United States Patent
Henley et al.

(10) Patent No.: US 11,098,325 B2
(45) Date of Patent: Aug. 24, 2021

(54) ADENO-ASSOCIATED VIRAL VECTORS FOR GENE THERAPY

(71) Applicant: Intima Bioscience, Inc., New York, NY (US)

(72) Inventors: Thomas Henley, Cambridgeshire (GB); Mavis Agbandje-McKenna, Gainesville, FL (US); Tilmann Buerckstuemmer, Vienna (AT); Lydia Viney, Cambridgeshire (GB); Modassir Choudhry, New York, NY (US)

(73) Assignee: INTIMA BIOSCIENCE, INC., New Yok, NY (US)

( * ) Notice: Subject to any disclaimer, the term of this patent is extended or adjusted under 35 U.S.C. 154(b) by 0 days.

(21) Appl. No.: 16/718,400

(22) Filed: Dec. 18, 2019

(65) Prior Publication Data

US 2020/0354743 A1   Nov. 12, 2020

Related U.S. Application Data

(63) Continuation of application No. PCT/US2018/040480, filed on Jun. 29, 2018.

(60) Provisional application No. 62/665,256, filed on May 1, 2018, provisional application No. 62/659,472, filed on Apr. 18, 2018, provisional application No. 62/527,937, filed on Jun. 30, 2017.

(51) Int. Cl.
| | |
|---|---|
| *C12N 15/86* | (2006.01) |
| *A61P 35/00* | (2006.01) |
| *A61K 35/17* | (2015.01) |
| *A61K 48/00* | (2006.01) |

(52) U.S. Cl.
CPC .............. *C12N 15/86* (2013.01); *A61K 35/17* (2013.01); *A61P 35/00* (2018.01); *A61K 48/00* (2013.01); *C12N 2750/14122* (2013.01); *C12N 2750/14143* (2013.01)

(58) Field of Classification Search
CPC .......... C12N 15/86; C12N 2750/14122; C12N 2750/14143; C12N 2750/14145; C12N 2310/20; C12N 9/22; A61P 35/00; A61K 35/17; A61K 48/00; A61K 48/005; C07K 2319/00; C07K 14/7051; C07K 14/005
See application file for complete search history.

(56) References Cited

U.S. PATENT DOCUMENTS

| | | | |
|---|---|---|---|
| 5,830,755 A | 11/1998 | Nishimura et al. | |
| 5,831,016 A | 11/1998 | Wang et al. | |
| 5,840,526 A | 11/1998 | Casterman et al. | |
| 5,906,936 A | 5/1999 | Eshhar et al. | |
| 6,132,980 A | 10/2000 | Wang et al. | |
| 6,187,306 B1 | 2/2001 | Pardoll et al. | |
| 6,207,147 B1 | 3/2001 | Hiserodt et al. | |
| 7,070,995 B2 | 7/2006 | Jensen | |
| 7,265,209 B2 | 9/2007 | Jensen | |
| 7,446,190 B2 | 11/2008 | Sadelain et al. | |
| 7,608,410 B2 | 10/2009 | Dunn et al. | |
| 7,619,057 B2 | 11/2009 | Wang et al. | |
| 7,723,111 B2 | 5/2010 | Hwu et al. | |
| 7,741,465 B1 | 6/2010 | Eshhar et al. | |
| 7,763,718 B2 | 7/2010 | Jakobsen et al. | |
| 7,868,158 B2 | 1/2011 | Chen et al. | |
| 8,211,422 B2 | 7/2012 | Eshhar et al. | |
| 8,354,516 B2 | 1/2013 | Endl et al. | |
| 8,367,804 B2 | 2/2013 | Boulter et al. | |
| 8,389,282 B2 | 3/2013 | Sadelain et al. | |
| 8,399,645 B2 | 3/2013 | Campana et al. | |
| 8,486,694 B2 | 7/2013 | Schendel et al. | |
| 8,541,204 B2 | 9/2013 | Endl et al. | |
| 8,546,553 B2 | 10/2013 | Terns et al. | |
| 8,697,359 B1 | 4/2014 | Zhang | |
| 8,754,046 B2 | 6/2014 | Wang et al. | |
| 8,771,945 B1 | 7/2014 | Zhang | |
| 8,795,965 B2 | 8/2014 | Zhang | |
| 8,865,406 B2 | 10/2014 | Zhang et al. | |
| 8,871,445 B2 | 10/2014 | Cong et al. | |
| 8,889,356 B2 | 11/2014 | Zhang | |
| 8,889,365 B2 | 11/2014 | Madura et al. | |
| 8,889,418 B2 | 11/2014 | Zhang et al. | |
| 8,895,308 B1 | 11/2014 | Zhang et al. | |
| 8,906,616 B2 | 12/2014 | Zhang et al. | |
| 8,921,332 B2 | 12/2014 | Choulika et al. | |
| 8,932,814 B2 | 1/2015 | Cong et al. | |
| 8,945,839 B2 | 2/2015 | Zhang | |

(Continued)

FOREIGN PATENT DOCUMENTS

| | | |
|---|---|---|
| CN | 103820454 B | 3/2016 |
| EP | 2258720 A1 | 12/2010 |

(Continued)

OTHER PUBLICATIONS

Grosse S, Penaud-Budloo M, Herrmann AK, Borner K, Fakhiri J, Laketa V, Kramer C, Wiedtke E, et. al. Relevance of Assembly-Activating Protein for Adeno-associated Virus Vector Production and Capsid Protein Stability in Mammalian and Insect Cells. J Virol. Sep. 27, 2017;91(20):e01198-17. (Year: 2017).*

(Continued)

*Primary Examiner* — Rachel B Gill

(74) *Attorney, Agent, or Firm* — Greenberg Traurig, LLP

(57) ABSTRACT

Genetically modified compositions, such as adeno-associated viral vectors and primary cells, for treating various conditions and diseases. Disclosed are also modified adeno-associated viruses for the treatment of cancer. Also disclosed are the methods of making and using the genetically modified compositions in treating various diseases, conditions, and cancer.

20 Claims, 70 Drawing Sheets

Specification includes a Sequence Listing.

(56) References Cited

U.S. PATENT DOCUMENTS

| | | |
|---|---|---|
| 8,993,233 B2 | 3/2015 | Zhang et al. |
| 8,999,641 B2 | 4/2015 | Zhang et al. |
| 9,023,649 B2 | 5/2015 | Mali et al. |
| 9,074,185 B2 | 7/2015 | Dudley et al. |
| 9,131,589 B2 | 9/2015 | Hayashi et al. |
| 9,234,213 B2 | 1/2016 | Wu |
| 9,260,723 B2 | 2/2016 | Mali et al. |
| 9,260,752 B1 | 2/2016 | May et al. |
| 9,362,208 B2 | 6/2016 | Schwab et al. |
| 9,393,257 B2 | 7/2016 | Osborn et al. |
| 9,404,098 B2 | 8/2016 | Terns et al. |
| 9,410,198 B2 | 8/2016 | May et al. |
| 9,422,553 B2 | 8/2016 | Terns et al. |
| 9,458,439 B2 | 10/2016 | Choulika et al. |
| 9,506,052 B2 | 11/2016 | Samulski |
| 9,570,114 B1 | 2/2017 | Sudo et al. |
| 10,406,177 B2 | 9/2019 | Moriarity et al. |
| 10,550,405 B2 | 2/2020 | Li et al. |
| 10,793,835 B2* | 10/2020 | Yan ................. A61K 39/23 |
| 2002/0045264 A1* | 4/2002 | During ................. A61P 11/00 435/456 |
| 2003/0040101 A1 | 2/2003 | Wilson |
| 2004/0023388 A1 | 2/2004 | Rozwadowski et al. |
| 2005/0250207 A1 | 11/2005 | Rozwadowski et al. |
| 2007/0274974 A1 | 11/2007 | Bonyhadi et al. |
| 2008/0009447 A1 | 1/2008 | Nash et al. |
| 2009/0197338 A1 | 8/2009 | Vandenberghe et al. |
| 2009/0220488 A1 | 9/2009 | Gardner |
| 2009/0220582 A1 | 9/2009 | Min |
| 2010/0076057 A1 | 3/2010 | Sontheimer et al. |
| 2010/0093617 A1 | 4/2010 | Barrangou et al. |
| 2010/0104556 A1 | 4/2010 | Blankenstein et al. |
| 2011/0136895 A1 | 6/2011 | Gregory et al. |
| 2011/0158957 A1 | 6/2011 | Bonini et al. |
| 2011/0189141 A1 | 8/2011 | Kieback et al. |
| 2012/0135022 A1* | 5/2012 | Sonntag ................. A61P 25/30 424/186.1 |
| 2012/0192298 A1 | 7/2012 | Weinstein et al. |
| 2013/0011828 A1 | 1/2013 | Barrangou et al. |
| 2013/0288237 A1 | 10/2013 | Robins et al. |
| 2013/0309258 A1 | 11/2013 | June et al. |
| 2013/0315884 A1 | 11/2013 | Galetto et al. |
| 2014/0004132 A1 | 1/2014 | Brenner et al. |
| 2014/0068797 A1 | 3/2014 | Doudna et al. |
| 2014/0099284 A1 | 4/2014 | Horsager et al. |
| 2014/0106449 A1 | 4/2014 | June et al. |
| 2014/0113375 A1 | 4/2014 | Liu |
| 2014/0113376 A1 | 4/2014 | Sorek et al. |
| 2014/0120622 A1 | 5/2014 | Gregory et al. |
| 2014/0134142 A1 | 5/2014 | Smith et al. |
| 2014/0141026 A1 | 5/2014 | Schendel et al. |
| 2014/0179770 A1 | 6/2014 | Zhang et al. |
| 2014/0199334 A1 | 7/2014 | Sasikumar et al. |
| 2014/0199767 A1 | 7/2014 | Barrangou et al. |
| 2014/0227237 A1 | 8/2014 | June et al. |
| 2014/0242049 A1 | 8/2014 | Choi et al. |
| 2014/0242671 A1 | 8/2014 | Grieger et al. |
| 2014/0242702 A1 | 8/2014 | Chen et al. |
| 2014/0273223 A1 | 9/2014 | Cho et al. |
| 2014/0273226 A1 | 9/2014 | Wu |
| 2014/0273230 A1 | 9/2014 | Chen et al. |
| 2014/0294773 A1 | 10/2014 | Brouns et al. |
| 2014/0295556 A1 | 10/2014 | Joung et al. |
| 2014/0295557 A1 | 10/2014 | Joung et al. |
| 2014/0302563 A1 | 10/2014 | Doudna et al. |
| 2014/0315985 A1 | 10/2014 | May et al. |
| 2014/0342456 A1 | 11/2014 | Mali et al. |
| 2014/0342457 A1 | 11/2014 | Mali et al. |
| 2014/0359799 A1 | 12/2014 | Wang et al. |
| 2015/0011007 A1 | 1/2015 | Liu et al. |
| 2015/0017136 A1 | 1/2015 | Galetto et al. |
| 2015/0020223 A1 | 1/2015 | Zhang et al. |
| 2015/0020233 A1 | 1/2015 | Harriman et al. |
| 2015/0024499 A1 | 1/2015 | Brouns et al. |
| 2015/0031133 A1 | 1/2015 | Church et al. |
| 2015/0031134 A1 | 1/2015 | Zhang et al. |
| 2015/0044772 A1 | 2/2015 | Zhao |
| 2015/0045546 A1 | 2/2015 | Siksnys et al. |
| 2015/0050699 A1 | 2/2015 | Siksnys et al. |
| 2015/0056705 A1 | 2/2015 | Conway et al. |
| 2015/0059010 A1 | 2/2015 | Cigan et al. |
| 2015/0067898 A1 | 3/2015 | Fahrenkrug et al. |
| 2015/0079681 A1 | 3/2015 | Zhang |
| 2015/0082478 A1 | 3/2015 | Cigan et al. |
| 2015/0098954 A1 | 4/2015 | Hyde et al. |
| 2015/0140664 A1 | 5/2015 | Byrne et al. |
| 2015/0141347 A1 | 5/2015 | Parkhurst et al. |
| 2015/0152436 A1 | 6/2015 | Musunuru et al. |
| 2015/0158822 A1 | 6/2015 | Raghavan et al. |
| 2015/0166980 A1 | 6/2015 | Liu et al. |
| 2015/0176013 A1 | 6/2015 | Musunuru et al. |
| 2015/0184139 A1 | 7/2015 | Zhang et al. |
| 2015/0203872 A1 | 7/2015 | Zhang |
| 2015/0211023 A1 | 7/2015 | Shiboleth et al. |
| 2015/0225741 A1 | 8/2015 | Horsager et al. |
| 2015/0232881 A1 | 8/2015 | Glucksmann et al. |
| 2015/0232883 A1 | 8/2015 | Dahlman et al. |
| 2015/0240261 A1 | 8/2015 | Siksnys et al. |
| 2015/0247150 A1 | 9/2015 | Zhang et al. |
| 2015/0259684 A1 | 9/2015 | Church et al. |
| 2015/0259704 A1 | 9/2015 | Church et al. |
| 2015/0284727 A1 | 10/2015 | Kim et al. |
| 2015/0291961 A1 | 10/2015 | Siksnys et al. |
| 2015/0291965 A1 | 10/2015 | Zhang et al. |
| 2015/0291966 A1 | 10/2015 | Zhang et al. |
| 2015/0306141 A1 | 10/2015 | Jensen et al. |
| 2015/0322457 A1 | 11/2015 | Kim et al. |
| 2015/0344912 A1 | 12/2015 | Kim et al. |
| 2015/0353917 A1 | 12/2015 | Miller et al. |
| 2015/0356239 A1 | 12/2015 | Zhang et al. |
| 2016/0002670 A1 | 1/2016 | Church et al. |
| 2016/0007929 A1 | 1/2016 | Chuang et al. |
| 2016/0017366 A1 | 1/2016 | Chen et al. |
| 2016/0024523 A1 | 1/2016 | Joung et al. |
| 2016/0024524 A1 | 1/2016 | Joung et al. |
| 2016/0032274 A1 | 2/2016 | Church et al. |
| 2016/0046949 A1 | 2/2016 | May et al. |
| 2016/0046961 A1 | 2/2016 | Jinek et al. |
| 2016/0046962 A1 | 2/2016 | May et al. |
| 2016/0060330 A1 | 3/2016 | Presta |
| 2016/0060653 A1 | 3/2016 | Doudna et al. |
| 2016/0060654 A1 | 3/2016 | Doudna et al. |
| 2016/0068864 A1 | 3/2016 | Doudna et al. |
| 2016/0068887 A1 | 3/2016 | May et al. |
| 2016/0076020 A1 | 3/2016 | May et al. |
| 2016/0108470 A1 | 4/2016 | May et al. |
| 2016/0115488 A1 | 4/2016 | Zhang et al. |
| 2016/0115489 A1 | 4/2016 | Zhang et al. |
| 2016/0120906 A1 | 5/2016 | Galetto et al. |
| 2016/0123990 A1 | 5/2016 | High et al. |
| 2016/0130609 A1 | 5/2016 | Doudna et al. |
| 2016/0138027 A1 | 5/2016 | Gan et al. |
| 2016/0138046 A1 | 5/2016 | Wu et al. |
| 2016/0153004 A1 | 6/2016 | Zhang et al. |
| 2016/0153005 A1 | 6/2016 | Zhang et al. |
| 2016/0153006 A1 | 6/2016 | Zhang et al. |
| 2016/0160210 A1 | 6/2016 | Mali et al. |
| 2016/0168594 A1 | 6/2016 | Zhang et al. |
| 2016/0175462 A1 | 6/2016 | Zhang et al. |
| 2016/0184362 A1 | 6/2016 | Duchateau et al. |
| 2016/0186152 A1 | 6/2016 | Brouns et al. |
| 2016/0186213 A1 | 6/2016 | Zhang et al. |
| 2016/0186214 A1 | 6/2016 | Brouns et al. |
| 2016/0208243 A1 | 7/2016 | Zhang et al. |
| 2016/0210905 A1 | 7/2016 | Lee et al. |
| 2016/0237455 A1 | 8/2016 | Glucksmann et al. |
| 2016/0251640 A1 | 9/2016 | May et al. |
| 2016/0272965 A1 | 9/2016 | Zhang et al. |
| 2016/0281072 A1 | 9/2016 | Zhang |
| 2016/0289675 A1 | 10/2016 | Ryan et al. |
| 2016/0298096 A1 | 10/2016 | Charpentier et al. |
| 2016/0304907 A1 | 10/2016 | Mali et al. |

(56) References Cited

U.S. PATENT DOCUMENTS

| | | |
|---|---|---|
| 2016/0319349 A1 | 11/2016 | May et al. |
| 2016/0348073 A1 | 12/2016 | Meissner et al. |
| 2016/0355816 A1 | 12/2016 | Terns et al. |
| 2017/0009256 A1 | 1/2017 | Buerckstuemmer |
| 2017/0028082 A1 | 2/2017 | Wilson et al. |
| 2017/0028083 A1 | 2/2017 | Beisel et al. |
| 2017/0037416 A1 | 2/2017 | Barrangou et al. |
| 2017/0051310 A1 | 2/2017 | Doudna et al. |
| 2017/0051312 A1 | 2/2017 | Jinek et al. |
| 2017/0067021 A1 | 3/2017 | Moriarity et al. |
| 2017/0073695 A1 | 3/2017 | Verruto et al. |
| 2017/0119820 A1 | 5/2017 | Moriarity et al. |
| 2017/0130200 A1 | 5/2017 | Moriarity et al. |
| 2017/0130245 A1 | 5/2017 | Kotin et al. |
| 2017/0172936 A1 | 6/2017 | Okada et al. |
| 2017/0175128 A1 | 6/2017 | Welstead et al. |
| 2017/0175142 A1 | 6/2017 | Zhang et al. |
| 2018/0030110 A1 | 2/2018 | Powell, Jr. |
| 2018/0051300 A1* | 2/2018 | Kay ................. A61K 35/76 |
| 2018/0169273 A1 | 6/2018 | Ferreira |
| 2018/0298101 A1 | 10/2018 | Huntington et al. |
| 2019/0032091 A1 | 1/2019 | Dever et al. |
| 2019/0054122 A1 | 2/2019 | Moriarity et al. |
| 2019/0060363 A1 | 2/2019 | Moriarity et al. |
| 2019/0060364 A1 | 2/2019 | Moriarity et al. |
| 2019/0264189 A1 | 8/2019 | Hammond et al. |
| 2019/0330308 A1 | 10/2019 | Samulski |
| 2019/0374576 A1* | 12/2019 | Henley ................. C12N 15/11 |
| 2020/0354744 A1* | 11/2020 | Finn ................. C12N 15/86 |
| 2020/0370039 A1* | 11/2020 | Grimm ............. C12N 15/1037 |

FOREIGN PATENT DOCUMENTS

| | | | |
|---|---|---|---|
| EP | 3004337 B1 | 8/2017 | |
| WO | 200028004 A1 | 5/2000 | |
| WO | 200168888 A2 | 9/2001 | |
| WO | WO-2007025097 A2 | 3/2007 | |
| WO | WO-2007136815 A2 | 11/2007 | |
| WO | WO-2010011961 A2 | 1/2010 | |
| WO | WO-2010025177 | 3/2010 | |
| WO | WO-2010054108 A2 | 5/2010 | |
| WO | WO-2010093784 A2 | 8/2010 | |
| WO | 2010/099960 | 10/2010 | |
| WO | WO-2011117258 A2 | 9/2011 | |
| WO | 2012/031760 | 3/2012 | |
| WO | WO-2012078540 A1 | 6/2012 | |
| WO | WO-2012112079 A1 | 8/2012 | |
| WO | WO-2012129514 | 9/2012 | |
| WO | WO-2012164565 A1 | 12/2012 | |
| WO | WO-2013049330 A1 | 4/2013 | |
| WO | WO-2013074916 A1 | 5/2013 | |
| WO | WO-2013088446 A1 | 6/2013 | |
| WO | WO-2013098244 A1 | 7/2013 | |
| WO | WO-2013141680 A1 | 9/2013 | |
| WO | WO-2013176772 A1 | 11/2013 | |
| WO | WO-2013176915 A1 | 11/2013 | |
| WO | WO-2014018423 A2 | 1/2014 | |
| WO | WO-2014022702 A2 | 2/2014 | |
| WO | WO-2014059173 A2 | 4/2014 | |
| WO | WO-2014065596 A1 | 5/2014 | |
| WO | WO-2014/093661 | 6/2014 | |
| WO | WO-2014083173 A1 | 6/2014 | |
| WO | WO-2014089290 | 6/2014 | |
| WO | WO-2014089290 A1 | 6/2014 | |
| WO | WO-2014093595 | 6/2014 | |
| WO | WO-2014093595 A1 | 6/2014 | |
| WO | WO-2014093622 A2 | 6/2014 | |
| WO | WO-2014093655 A2 | 6/2014 | |
| WO | WO-2014093661 A2 | 6/2014 | |
| WO | WO-2014093709 A1 | 6/2014 | |
| WO | WO-2014093712 A1 | 6/2014 | |
| WO | WO-2014093718 | 6/2014 | |
| WO | WO-2014099744 A1 | 6/2014 | |
| WO | WO-2014099750 A2 | 6/2014 | |
| WO | WO-2014127287 | 8/2014 | |
| WO | WO-2014130955 A1 | 8/2014 | |
| WO | WO-2014134165 A1 | 9/2014 | |
| WO | WO-2014150624 A1 | 9/2014 | |
| WO | WO-2014165825 A2 | 10/2014 | |
| WO | WO-2014184741 A1 | 11/2014 | |
| WO | WO-2014184744 | 11/2014 | |
| WO | WO-2014184744 A1 | 11/2014 | |
| WO | WO-2014186585 | 11/2014 | |
| WO | WO-2014186585 A2 | 11/2014 | |
| WO | WO-2014191128 | 12/2014 | |
| WO | WO-2014191128 A1 | 12/2014 | |
| WO | WO-2014191518 A1 | 12/2014 | |
| WO | WO-2014204723 A1 | 12/2014 | |
| WO | WO-2014204725 A1 | 12/2014 | |
| WO | WO-2014204726 A1 | 12/2014 | |
| WO | WO-2014204727 A1 | 12/2014 | |
| WO | WO-2014204728 A1 | 12/2014 | |
| WO | WO-2014204729 A1 | 12/2014 | |
| WO | WO-2015006294 A2 | 1/2015 | |
| WO | WO-2015026887 A1 | 2/2015 | |
| WO | WO-2015048577 A2 | 4/2015 | |
| WO | WO-2015048690 | 4/2015 | |
| WO | WO-2015052133 A1 | 4/2015 | |
| WO | WO-2015053995 A1 | 4/2015 | |
| WO | WO-2015054253 A1 | 4/2015 | |
| WO | WO-2015070083 A1 | 5/2015 | |
| WO | WO-2015071474 A2 | 5/2015 | |
| WO | WO-2015079056 A1 | 6/2015 | |
| WO | WO-2015084897 A2 | 6/2015 | |
| WO | WO-2015089419 A2 | 6/2015 | |
| WO | WO-2015136001 | 9/2015 | |
| WO | WO-2015142675 A2 | 9/2015 | |
| WO | WO-2015143328 A1 | 9/2015 | |
| WO | 2015148454 A1 | 10/2015 | |
| WO | WO-2015155686 A2 | 10/2015 | |
| WO | WO-2015157534 A1 | 10/2015 | |
| WO | WO-2015164675 A1 | 10/2015 | |
| WO | WO-2015188228 | 12/2015 | |
| WO | WO-2015191693 | 12/2015 | |
| WO | WO-2016011210 | 1/2016 | |
| WO | WO-2016053338 A1 | 4/2016 | |
| WO | WO-2016054326 A1 | 4/2016 | |
| WO | WO-2016057821 A2 | 4/2016 | |
| WO | WO-2016057835 A2 | 4/2016 | |
| WO | WO-2016057961 A1 | 4/2016 | |
| WO | WO-2016/069283 | 5/2016 | |
| WO | WO-2016089433 | 6/2016 | |
| WO | WO-2016112351 | 7/2016 | |
| WO | WO-2016115326 | 7/2016 | |
| WO | WO-2016183345 A1 | 11/2016 | |
| WO | WO-2017011519 A1 | 1/2017 | |
| WO | WO-2017023801 A1 | 2/2017 | |
| WO | WO-2017023803 A1 | 2/2017 | |
| WO | WO-2017048593 A1 | 3/2017 | |
| WO | 2017/100674 | 6/2017 | |
| WO | WO-2017139264 A1 | 8/2017 | |
| WO | 2017180854 A1 | 10/2017 | |
| WO | WO-2018014038 A1 * | 1/2018 | ............. C07K 14/78 |
| WO | WO-2018081470 A1 | 5/2018 | |
| WO | WO-2018081476 A2 | 5/2018 | |
| WO | 2018/170310 | 9/2018 | |
| WO | WO-2019006418 | 1/2019 | |
| WO | 2019025984 A1 | 2/2019 | |
| WO | WO-2019051278 A1 | 3/2019 | |

OTHER PUBLICATIONS

Adamson-Small, et al., "Sodium Chloride Enhances Recombinant Adeno-Associated virus Production in a Serum-Free Suspension Manufacturing Platform Using the Herpes Simplex virus System", Human Gene Therapy Methods, V. 28, No. 1 (2017).

Ahmadi, et al. CD3 limits the efficacy of TCR gene therapy in vivo. Blood. Sep. 29, 2011;118(13):3528-37. doi: 10.1182/blood-2011-04-346338. Epub Jul. 12, 2011.

Arap, et al. Cancer treatment by targeted drug delivery to tumor vasculature in a mouse model. Science. Jan. 16, 1998;279(5349):377-80.

(56) References Cited

OTHER PUBLICATIONS

Aronovich, E.L., et al., "The Sleeping Beauty transposon system: a non-viral vector for gene therapy," Human Molecular Genetics, vol. 20, Review Issue 1, R14-R20, Apr. 1, 2011.
Baumgaertner, et al. Ex vivo detectable human CD8 T-cell responses to cancer-testis antigens. Cancer Res. Feb. 15, 2006;66(4):1912-6.
Beane, et al. Clinical Scale Zinc Finger Nuclease-mediated Gene Editing of PD-1 in Tumor Infiltrating Lymphocytes for the Treatment of Metastatic Melanoma. Mol Ther. Aug. 2015;23(8):1380-90. doi: 10.1038/mt.2015.71. Epub May 5, 2015.
Bennett, A. et al., Original Article Thermal Stability as a Determinant of AAV Stereotype Identity, Molecular Therapy: Methods & Clinical Development, Jul. 24, 2017, vol. 6; pp. 171-182.
Budloo, et al. "Pharmacology of Recombinant Adeno-associated Virus Production" Molecular Therapy: Methods & Clinical Development, vol. 8, Mar. 2018.
Cao, et al., "The X Gene of Adeno-Associated Virus 2 (AAV2) is involved in Vireal DNA Replication" PLOS One, pp. 1-11, 2014.
Carosella, Edgardo D. et al., A Systematic Review of Immunotherapy in Urologic Cancer: Evolving Roles for Targeting of CTLA-4, PD-1/PD-L1, and HLA-G, Eur. Urol Aug. 2015;68(2):267-79.
Center for Cancer Research. Investigational New Drug Application. U.S. Food and Drug Administration. Complete Submission. BB-IND 17614. SN 0001. Aug. 4, 2017. 13 pages.
Center for Cancer Research. Investigational New Drug Application. U.S. Food and Drug Administration. Complete Submission. BB-IND 17614. SN 0002. Aug. 15, 2017. 187 pages.
Chacon, et al. Continuous 4-1BB co-stimulatory signals for the optimal expansion of tumor-infiltrating lymphocytes for adoptive T-cell therapy. Oncoimmunology. Sep. 1, 2013;2(9):e25581. Epub Jul. 3, 2013.
Chacon, et al. Co-stimulation through 4-1BB/CD137 improves the expansion and function of CD8(+) melanoma tumor-infiltrating lymphocytes for adoptive T-cell therapy. PLoS One. 2013;8(4):e60031. doi: 10.1371/journal.pone.0060031. Epub Apr. 1, 2013.
Chai, et al. "Application of polyploid adeno-associated virus vectors for transduction enhancement and neutralizing antibody evasion", J Control Release. Sep. 28, 2017; 262: 348-356.
Chai, et al. "Chimeric Capsid Proteins Impact Transduction Efficiency of Haploid Adeno-Associated Virus Vectors", Viruses 2019, vol. 11, 1138, pp. 2-13.
Chan, et al. Viral evasion of intracellular DNA and RNA sensing. Nat Rev Microbiol. Jun. 2016;14(6):360-73. doi: 10.1038/nrmicro. 2016.45. Epub May 13, 2016.
Chen, et al. Molecular mechanism for silencing virally transduced genes involves histone deacetylation and chromatin condensation. Proc Natl Acad Sci U S A. Jan. 4, 2000;97(1):377-82.
Chen, et al. Reactivation of silenced, virally transduced genes by inhibitors of histone deacetylase. Proc Natl Acad Sci U S A. May 27, 1997;94(11):5798-803.
Chen et al. Silencing of episomal transgene expression by plasmid bacterial DNA elements in vivo. Gene Ther. May 2004;11(10):856-64.
Chikuma, et al. Suppressors of cytokine signaling: Potential immune checkpoint molecules for cancer immunotherapy: Cancer Sci 108 (2017) 574-580.
Chng, et al., "Cleavage efficient 2A peptides for high level monoclonal antibody expression in CHO cells", Bioprocessing Technology Institute, pp. 403-412, (2015).
"Cho, et al. Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.".
Cho, S et al Producing conjugate linoleic acid useful for preparing fermented milk used in dairy products for lowering blood cholesterol and treating cancer, involves culturing Bifidobacterium breve in culture medium, WPI / Thomson, vol. 2012, No. 42, Dec. 27, 2010 (Dec. 27, 2010), XP002711389, cf. WPI.
Chu, et al. Increasing the efficiency of homology-directed repair for CRISPR-Cas9-induced precise gene editing in mammalian cells. Nat Biotechnol. May 2015;33(5):543-8. doi: 10.1038/nbt.3198. Epub Mar. 24, 2015.
clinicaltrials.gov: Archive: NC100501995 on Oct. 9, 2016 [online]. U.S. National Institute of Health. Oct. 9, 2016 [retrieved on Jan. 10, 2018]. Retrieved for the internet<https://clinicaltrials.gov/archive/NCT00501995/2016_10_09>.
CLR, RLR, & CDS Signaling Pathways. InvivoGen. Poster. 2016. www.invivogen.com/docs/2016-Poster_CLR-RLR-CDS-invivogen.pdf.
Cong, et al. Multiplex genome engineering using CRISPR/Cas systems. Science. 339.6121 (Feb. 15, 2013): 819-23. doi: 10.1126/science.1231143. Epub Jan. 3, 2013.
Co-pending U.S. Appl. No. 16/389,586, filed Apr. 19, 2019.
Co-pending U.S. Appl. No. 16/389,612, filed Apr. 19, 2019.
Delconte, et al., CIS is a potent checkpoint in NK cell-mediated tumor immunity. Nat Immunol, Jul. 2016; 17(7):816-24.
Donia, et al., (2013), Methods to Improve Adoptive T-Cell Therapy for Melanoma: IFN-g Enhances Anticancer Responses of Cell Products for Infusion. Journal of Investigative Dermatology, 133:545-552.
Dudley et al. Adoptive Cell Transfer Therapy Following Non-Myeloablative but Lymphodepleting Chemotherapy for the Treatment of Patients With Refractory Metastatic Melanoma. J Clin Oncol. 23(10):2346-2357 (2005).
Examiner's Summary Action dated Jul. 18, 2019 for U.S. Appl. No. 16/182,189.
Examiner-Initiated Interview Summary dated for U.S. Appl. No. 16/182,146 dated Jan. 24, 2019.
Extended European Search Report for EP 16833645.1 dated Nov. 9, 2018.
Feoktistova, et al. Programmed necrosis and necroptosis signalling. FEBS J. Jan. 2015;282(1):19-31. doi: 10.1111/febs.13120. Epub Nov. 11, 2014. Review.
Final Rejection dated May 15, 2019 for U.S. Appl. No. 15/256,086.
Fu, et al. High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.
Fu et al. Improving CRISPR-Cas nuclease specificity using truncated guide RNAs. Nat Biotechnol 32(3):279-284 (2013).
Gao, et al. Structure-function analysis of STING activation by c[G(2',5')pA(3',5')p] and targeting by antiviral DMXAA. Cell. Aug. 15, 2013;154(4):748-62. doi: 10.1016/j.cell.2013.07.023. Epub Aug. 1, 2013.
Gao GP, Alvira MR, Wang L, Calcedo R, Johnston J, Wilson JM. 2002. Novel adeno-associated viruses from rhesus monkeys as vectors for human gene therapy. Proc Natl Acad Sci USA 99(18):11854-11859.5.
Goff et al. Randomized, Prospective Evaluation Comparing Intensity of Lymphodepletion Before Adoptive Transfer of Tumor-Infiltrating Lymphocytes for Patients With Metastatic Melanoma. J Clin Oncol. Jul. 10, 2016;34(20):2389-97.
Guschin, et al. A rapid and general assay for monitoring endogenous gene modification. Methods Mol Biol. 649 (2010): 247-56. doi: 10.1007/978-1-60761-753-2_15.
Gwiazda, et al. High Efficiency CRISPR/Cas9-mediated Gene Editing in Primary Human T-cells Using Mutant Adenoviral E4orf6/E1b55k "Helper" Proteins. Mol Ther. Jun. 28, 2016. doi: 10.1038/mt.2016.105.
Hamid, et al. Safety and tumor responses with lambrolizumab (anti-PD-1) in melanoma. N Engl J Med. Jul. 11, 2013;369(2):134-44. doi: 10.1056/NEJMoa1305133. Epub Jun. 2, 2013.
Harrison. Competitive repopulation: a new assay for long-term stem cell functional capacity. Blood. Jan. 1980;55(1):77-81.
Hauck, et al. "Generation and Characterization of Chimeric Recombinant AAV Vectors", Mol Ther. Mar. 2003; 7(3): 419-425.
Hendel, et al. Chemically modified guide RNAs enhance CRISPR-Cas genome editing in human primary cells. Nat Biotechnol. Sep. 2015;33(9):985-9. doi: 10.1038/nbt.3290. Epub Jun. 29, 2015.
Hermann, A.K., et al., Impact of the Assembly-Activating Protein on Molecular Evolution of Synthetic Adeno-Associated Virus Capsids, Hum Gene Ther. Jan. 2019. 30(1):21-35.

(56) References Cited

OTHER PUBLICATIONS

Herrmann, Ann-Kathrin et al. Impact of the Assembly-Activating Protein on Molecular Evolution of Synthetic Adeono-Associated Virus Capsids, Human Gene Therapy, vol. 30, No. 1, pp. 21-35, 2019 by Mary Ann Liebert, Inc., DOI: 10.1089/hum.2018.085.
Hilton, et al., Twenty proteins containing a C-terminal SOCS box form five structural classes. Proc. Natl. Acad. Sci. Jan. 1998;95:114-119.
Hinrichs, C.S., et al.,Human effector CD8+ T cells derived from naive rather than memory subsets possess superior traits for adoptive immunotherapy, Blood, 117(3):808-814, Jan. 20, 2011.
Hirata et al. Targeted transgene insertion into human chromosomes by adeno-associated virus vectors. Nature Biotechnology 20 (2002): 735-738.
*Homo sapiens* cytokine inducible SH2 containing protein (CISH), RefSeqGene on chromosome 3 NCBI Reference Sequence: NG_023194.1 pp. 1-5; downloaded May 31, 2017.
Hsu, et al. Development and applications of CRISPR-Cas9 for genome engineering. Cell. Jun. 5, 2014;157(6):1262-78. doi: 10.1016/j.cell.2014.05.010.
Hu et al. MicroRNA-98 and let-7 Confer Cholangiocyte Expression of Cytokine-Inducible Src Homology 2-Containing Protein in Response to Microbial Challenge. J Immunol. Aug. 1, 2009; 183(3): 1617-1624.
Hunder, et al. Treatment of metastatic melanoma with autologous CD4+ T cells against NY-ESO-1. N Engl J Med. Jun. 19, 2008;358(25):2698-703. doi: 10.1056/NEJMoa0800251.
Idorn, et al. Transfection of Tumor-Infiltrating T Cells with mRNA Encoding CXCR2. Methods Mol Biol. 2016;1428:261-76. doi: 10.1007/978-1-4939-3625-0_17.
International Search Report and Written Opinion dated Jan. 12, 2018 for International PCT Patent Application No. PCT/US2017/058605.
International Search Report and Written Opinion dated Oct. 17, 2016 for International PCT Patent Application No. PCT/US2016/044856.
International Search Report and Written Opinion dated Jan. 11, 2019 for PCT/US18/040480 (WO 2019/006418).
International Search Report and Written Opinion dated Nov. 16, 2016 for International PCT Patent Application No. PCT/US2016/044858.
International Search Report and Written Opinion dated Jan. 12, 2018 for PCT/US2017/058605.
International Search Report and Written Opinion dated Feb. 1, 2019 for PCT/US2018/050029.
International Search Report and Written Opinion dated Apr. 24, 2018 for PCT/US17/058615.
International Search Report Written Opinion dated Apr. 24, 2018 for PCT/US17/057228.
Invitrogen. Neon Transfer System: For transfecting mammalian cells, including primary and stem cells, with high transfection efficiency. User Guide. Life Technologies. Jul. 11, 2014. 52 pages.
InvivoGen Insight. Cytosolic DNA Sensors (CDSs): a sting in the tail. InvivoGen. Fall 2012. 8 pages.
Izmiryan et al. Efficient gene targeting mediated by a lentiviral vector-associated meganuclease. Nucleic Acids Res. Sep. 2011;39(17):7610-19.
Jiang, Chunling et al., (2000) Cloning and Characterization of CIS 1b (Cytokine Inducible SH2-Containing Protein 1b), an Alternative Splicing Form of CIS 1 Gene, DNA Sequence, vol. 11(1-2), pp. 149-154.
Jin, et al. Simplified method of the growth of human tumor infiltrating lymphocytes in gas-permeable flasks to numbers needed for patient treatment. J Immunother. Apr. 2012;35(3):283-92. doi: 10.1097/CJI.0b013e31824e801f.
Jinek, et al. A programmable dual-RNA-guided DNA endonuclease in adaptive bacterial immunity. Science. Aug. 17, 2012;337(6096):816-21. doi: 10.1126/science.1225829. Epub Jun. 28, 2012.
Johnson et al. Gene transfer of tumor-reactive TCR confers both high avidity and tumor reactivity to nonreactive peripheral blood mononuclear cells and tumor-infiltrating lymphocytes. J Immunol. Nov. 1, 2006;177(9):6548-59.
Keir, et al. PD-1 and its ligands in tolerance and immunity. Annu Rev Immunol. 2008;26:677-704. doi: 10.1146/annurev.immunol.26.021607.090331.
Klebanoff et al. Prospects for gene-engineered T cell immunotherapy for solid cancers. Nat Med 22(1):26-36 (2016).
Komor, et al., CRISPR-Based technologies for the manipulation of Eukaryotic genomes. Cell 168; Jan. 12, 2017: p. 20-36.
Krupovic, Mart et al., Capsosons: a new superfamily of self-synthesizing DNA transposons at the origin of prokaryotic CRISPR-Cas immunity, BMC Biology 2014, A12:36; doi.org/10.1186/1741-7007-12-36.
Legut et al. CRISPR-mediated TCR replacement generates superior anticancer transgenic T-cells. Blood. Nov. 9, 2017. pii: blood-2017-05-787598.
Letai. BH3 domains as BCL-2 inhibitors: prototype cancer therapeutics. Expert Opin Biol Ther. Apr. 2003;3(2):293-304.
Li et al. Heritable gene targeting in the mouse and rat using a CRISPR-Cas system. Nat Biotechnol. Aug. 2013;31(8):681-3.
Li, et al. HomeRun Vector Assembly System: a flexible and standardized cloning system for assembly of multi-modular DNA constructs. PLoS One. Jun. 24, 2014;9(6):e100948. doi: 10.1371/journal.pone.0100948. eCollection 2014.
Li, Shenglan et al., One-Step piggyBac Transposon-Based CRISR/Cas9 Activation of Multiple Genes, Molecular Therapy Nucleic Acids, vol. 8, p. 64-76, Sep. 15, 2017, DOI:https://doi.org/10.1016/j.omtn.2017.06.007.
Love et al. ITAM-mediated signaling by the T-cell antigen receptor. Cold Spring Harb Perspect Biol. 2(6):a002485 (2010).
Lu et al. Efficient identification of mutated cancer antigens recognized by T cells associated with durable tumor regressions. Clin Cancer Res. Jul. 1, 2014; 20(13): 3401-3410. Manuscript; Jul. 1, 2015.
Luo, et al., Comparative analysis of chimeric ZFP-, TALE- and Cas9-piggyBac transposases for integration into single locus in human cells. Nucleic Acids Res. Aug. 21, 2017; 45(14): 8411-8422.
Makarova et al. An updated evolutionary classification of CRISPR-Cas systems. Nat Rev Microbiol 13:722-736 (2015).
Mali, et al. RNA-Guided Human Genome Engineering via Cas9. Science. Feb. 15, 2013; 339(6121): 823-826. Published online Jan. 3, 2013. doi: 10.1126/science.1232033.
Maurer, et al., The assembly-activating protein promotes stability and interactions between AAV's viral proteins to nuclete capsid assembly. Cell Reports, 2018;23:1817-1830.
Menger, et al.TALEN-Mediated Inactivation of PD-1 in Tumor-Reactive Lymphocytes Promotes Intratumoral T-cell Persistence and Rejection of Established Tumors. Cancer Res. Apr. 15, 2016;76(8):2087-93. doi: 10.1158/0008-5472.CAN-15-3352.
Milone et al. Chimeric receptors containing CD137 signal transduction domains mediate enhanced survival of T cells and increased antileukemic efficacy in vivo. Mol Ther 17(8):1453-1464 (2009).
Monjezi et al. Enhanced Car T-cell engineering using non-viral Sleeping Beauty transposition from minicircle vectors. Leukemia. Jan. 2017;31(1):186-194.
Moriarity, Branden S., Modular assembly of transposon integratable multigene vectors using RecWay assembly, Nucleic Acids Research, 2013, vol. 41, No. 8, e92.
Moriarity, et al. Simple and efficient methods for enrichment and isolation of endonuclease modified cells. PLoS One. 9.5 (May 5, 2014): e96114. doi: 10.1371/journal.pone.0096114. eCollection 2014.
Natsume, et al. Rapid Protein Depletion in Human Cells by Auxin-Inducible Degron Tagging with Short Homology Donors. Cell Reports. 15(1):210-218 (2016).
De Witte, M. A., et al., Targeting self-antigens through allogeneic TCR gene transfer, Blood 108, 870-877, Jul. 22, 2006.
Neon Transfection System Protocols and Cell line data. ThermoFisher Scientific, p. 1; downloaded on May 30, 2017.
Non-Final Office Action dated Jan. 24, 2019 for U.S. Appl. No. 16/182,146.

(56) References Cited

OTHER PUBLICATIONS

Non-Final Office Action dated Dec. 5, 2018 for U.S. Appl. No. 15/224,159.
Non-Final Office Action dated Jun. 3, 2019 for U.S. Appl. No. 16/180,867.
Non-Final Office Action dated Jul. 25, 2019 for U.S. Appl. No. 16/182,189.
Ochi, et al. Novel adoptive T-cell immunotherapy using a WT1-specific TCR vector encoding silencers for endogenous TCRs shows marked antileukemia reactivity and safety. Blood. Aug. 11, 2011;118(6):1495-503. doi: 10.1182/blood-2011-02-337089. Epub Jun. 14, 2011.
Odunsi, et al. Epigenetic potentiation of NY-ESO-1 vaccine therapy in human ovarian cancer. Cancer Immunol Res. Jan. 2014;2(1):37-49. doi: 10.1158/2326-6066.CIR-13-0126.
Office Action dated Mar. 23, 2017 for U.S. Appl. No. 15/256,086.
Office Action dated Jun. 5, 2017 for U.S. Appl. No. 15/250,514.
Office Action dated Sep. 19, 2017 for U.S. Appl. No. 15/224,159.
Office Action dated Nov. 9, 2018 for U.S. Appl. No. 15/250,214.
Office Action dated Dec. 5, 2017 for U.S. Appl. No. 15/224,151.
Office Action dated Dec. 14, 2017 for U.S. Appl. No. 15/256,086.
Osborn, et al. Evaluation of TCR Gene Editing Achieved by TALENs, CRISPR/Cas9, and megaTAL Nucleases. Mol Ther. Mar. 2016;24(3):570-81. doi: 10.1038/mt.2015.197. Epub Oct. 27, 2015.
Overwijk et al. Tumor regression and autoimmunity after reversal of a functionally tolerant state of self-reactive CD8+ T cells. J Exp Med 198:569-580 (2003).
Palmer, et al. Cish actively silences TCR signaling in CD8+ T cells to maintain tumor tolerance. J Exp Med. Nov. 16, 2015;212(12):2095-113. doi: 10.1084/jem.20150304. Epub Nov. 2, 2015.
Palmer, et al. Cish attenuates proximal TCR-signaling and CD8+ T cell immunity. J Immunother Cancer. 2014; 2(Suppl 3): P32. Published online Nov. 6, 2014. doi: 10.1186/2051-1426-2-S3-P32.
Palmer et al. Effective tumor treatment targeting a melanoma/melanocyte-associated antigen triggers severe ocular autoimmunity. Proc Natl Acad Sci U S A. Jun. 10, 2008;105(23):8061-6.
Palmer, et al. Suppressors of cytokine signaling (SOCS) in T cell differentiation, maturation, and function. Trends Immunol. Dec. 2009;30(12):592-602. doi: 10.1016/j.it.2009.09.009. Epub Oct. 30, 2009.
Pauken, et al. Epigenetic stability of exhausted T cells limits durability of reinvigoration by PD-1 blockade. Science Oct. 27, 2016. 10 pages. DOI: 10.1126/science.aaf2807.
PCT/US2017/057228 International Search Report dated Mar. 22, 2018.
PCT/US2017/058615 International Search Report dated Apr. 24, 2018.
Peters, Joseph E. et al., Recruitment of CRISPR-Cas systems by Tn7-like transponsons, Journal List, Proc Natl Acad Sci USA, V. 114(35); Aug. 29, 2017, PMC5584455, 10.1073/pnas.1709035114PMCID:PMC5584455PMID: 28811374PNAS PlusMicrobiology.
Poirot et al. Multiplex Genome-Edited T-cell Manufacturing Platform for Off-the-ShelfAdoptive T-cell Immunotherapies. Cancer Research 75(18):3853-3864 (2015).
Postow, et al. Immune Checkpoint Blockade in Cancer Therapy. J Clin Oncol. Jun. 10, 2015;33(17):1974-82. doi: 10.1200/JCO.2014.59.4358. Epub Jan. 20, 2015.
PreInterview Action dated Feb. 25, 2019 for U.S. Appl. No. 16/180,867.
Pre-Interview Examiner first action, dated Mar. 21, 2019 for U.S. Appl. No. 16/182,189.
Pre-Interview Office Action dated May 31, 2019 for U.S. Appl. No. 15/947,688.
Pre-office action communication dated May 31, 2019 for U.S. Appl. No. 15/947,688.
Rabinowitz, et al. "Cross-Packaging of a Single Adeno-Associated Virus (AAV) Type 2 Vector Genome into Multiple AAV Serotypes Enable Transduction with Broad Specificity", Journal of Virology, Jan 2002, p. 791-801.

Radhar, M., et al., Synthetic CRISPR RNA-Cas9-guided genome editing in human cells, Proc Natl Acad Sci USA, v. 1112(51); Dec. 22, 2015: PMC4697396.
Ran et al. Genome engineering using the CRISPR-Cas9 system. Nature Protocols 8:2281-2308 (2013).
Rao et al. Inhibition of histone lysine methylation enhances cancer-testis antigen expression in lung cancer cells: implications for adoptive immunotherapy of cancer. Cancer Res. Jun. 15, 2011;71(12):4192-204.
Rapoport, et al. NY-ESO-1-specific TCR-engineered T cells mediate sustained antigen-specific antitumor effects in myeloma. Nat Med. Aug. 2015;21(8):914-21. doi: 10.1038/nm.3910. Epub Jul. 20, 2015.
Ren, Jiantao, Zhao, Yangbing, (2017) Advancing chimeric antigen receptor T cell therapy with CRISPR/Cas9,Protein & Cell, Sep. 2017, vol. 8, Issue 9, pp. 634-643.
Restifo, et al., Acquired resistance to immunotherapy and future challenges. Nature Reviews Cancer, Feb. 2011;16:121-126.
Restifo, N.P., M.E. Dudley, and S.A. Rosenberg, Adoptive immunotherapy for cancer: harnessing the T cell response. Nature Reviews Immunology, Apr. 2012, pp. 269-281, vol. 12, No. 4.
Robbins et al. Mining Exomic Sequencing Data to Identify Mutated Antigens Recognized by Adoptively Transferred Tumor-reactive T cells. Nat Med. Jun. 2013; 19(6): 747-752. Nat Med. Manuscript; Dec. 1, 2013.
Robbins, et al. Tumor regression in patients with metastatic synovial cell sarcoma and melanoma using genetically engineered lymphocytes reactive with NY-ESO-1. J Clin Oncol. Mar. 1, 2011;29(7):917-24. doi: 10.1200/JCO.2010.32.2537. Epub Jan. 31, 2011.
Rosati et al. A novel murine T-cell receptor targeting NY-ESO-1. J Immunother. Apr. 2014;37(3):135-46.
Rosenberg, et al. A new approach to the adoptive immunotherapy of cancer with tumor-infiltrating lymphocytes. Science Sep. 1986;233 (4770): 1318-21.
Rosenberg et al. Adoptive cell transfer as personalized immunotherapy for human cancer. Science 348(6230):62-68 (2015).
Rosenberg et al. Durable complete responses in heavily pretreated patients with metastatic melanoma using T-cell transfer immunotherapy. Clin Cancer Res 17(13):4550-4557 (2011).
Roth et al. Reprogramming human T cell function and specificity with non-viral genome targeting. bioRxiv; 183418. Aug. 31, 2017. doi: https://doi.org/10.1101/183418.
Safa, et al. Roles of c-FLIP in Apoptosis, Necroptosis, and Autophagy. J Carcinog Mutagen. 2013;Suppl 6. pii: 003.
Samoylova, et al. Peptide phage display: opportunities for development of personalized anti-cancer strategies. Anticancer Agents Med Chem. Jan. 2006;6(1):9-17.
Sander et al. CRISPR-Cas systems for editing, regulating and targeting genomes. Nat. Biotechnol 32:347-355 (2014).
Sather et al. Efficient modification of CCR5 in primary human hematopoietic cells using a megaTAL nuclease and AAV donor template. Sci Transl Med. Sep. 30, 2015;7(307):307ra156.
Savoldo, et al. CD28 costimulation improves expansion and persistence of chimeric antigen receptor-modified T cells in lymphoma patients. J Clin Invest. May 2011;121(5):1822-6. doi: 10.1172/JCI46110. Epub Apr. 11, 2011.
Scheffel, et al. Efficacy of Adoptive T-cell Therapy Is Improved by Treatment with the Antioxidant N-Acetyl Cysteine, Which Limits Activation-Induced T-cell Death. Cancer Res. Oct. 15, 2016;76(20):6006-6016.
Schietinger, et al. Tolerance and exhaustion: defining mechanisms of T cell dysfunction. Trends Immunol. Feb. 2014;35(2):51-60. doi: 10.1016/j.it.2013.10.001. Epub Nov. 6, 2013.
Schmid, et al. Evidence for a TCR affinity threshold delimiting maximal CD8 T cell function. J Immunol. May 1, 2010;184(9):4936-46. doi: 10.4049/jimmunol.1000173. Epub Mar. 29, 2010.
Schumann, et al. Generation of knock-in primary human T cells using Cas9 ribonucleoproteins. Proc Natl Acad Sci U S A. Aug. 18, 2015;112(33):10437-42. doi: 10.1073/pnas.1512503112. Epub Jul 27, 2015.
Scott, et al. Structural requirements for the biosynthesis of backbone cyclic peptide libraries. Chem Biol. Aug. 2001;8(8):801-15.

(56) References Cited

OTHER PUBLICATIONS

Sen, et al. The epigenetic landscape of T cell exhaustion. Science Oct. 27, 2016. 10 pages. DOI: 10.1126/science.aae0491.
Shi et al. Silenced suppressor of cytokine signaling 1 (SOCS1) enhances the maturation and antifungal immunity of dendritic cells in response to Candida albicans in vitro. Immunol Res. 2015; 61(3): 206-218.
Shifrut, et al., Genome-wide CRISPR screens in primary human T cells reveal key regulators of immune function. BioRxiv 384776, Aug. 2018; doi: https://doi.org/10.1101/384776.
Shmakov et al. Discovery and Functional Characterization of Diverse Class 2 CRISPR-Cas Systems. Mol Cell 60(3):385-397 (2015).
Silas, et al. Direct CRISPR spacer acquisition from RNA by a natural reverse transcriptase-Cas1 fusion protein. Science. Feb. 26, 2016;351(6276):aad4234. doi: 10.1126/science.aad4234.
Smith, et al. Gene transfer properties and structural modeling of human stem cell-derived AAV. Mol Ther. Sep. 2014;22(9):1625-34. doi: 10.1038/mt.2014.107. Epub Jun. 13, 2014.
Stanislawski, et al. Circumventing tolerance to a human MDM2-derived tumor antigen by TCR gene transfer. Nat Immunol. Oct. 2001;2(10):962-70.
Su, et al. CRISPR-Cas9 mediated efficient PD-1 disruption on human primary T cells from cancer patients. Sci Rep. Jan. 28, 2016;6:20070. doi: 10.1038/srep20070.
Tebas et al. Gene editing of CCR5 in autologous CD4 T cells of persons infected with HIV. N Engl J Med 370(10):901-10 (2014).
Torikai et al. A foundation for universal T-cell based immunotherapy: T cells engineered to express a CD19-specific chimeric-antigen-receptor and eliminate expression of endogenous TCR. Blood 119(24):5697-5705 (2012).
Trabattoni, et al. Costimulatory pathways in multiple sclerosis: distinctive expression of PD-1 and PD-L1 in patients with different patterns of disease. J Immunol. Oct. 15, 2009;183(8):4984-93. doi: 10.4049/jimmunol.0901038. Epub Sep. 30, 2009.
Tran et al. Cancer Immunotherapy Based on Mutation-Specific CD4+ T Cells in a Patient with Epithelial Cancer. Science 9:641-645 (2014).
Tran, et al. Immunogenicity of somatic mutations in human gastrointestinal cancers. Science. Dec. 11, 2015;350(6266):1387-90. doi: 10.1126/science.aad1253. Epub Oct. 29, 2015.
Tsai, et al. GUIDE-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.
Tuschl, et al. Nucleic Acid Sensing Pathways: Innate Immunity, Immunobiology and Therapeutics. Keystone Symposia 2016 Conference. May 8-12, 2016. 3 pages.
Twyman-Saint Victor, Christina et al., Radiation and Dual Checkpoint Blockage Activates Non-Redundant Immune Mechanism in Cancer, Nature Apr. 16, 2015: 520(7547): 373-377.
Tyrakis, et al. S-2-hydroxyglutarate regulates CD8+ T-lymphocyte fate. (Accelerated Article Preview). Nature (2016). Published online: Oct. 26, 2016. 22 pages. DOI:10.1038/nature20165.
(University of Iowa Carver College of Medicine) Storage and Transduction instructions for AAV Vectors. Webpage [online]. Jul. 4, 2017 [date verified by web.archive.org; retrieved on May 21, 2019). Retrieved from the internet:<url:https://medicine.uiowa.edu/vectorcore/sites/medicine.uiowa.edu.vectorcore/files/wysiwyg_uploads/Store%20and%2020Transduction%20instructions%20AAV.pdf>;page, 5th paragraph</url:<a>.
U.S. Appl. No. 15/224,151 Notice of Allowance dated Aug. 27, 2018.
U.S. Appl. No. 15/224,151 Notice of Allowance dated Oct. 3, 2018.
U.S. Appl. No. 15/224,151 Notice of Allowance dated Sep. 19, 2018.
U.S. Food and & Drug Administration. Clinical Hold: Advice/Information Request. To William Dahut, MD. Reference: IND 17614. Sep. 14, 2017. 6 pages.
U.S. Appl. No. 15/224,159 NF Office Action dated Dec. 5, 2018.
U.S. Appl. No. 15/224,159 Office Action dated May 15, 2018.
U.S. Appl. No. 15/250,514 Office Action dated Oct. 12, 2017.
U.S. Appl. No. 15/250,514 Office Action dated Sep. 11, 2018.
U.S. Serial No. Office Action U.S. Appl. No. 15/256,086 dated Oct. 5, 2018.
Van Lieshout, et al, "A Novel Triple-Mutant AAV6 Capsid Induces Rapid and Potent Transgene Expression in the muscle and Respiratory Tract of Mice", Molecular Therapy: Methods & Clinical Development, vol. 9 (2018) pp. 323-329.
Van Loenen, et al. Mixed T cell receptor dimers harbor potentially harmful neoreactivity. Proc Natl Acad Sci U S A. Jun. 15, 2010;107(24):10972-7. doi: 10.1073/pnas.1005802107. Epub Jun. 1, 2010.
Voigt, et al., Retargeting Sleeping Beauty Transposon Insertions by Engineered Zinc Finger DNA-binding Domains. Mol Ther. Oct. 2012; 20(10): 1852-1862.
Wang, et al. Highly efficient homology-driven genome editing in human T cells by combining zinc-finger nuclease mRNA and AAV6 donor delivery. Nucleic Acids Res. Feb. 18, 2016;44(3):e30. doi: 10.1093/nar/gkv1121. Epub Nov. 2, 2015.
Ward, et al., "Chimeric AAV Cap sequences alter gene transduction", Virology 386 (2009) p. 237-248.
Whiteside, et al. Regulatory T cell subsets in human cancer: are they regulating for or against tumor progression? Cancer Immunol Immunother (2014) 63:67-72.
Wiedenheft, et al. RNA-guided genetic silencing systems in bacteria and archaea. Nature. Feb. 15, 2012;482(7385):331-8. doi: 10.1038/nature10886.
Wierson, Wesley et al., (2018), GeneWeld, a method for efficient targeted integration directed by short homology, epub: Oct. 3, 2018; doi:http://dx.doi.org/10.1101/431627.
Wu, et al. Single amino acid changes can influence titer, heparin binding, and tissue tropism in different adeno-associated virus serotypes. J Virol. Nov. 2006;80(22):11393-7. Epub Aug. 30, 2006.
Xiao et al. CasOT: a genome-wide Cas9/gRNA off-target searching tool. Bioinformatics. Apr. 15, 2014;30(8):1180-1182.
Yan, Z., et al., Distinct transduction difference between adeno-associated virus type 1 and type 6 vectors in human polarized airway epithelia, Gene Therapy, Mar. 2013, Epub Jun. 14, 2012, vol. 20, No. 3, pp. 328-337.
Yang, et al. "Development of optimal bicistronic lentiviral vectors facilitates high-level TCRE gene expression and robust tumor cell recognition", Gene Ther. 15(21): 1411-1423, 2008.
Yang et al. One-step generation of mice carrying reporter and conditional alleles by CRISPR/Cas-mediated genome engineering. Cell 154:1370-1379 (2013).
Yang et al. The signaling suppressor CIS controls proallergic T cell development and allergic airway inflammation. Nat Immunol. Jul. 2013; 14(7): 732-740. Manuscript; Jul. 7, 2014.
Yao, Xuan et al., (2017) Homology-mediated end joining-based targeted integration using CRISPR/Cas9, Cell Research, Jun. 2017:27(6):801-814.
Yoshimura, Akihiko et al., A novel cytokine-inducible gene CIS encodes an SH2-containing protein that binds to tyrosine-phosphorylated interleukin 3 and erythropoietin receptors, The EMBO Journal, vol. 14, No. 12, pp. 2816-2826, 1995.
Yuan, et al. CTLA-4 blockade enhances polyfunctional NY-ESO-1 specific T cell responses in metastatic melanoma patients with clinical benefit. Proc Natl Acad Sci U S A. Dec. 23, 2008;105(51):20410-5. doi: 10.1073/pnas.0810114105. Epub Dec. 12, 2008.
Zhang et al. A novel RNA motif mediates the strict nuclear localization of a long noncoding RNA. Mol Cell Biol. Jun. 2014;34(12):2318-29.
Zhong, et al., "Next generation of adeno-associated virus 2 vectors: Point mutations in tyrosines lead to high-efficiency transductgion at lower doses" PNAS, vol. 105, No. 22, pp. 7827-7832.
Zon. Intrinsic and extrinsic control of haematopoietic stem-cell self-renewal. Nature. May 15, 2008;453(7193):306-13. doi: 10.1038/nature07038.
"Surace EM, Auricchio A. Versatility of AAV vectors for retinal gene transfer. Vision Res. 2008;48(3):353-359. doi:10.1016/j.visres.2007.07.027".

(56) References Cited

OTHER PUBLICATIONS

Li, et al., "Cytokine-induced Src Homology 2 Protein (CIS) Promotes T Cell Receptor-mediated Proliferation and Prolongs Survival of activated T Cells" J. Exp. Med, vol. 191, No. 6, (2020) pp. 985-994.

Viney, et al., "Adeno-associated Virus (AAV) Capsid Chimeras with Enhanced Infectivity Reveal a Core Element in the AAV Genome Critical for both Cell Transduction and Capsid Assembly" (2021) J. Virol.

Shen Xuan El Al: "Characterization of the Relationship of AAV Capsid Domain Swapping to Liver Transduction Efficiency", Molecular Therapy, vol. 15, No. 11, Nov. 1, 2007 (Nov. 1, 2007), pp. 1955-1962, XP002595612, ISSN: 1525-0016, DOI:10.1038/SJ.MT.6300293.

L. E. Mays et al.: "Mapping the Structural Determinants Responsible for Enhanced T Cell Activation to the Immunogenic Adeno-Associated Virus Capsid from Isolate Rhesus 32.33", Journal of Virology, vol. 87, No. 17, Sep. 1, 2013 (Sep. 1, 2013), pp. 9473-9485, XP055410703, US ISSN: 0022-538X, DOI: 10.1128/JV1.00596-13.

Extended European Search Report dated Mar. 18, 2021 for EP Application No. 18825318.1.

Van Vliet K.M., Blouin V., Brument N., Agbandje-McKenna M., Snyder R.O. (2008) "The Role of the Adeno-Associated Virus Capsid in Gene Transfer" In: Jain K.K. (eds) Drug Delivery Systems. Methods in Molecular Biology, vol. 437. Humana Press, https://doi.org/10.1007/978-1-59745-210-6_2.

Drouin, L. M., & Agbandje-McKenna, M. (2013). "Adeno-Associated Virus Structural Biology as a Tool in Vector Development" Future Virology, 8(12), 1183-1199. https://doi.org/10.2217/fvl.13.112.

Tseng Yu-Shan, Agbandje-Mckenna Mavis, (2014) "Mapping the AAV Capsid Host Antibody Response toward the Development of Second Generation Gene Delivery Vectors" Frontiers in Immunology, vol. 5, p. 9, https://www.fontiersin.org/article/10.3389/fimmu.2014.00009.

Ng, Robert, Govindasamy, Lakshmanan, Gurda, Brittney L., McKenna, Robert, Kozyreva, Olga G., Samulski, R. Jude, Parent, Kristin N., Baker, Timothy S., Agbandje-McKenna, Mavis (2010) "Structural Characterization of the Dual Glycan Binding Adeno-Associated Virus Serotype" Journal of Virology, 84(24), p. 12945-12957, doi: 10.1128/JVI01235-10.

Drouin, Lauren M., Lins, Bridget, Janssen, Maria, Bennett, Antonette, Chipman, Paul, McKenna, Robert, Chen, Muzyczka, Nicholas, Cardone, Giovanni, Baker, Timothy S., Agbandje-McKenna, Mavis (2016) "Cryo-electron Microscopy Reconstruction and Stability Studies of the Wild Type and the R432A Variant of Adeno-associated Virus Type 2 Reveal that Capsid Structural Stability Is a Major Factor in Genome Packaging" Jounal of Virology, 90(19), p. 3542-8551.

Raupp, Christina, Naumer, Matthias, Muller, Oliver J., Gurda, Brittney L., Agbandje-McKenna, Mavis Kleinschmidt, Jürgen A. "The Threefold Protrusions of Adeno-Associated Virus Type 8 Are Involved in Cell Surface Targeting as Well as Postattachment Processing", Journal of Virology, p. 9396-9408.

Naumer, M et al. Properties of the Adeno-Associated Virus Assembly-Activating Protein. Journal of Virology. Dec. 2012. Vol. 86, No. 23, p. 13083-13048.

Chiorini et al. Adeno-associated virus (AAV) type 5 Rep protein cleaves a unique terminal resolution site compared with other AAV serotypes J Virol May 1999, vol. 73, No. 5, pp. 4293-4298.

\* cited by examiner

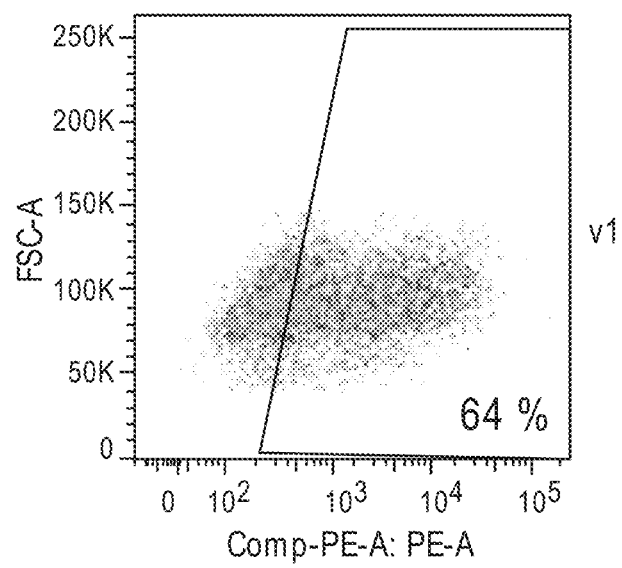
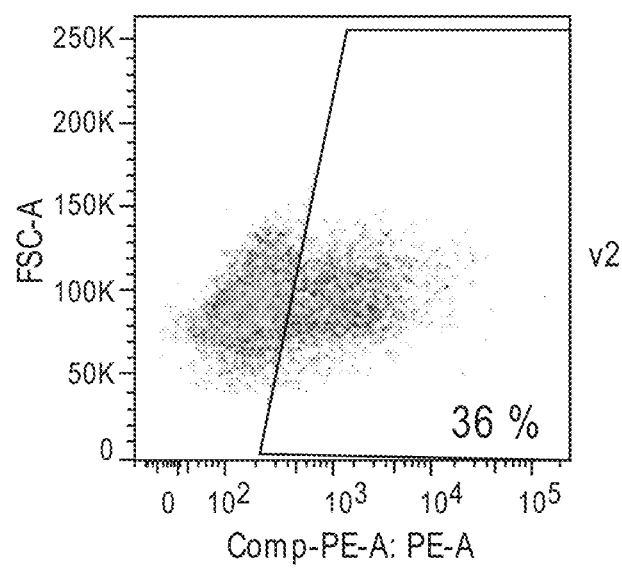
FIG. 2 (CONT.)

Flanking Restriction Sites: Kpn (GGTACC) / AgI (ACCGGT)

Stop codon of previous ORF (rep) marked in yellow.

Sequence in bold originates from the pAAV DJ vector

Highlighted yellow = wt AAV6 cap ORF

>AAV6_WT

GGTACCAAAACAAATGTTCTCGTCACGTGGGCATGAATCTGATGCTGTTTCCCTGCAGACAATGCGAG
AGAATGAATCAGAATTCAAATATCTGCTTCACTCACGGACAGAAAGACTGTTTAGAGTGCTTTCCCGT
GTCAGAATCTCAACCCGTTTCTGTCGTCAAAAAGGCGTATCAGAAACTGTGCTACATTCATCATATCA
TGGGAAAGGTGCCAGACGCTTGCACTGCCTGCGATCTGGTCAATGTGGATTTGGATGACTGCATCTTT
GAACAATAAATGATTTAAATCAGGTatggctgccgatggttatcttccagattggctcgaggacaac
tctctgagggcattcgcgagtggtgggacttgaaacctggagcccccgaaacccaaagccaaccagcaa
aagcaggacgacggccggggtctggtgcttcctggctacaagtacctcggacccttcaacggactcga
caaggggggagcccgtcaacgcggcggatgcagcggccctcgagcacgacaaggcctacgaccagcagc
tcaaagcgggtgacaatccgtacctgcggtataaccacgccgacgccgagtttcaggagcgtctgcaa
gaagatacgtcttttgggggcaacctcgggcgagcagtcttccaggccaagaagagggttctcgaacc
ttttggtctggttgaggaaggtgctaagacggctcctggaaagaaacgtccggtagagcagtcgccac
aagagccagactcctcctcgggcattggcaagacaggccagcagcccgctaaaaagagactcaattttt
ggtcagactggcgactcagagtcagtccccgacccacaacctctcggagaacctccagcaaccccgc
tgctgtgggacctactacaatggcttcaggcggtggcgcaccaatggcagacaataacgaaggcgcg
acggagtgggtaatgcctcaggaaattggcattgcgattccacatggctgggcgacagagtcatcacc
accagcacccgaacatgggccttgcccacctataacaaccacctctacaagcaaatctccagtgcttc
aacggggccagcaacgacaaccactacttcggctacagcacccctgggggtatttttgatttcaaca
gattccactgccatttctcaccacgtgactggcagcgactcatcaacaacaattggggattccggccc
aagagactcaacttcaagctcttcaacatccaagtcaagaaggtcacgacgaatgatggcgtcacgac
catcgctaataaccttaccagcacggttcaagtcttctcggactcggagtaccagttgccgtacgtc
tcggctctgcgcaccagggctgcctccctccgttccggcggacgtgttcatgattccgcagtacggc
tacctaacgctcaacaatggcagccaggcagtgggacggtcatccttttactgcctggaatatttccc
atcgcagatgctgagaacgggcaataactttaccttcagctacaccttcgaggacgtgcctttccaca
gcagctacgcgcacagccagagcctggaccggctgatgaatcctctcatcgaccagtacctgtattac
ctgaacagaactcagaatcagtccggaagtgcccaaaacaaggacttgctgtttagccgggggtctcc
agctggcatgtctgttcagcccaaaaactggctacctggaccctgttaccggcagcagcgcgtttcta
aaacaaaaacagacaacaacaacagcaacttacctggactggtgcttcaaaatataaccttaatggg
cgtgaatctataatcaaccctggcactgctatggcctcacacaaagacgacaaagacaagttctttcc
catgagcggtgtcatgattttggaaggagagcgccggagcttcaaacactgcattggacaatgtca
tgatcacagacgaagaggaaatcaaagccactaaccccgtggccaccgaaagatttgggactgtggca
gtcaatctccagagcagcagcacagaccctgcgacggagatgtgcatgttatgggagccttacctgg
aatggtgtggcaagacagagacgtatacctgcagggtcctatttgggccaaaattcctcacacggatg
gacactttcaccgtctcctctcatgggcggctttggacttaagcaccgcctcctcagatcctcatc
aaaaacacgcctgttcctgcgaatcctccggcagagttttcggctacaaagtttgcttcattcatcac
ccagtattccacaggacaagtgagcgtggagattgaatgggagctgcagaagaaaacagcaaacgct
ggaatcccgaagtgcagtatacatctaactatgcaaaatctgccaacgttgatttcactgtggacaac
aatggactttatactgagcctcgcccattggcaccgttacctcacccgtcccctgtaa**TTGTGTGT
TAATCAATAA**ACCGGT (SEQ ID NO: 246)

FIG. 13

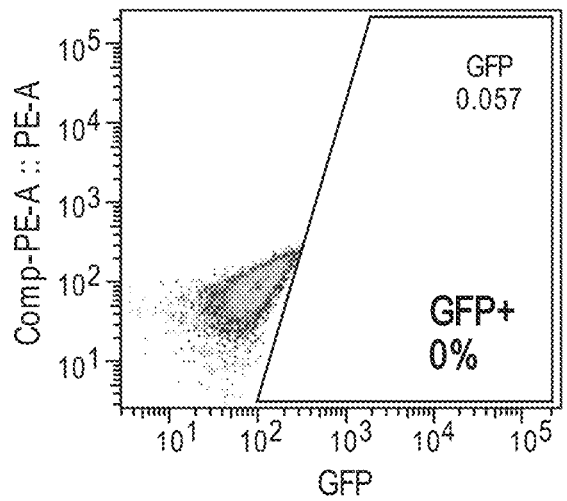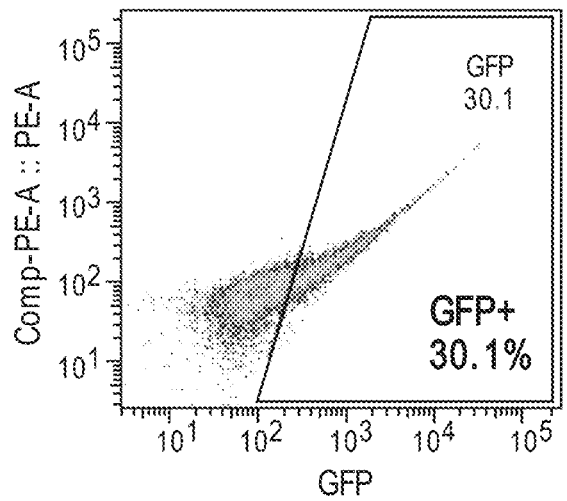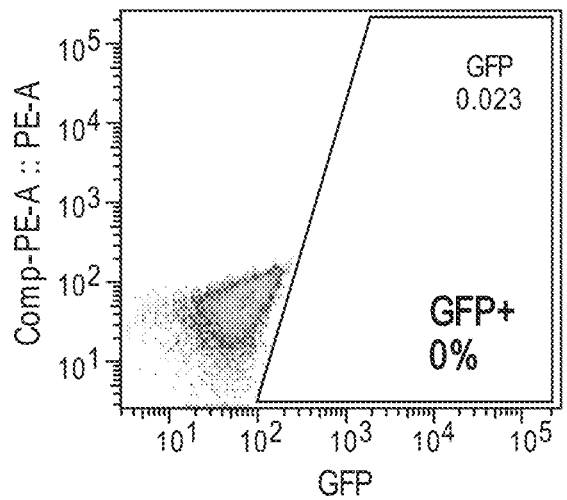
FIG. 18A

| Virus variant | |
|---|---|
| 1 | Wt |
| 15 | F129L+H642N+D418N |
| 17 | F129L+H642N+L584N |
| 19 | F129L+H642N+V598L |
| 20 | F129L+H642N+V598I |

FIG. 22C

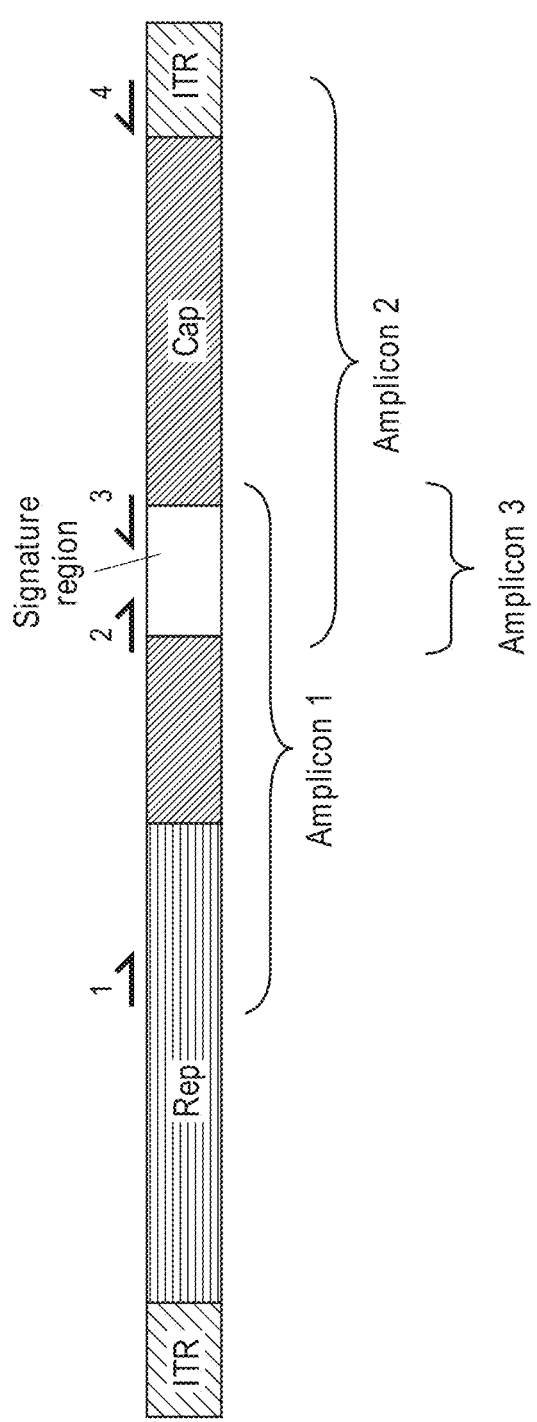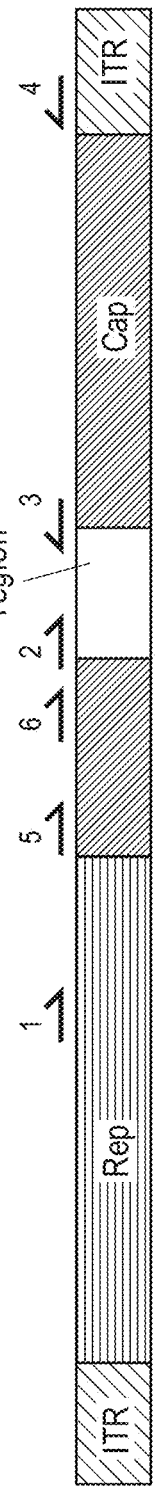
FIG. 25A
FIG. 25B

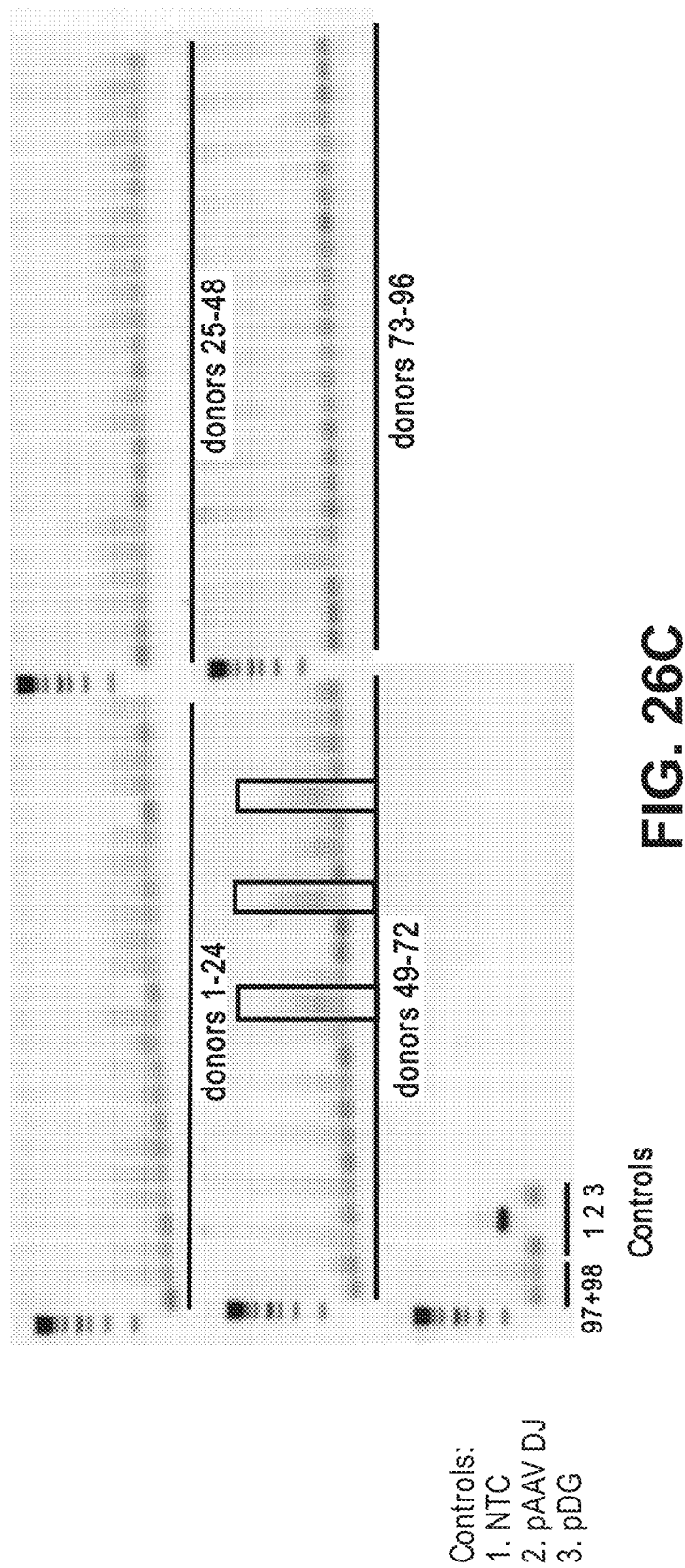

AGDGPPEGSSSG----EMSHDAEMASGGGAPHADNNEGADGVGNASGN
DSESVPDPQPLGEPPATPAAVGPTTMASGGGAPHADNNEGADGVGNASGN
DSESVPDPQPLGEPPATPAAVGPTTMASGGGAPHADNNEGADGVGNASGN
                        *          ************************
                                                          → 230

FIG. 29B (CONT.)

ADENO-ASSOCIATED VIRAL VECTORS FOR GENE THERAPY

This application is a continuation of International Application No. PCT/US2018/040480, filed Jun. 29, 2018, which claims the benefit of U.S. Provisional Application No. 62/665,256, filed May 1, 2018, U.S. Provisional Application No. 62/659,472, filed Apr. 18, 2018, and U.S. Provisional Application No. 62/527,937, filed Jun. 30, 2017, the disclosures of each of which are hereby incorporated by reference herein in their entirety.

SEQUENCE LISTING

The instant application contains a Sequence Listing which has been submitted electronically in ASCII format and is hereby incorporated by reference in its entirety. Said ASCII copy, created on Jun. 29, 2018, is named 47533-726_601_SL.txt and is 5,955,965 bytes in size.

BACKGROUND

Despite remarkable advances in cancer therapeutics over the last 50 years, there remain many tumor types that are recalcitrant to chemotherapy, radiotherapy or biotherapy, particularly in advanced stages that cannot be addressed through surgical techniques. Recently there have been significant advances in the genetic engineering of lymphocytes to recognize molecular targets on tumors in vivo, resulting in remarkable cases of remission of the targeted tumor. However, these successes have been limited largely to hematologic tumors, and more broad application to solid tumors is limited by the lack of an identifiable molecule that is expressed by cells in a particular tumor, and lack of a molecule that can be used to specifically bind to the tumor target in order to mediate tumor destruction.

The disclosed compositions and methods herein provide modified adeno-associated viral vectors as well as methods for the identification of modified adeno-associated viral vectors that enhance cellular therapy. Insertion of transgenes into primary cells using modified adeno-associated viral methods are innovative approaches that open new opportunities for extending and improving immunotherapy for various conditions, such as cancer.

INCORPORATION BY REFERENCE

All publications, patents, and patent applications herein are incorporated by reference to the same extent as if each individual publication, patent, or patent application was specifically and individually indicated to be incorporated by reference. In the event of a conflict between a term herein and a term in an incorporated reference, the term herein controls.

SUMMARY OF THE INVENTION

Disclosed herein is an isolated non-naturally occurring nucleic acid comprising an adeno-associated virus (AAV) nucleotide sequence that comprises a first mutation in a VP1 region and a second mutation in a VP3 region as compared to a wild-type AAV nucleotide sequence, wherein the isolated non-naturally occurring nucleic acid, upon contacting with a plurality of cells, has increased expression of a transgene post transfection or transduction in the plurality of cells as compared to a wild-type AAV nucleic acid or an AAV nucleotide sequence with a single mutation in a VP region of the capsid protein in a comparable plurality of cells.

Disclosed herein is an isolated non-naturally occurring nucleic acid comprising an adeno-associated virus (AAV) nucleotide sequence that comprises a first mutation in a VP1 region and a second mutation in a VP2 region as compared to a wild-type AAV nucleotide sequence, wherein the isolated non-naturally occurring nucleic acid, upon contacting with a plurality of cells, has increased expression of a transgene post transfection or transduction in said plurality of cells as compared to a wild-type AAV nucleic acid or an AAV nucleotide sequence with a single mutation in a VP region of the capsid protein in a comparable plurality of cells. In some cases, the AAV nucleotide sequence is of serotype AAV1, AAV2, AAV3, AAV4, AAV5, AAV6, AAV7, AAV8, AAV9, AAV10, AAV11, AAV12, and any combination thereof. The AAV nucleotide sequence can be of an AAV6 serotype. The isolated non-naturally occurring nucleic acid can be at least one of DNA or RNA. The isolated non-naturally occurring nucleic acid can be DNA. The first mutation and the second mutation comprise at least one of a point mutation, missense mutation, nonsense mutation, insertion, deletion, duplication, frameshift, or repeat expansion. The first mutation and the second mutation can be point mutations. The first mutation can be a mutation of a phenylalanine (F) encoding sequence in the VP1 region. In some cases, the first mutation can be in an F encoding sequence at position 129 of the VP1 region of a polypeptide encoded by the nucleic acid. In some cases, the mutation encodes a mutation from an F at position 129 of the polypeptide to a nonpolar aliphatic amino acid. In some cases, the nonpolar aliphatic amino acid can be selected from: leucine (L), isoleucine (I), and valine (V). In some cases, the nonpolar aliphatic amino acid is an L. In some cases, the second mutation is in a leucine (L) encoding sequence in the polypeptide. In some cases, the second mutation is in an L encoding sequence at position 584 of the polypeptide encoded by the nucleic acid. In some cases, the second mutation encodes a mutation from an L at position 584 of the polypeptide to a polar amino acid. The polar amino acid can be selected from: asparagine (N) and glutamine (Q). The polar amino acid can be an N. In some cases, the second mutation encodes a mutation from an L at position 584 to a positively charged amino acid. The positively charged amino acid can be histidine (H). The second mutation can encode a mutation from an L at position 584 of the polypeptide to a negatively charged amino acid. In some cases, the negatively charged amino acid is selected from: aspartate (D) and glutamate (E). In some cases, the negatively charged amino acid is a D. In some cases, the second mutation is in a valine (V) encoding sequence in the polypeptide. In some cases, the second mutation is in a V encoding sequence at position 598 of the polypeptide encoded by the nucleic acid. In some cases, the second mutation encodes a mutation from a V at position 598 of the polypeptide to a nonpolar aliphatic amino acid. In some cases, a nonpolar aliphatic amino acid is selected from: leucine (L), isoleucine (I), and valine (V). A nonpolar aliphatic amino acid can be an L. A nonpolar aliphatic amino acid can be an I. In some cases, a second mutation is in a histidine (H) encoding region in the polypeptide. In some cases, the second mutation can be in an H encoding region at position 642 in the polypeptide. In some cases, the second mutation encodes a mutation from an H at position 642 of said polypeptide to a polar amino acid. In some cases, a polar amino acid is selected from: asparagine (N) and glutamine (Q). In some cases, a polar amino acid is an N. In some cases, a first mutation can be in an aromatic amino acid encoding sequence in a nucleic acid prior to a second mutation, a second mutation encoding a nonpolar aliphatic amino acid in a polypeptide encoded by a nucleic acid. In some cases, an aromatic amino acid can be at position 129 of a VP1 polypeptide encoded by a VP1 region. In some cases, a first mutation is in a sequence encoding a more hydrophobic amino acid than an amino acid encoded at a position of a sequence prior to a second mutation. In some cases, a second mutation encodes at least one mutation selected from the group consisting of: a positively charged amino acid to a polar amino acid, a negatively charged amino acid to a polar amino acid. In some cases, a second mutation encodes a conservative mutation. A conservative mutation can be selected from the group consisting of: a nonpolar aliphatic amino acid to a nonpolar aliphatic amino acid, a polar amino acid to a polar amino acid, a positively charged amino acid to a positively charged amino acid, a negatively charged amino acid to a negatively charged amino acid, and an aromatic amino acid to an aromatic amino acid. In some cases, a first mutation is in a sequence encoding a less hydrophobic amino acid than the amino acid encoded at a position of said sequence prior to the second mutation. In some cases, a second mutation is in a VP3 region, and a second mutation can encode at least one mutation selected from the group consisting of an: H to N, D to N, D to N, V to L, and V to I. In some cases, a second mutation in a VP3 region occurs at position 418, 462, 584, 598, or 642 of an AAV polypeptide sequence encoded by an AAV nucleotide sequence. In some cases, an isolated non-naturally occurring nucleic acid comprises at least one of F129L, H642N, and D418N mutations. In some cases, an isolated non-naturally occurring nucleic acid encodes at least one of F129L, H642N, and L584N mutations. In some cases, an isolated non-naturally occurring nucleic acid comprises at least one of F129L, H462N, and V598L mutations. In some cases, an isolated non-naturally occurring nucleic acid comprises at least one of F129L, H462N, and V598I mutations. In some cases, a plurality of cells can be a plurality of primary cells. In some cases, an isolated non-naturally occurring nucleic acid encodes at least a portion of an exogenous receptor sequence. In some cases, an isolated non-naturally occurring nucleic acid can be formulated into a pharmaceutical composition. In some cases, a wild-type AAV nucleic acid comprises at least 60% sequence identity to SEQ ID NO: 55.

Disclosed herein is an isolated and purified adeno-associated virus (AAV) capsid nucleotide sequence that encodes at least two mutations selected from the group consisting of: F129L, H642N, and D418N.

Disclosed herein is an isolated and purified adeno-associated virus (AAV) nucleotide sequence that encodes at least two mutations selected from the group consisting of: F129L, H642N, and L584N.

Disclosed herein is an isolated and purified adeno-associated virus (AAV) nucleotide sequence that encodes at least two mutations selected from the group consisting of: F129L, H462N, and V598L.

Disclosed herein is an isolated and purified adeno-associated virus (AAV) nucleotide sequence that encodes at least two mutations selected from the group consisting of: F129L, H642N, and V598I.

Disclosed herein is an isolated and purified protein generated from the adeno-associated virus (AAV) nucleotide sequence.

Disclosed herein is an isolated and purified adeno-associated virus (AAV) nucleic acid sequence that comprises at least 60% sequence identity or similarity with any one of the nucleic acid sequences of SEQ ID NO: 1 to SEQ ID NO: 19. A sequence identity can be from about 60%, 70%, 80%, 85%, 90%, 95%, 96%, 97%, 98%, 99%, and up to about 100%.

Disclosed herein is an isolated non-naturally occurring nucleic acid that comprises an adeno-associated virus (AAV) nucleotide sequence that comprises VP1, VP2, and VP3 sequences, wherein two of the VP1, VP2, and VP3 sequences are from a first AAV serotype, and one of the VP1, VP2, and VP3 sequences is from a second AAV serotype, wherein the isolated non-naturally occurring nucleic acid upon introduction into a plurality of cells confers an increased expression of a transgene after transfection or transduction as compared to a wild-type AAV nucleic acid. In some cases, a first AAV serotype and a second AAV serotype are selected from AAV1, AAV2, AAV3, AAV4, AAV5, AAV6, AAV7, AAV8, AAV9, AAV10, AAV11, AAV12, or any combination thereof. In some cases, a first AAV serotype and a second AAV serotype are selected from the group consisting of: AAV4 and AAV6, AAV8 and AAV6, AAV11 and AAV6, AAV12 and AAV6, and any combination thereof. In some cases, an isolated non-naturally occurring nucleic acid can be at least one of DNA or RNA. In some cases, an isolated non-naturally occurring nucleic acid can be DNA. In some cases cells are primary cells, immortalized cells, or recombinant cells. In some cases, a transgene encodes at least a portion of an exogenous receptor sequence. In some cases, an isolated non-naturally occurring nucleic acid can be formulated into a pharmaceutical composition. In some cases, VP1, VP2, and VP3 regions are comprised within at least a portion of a capsid.

Disclosed herein is an isolated and purified adeno-associated virus (AAV) nucleic acid sequence that comprises at least 60% sequence identity or similarity with any one of amino acid sequences of SEQ ID NO: 195 to SEQ ID NO: 213. A sequence identity can be from about 60%, 70%, 80%, 85%, 90%, 95%, 96%, 97%, 98%, 99%, and up to about 100%.

Disclosed herein is an engineered cell generated by transfecting a cell with an isolated and purified AAV nucleic acid sequence.

Disclosed herein is a plurality of adeno-associated viral (AAV) particles isolated from an engineered cell.

Disclosed herein is a composition comprising adeno-associated viral particles in unit dosage form. A composition can be cryopreserved.

Disclosed herein is a container comprising a composition.

Disclosed herein is a method of making engineered cells comprising contacting a plurality of cells with a plurality of adeno-associated viral (AAV) particles. In some cases, a plurality of cells are mammalian cells. In some cases, mammalian cells are human cells. In some cases, human cells are lymphocytes. In some cases, cells can be stimulated prior to contacting with a plurality of AAV particles. In some cases, stimulation can be performed with at least one of: anti-CD3, anti-CD28, and an interleukin. In some cases, contacting can be performed before, after, or concurrent with stimulation. In some cases, contacting of a plurality of cells with a plurality of AAV particles is performed after stimulation. Stimulation can be performed from 4 days before to 24 hours before contacting of a plurality of cells with a plurality of AAV particles. Stimulation can be performed 3 days before contacting of a plurality of cells with a plurality of AAV particles. A method can further comprise introducing a genomic disruption in a genome of a plurality of cells. A genomic disruption can comprise a Clustered Regularly Interspaced Short Palindromic Repeats (CRISPR) system. A genomic disruption can be performed prior to contacting of a plurality of cells with a plurality of AAV particles. A method can further comprise expanding engineered cells. A method can further comprise administering engineered cells in unit dosage form to a subject in need thereof. In some cases, administering is an infusion. In some cases, administering of engineered cells at least partially ameliorates a disease or condition in a subject in need thereof. In some cases, a disease or condition comprises a cancer. In some cases, amelioration comprises a reduction in a cancer by at least about 30% as measured by computerized tomography (CT) scan. In some cases, amelioration comprises stabilizing tumor size as measured by a less than 10% change in a baseline measurement of a diameter of a tumor lesion as measured by computerized tomography (CT) scan.

Disclosed herein is a method of screening a plurality of engineered adeno associated viral (AAV) particles comprising introducing at least one of a mutation or exogenous AAV genome to a genome of an adeno-associated virus (AAV) nucleotide sequence to form engineered AAV particles; introducing a plurality of engineered AAV particles from a to a plurality of cellular genomes; and quantifying a level of expression of a transgene encoded by the plurality of AAV particles in the plurality of cellular genomes wherein the level of expression is compared to a second level of expression obtained from a second AAV particle introduced a different mutation or exogenous AAV genome from a. In some cases, a mutation comprises at least one of a point mutation, missense mutation, nonsense mutation, insertion, deletion, duplication, frameshift, or repeat expansion. In some cases, a mutation comprises a point mutation. In some cases, a genome of an adeno-associated virus (AAV) nucleotide sequence is of serotype AAV6. An exogenous AAV genome can be of serotype AAV1, AAV2, AAV3, AAV4, AAV5, AAV7, AAV8, AAV9, AAV10, AAV11, or AAV12. An exogenous AAV genome can be AAV4. An exogenous AAV genome can be AAV5. An exogenous AAV genome can be AAV11. An exogenous AAV genome can be AAV12. A plurality of cellular genomes can be from primary cells, immortalized cells, or recombinant cells. In some cases, quantifying a level of expression can be determined by flow cytometry, western blot, or PCR. In some cases, engineered AAV particles when introduced to a plurality of cellular genomes confer increased expression of a transgene post transduction as compared to non-engineered AAV particles. Increased expression can be from about 30%, 40%, 50%, 60%, and up to about 100% as compared to the second level of expression obtained from a second AAV particle introduced a different mutation or exogenous AAV genome from a. Quantifying can be measured by flow cytometry, western blot, or PCR.

Disclosed herein is a method of making engineered cells comprising contacting a plurality of cells with an effective amount of adeno-associated viral (AAV) particles comprising a first mutation in a VP1 region and a second mutation in a VP3 region in a capsid protein thereby generating a plurality of engineered cells, wherein an expression of a transgene after transduction of the engineered cells is increased as compared to a comparable plurality of cells contacted with wild type AAV particles or AAV particles comprising a single mutation in a VP region of the capsid protein.

Disclosed herein is a method of making engineered cells comprising contacting a plurality of cells with an effective amount of adeno-associated viral (AAV) particles comprising a first mutation in a VP1 region and a second mutation in a VP3 region in a capsid protein thereby generating a plurality of engineered cells, wherein an expression of a transgene after transduction of the plurality of cells is increased between about 10× to 300× at a mean of infectivity (MOI) of 200,000 GC/mL as compared to a comparable plurality of cells contacted with wild type AAV particles or AAV particles comprising a single mutation in a VP region of the capsid protein at the MOI.

Disclosed herein is a method of making engineered cells comprising contacting a plurality of cells with an effective amount of adeno-associated viral (AAV) particles encoding a transgene and comprising a first mutation in a VP1 region and a second mutation in a VP3 region in a capsid protein thereby generating a plurality of engineered cells, wherein expression of said transgene in said plurality of cells is increased as compared to cells contacted with wild type AAV particles or AAV particles comprising a single mutation in a VP region of said capsid protein, wherein said wild type AAV particles or AAV particles comprising the single mutation in the VP region of said capsid protein also encode said transgene. In some cases, a transgene encodes a cellular receptor or a portion thereof. A cellular receptor or portion thereof can be a T cell receptor. A cellular receptor or portion thereof can be a chimeric antigen receptor (CAR). In some cases, a first mutation is in an F encoding sequence at position 129 of the VP1 region of a polypeptide encoded by the method. In some cases, a first mutation encodes a mutation from an F at position 129 of the polypeptide to a nonpolar aliphatic amino acid. In some cases, a nonpolar aliphatic amino acid can be selected from: leucine (L), isoleucine (I), and valine (V). In some cases, a nonpolar aliphatic amino acid can be an L. In some cases a first mutation is in a leucine (L) encoding sequence in a polypeptide. In some cases, a first mutation is in an L encoding sequence at position 584 of a polypeptide encoded by a nucleic acid. In some cases, a first mutation encodes a mutation from an L at position 584 of a polypeptide to a polar amino acid. A polar amino acid can be selected from: asparagine (N) and glutamine (Q). A polar amino acid can be N. In some cases, a first mutation encodes a mutation from an L at position 584 to a positively charged amino acid. A positively charged amino acid can be histidine (H). A first mutation can encode a mutation from an L at position 584 of a polypeptide to a negatively charged amino acid. A negatively charged amino acid can be selected from: aspartate (D) and glutamate (E). A negatively charged amino acid can be D. In some cases, a first mutation can be in a valine (V) encoding sequence in a polypeptide. In some cases, a first mutation can be in a V encoding sequence at position 598 of a polypeptide encoded by a nucleic acid. A first mutation can encode a mutation from a V at position 598 of a polypeptide to a nonpolar aliphatic amino acid. A nonpolar aliphatic amino acid can be selected from: leucine (L), isoleucine (I), and valine (V). A nonpolar aliphatic amino acid can be an L. A nonpolar aliphatic amino acid can be an I. A second mutation can be in a histidine (H) encoding region in a polypeptide. A second mutation can be in an H encoding region at position 642 in a polypeptide. A second mutation can encode a mutation from an H at position 642 of a polypeptide to a polar amino acid. In some cases, a polar amino acid can be selected from: asparagine (N) and glutamine (Q). A polar amino acid can be an N. A first mutation can be in an aromatic amino acid encoding sequence in a nucleic acid prior to said second mutation, said second mutation encoding nonpolar aliphatic amino acid in a polypeptide encoded by a nucleic acid. In some cases, an aromatic amino acid can be at position 129 of a VP1 polypeptide encoded by a VP1 region. In some cases, a first mutation can be in a sequence encoding a more hydrophobic amino acid than the amino acid encoded at a position of the sequence prior to the second mutation. In some cases, a second mutation encodes at least one mutation selected from the group consisting of an: a positively charged amino acid to a polar amino acid, a negatively charged amino acid to a polar amino acid. A second mutation can encode a conservative mutation. A conservative mutation can be selected from the group consisting of: a nonpolar aliphatic amino acid to a nonpolar aliphatic amino acid, a polar amino acid to a polar amino acid, a positively charged amino acid to a positively charged amino acid, a negatively charged amino acid to a negatively charged amino acid, and an aromatic amino acid to an aromatic amino acid. In some cases, a first mutation can be in a sequence encoding a less hydrophobic amino acid than the amino acid encoded at a position of said sequence prior to the second mutation. In some cases, a first mutation in a VP region of a capsid protein can be a single mutation in a VP1 or a VP3 region of the capsid protein. In some cases, a first mutation in a VP1 region comprises an F to L mutation. In some cases, a first mutation in a VP1 region occurs at position 129 of an AAV polypeptide sequence encoded by the AAV nucleotide sequence. In some cases, a second mutation is in a VP3 region and the second mutation comprises at least one mutation selected from the group consisting of an: H to N, D to N, D to N, V to L, and V to I. In some cases, the second mutation in a VP3 region can occur at position 418, 462, 584, 598, or 642 of an AAV polypeptide sequence encoded by an AAV nucleotide sequence. A second mutation in a VP3 region can comprise at least one of F129L, H642N, D418N, L584N, V598L, V598I. A method can further comprise contacting a plurality of cells with a Clustered Regularly Interspaced Short Palindromic Repeats (CRISPR) system, thereby generating a plurality of engineered cells comprising a genomic disruption. In some cases, contacting can be before, concurrent, or after contacting with AAV particles. An endonuclease can be Cas. A Cas can be selected from the group consisting of: Cas1, Cas1B, Cas2, Cas3, Cas4, Cas5, Cas6, Cas7, Cas8, Cas9 (also known as Csn1 or Csx12), Cas10, Csy1, Csy2, Csy3, Cse1, Cse2, Csc1, Csc2, Csa5, Csn2, Csm2, Csm3, Csm4, Csm5, Csm6, Cmr 1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpfl, c2c1, c2c3, Cas9HiFi, homologues thereof, and modified versions thereof. A CRISPR system can be electroporated or nucleofected into a plurality of cells. A CRISPR system can be encoded by DNA, RNA, or a combination hereof. A CRISPR system can be encoded by RNA. A method can further comprise expanding engineered cells. In some cases, engineered cells are expanded to at least about $1\times10^8$ cells. An AAV can be AAV6.

Disclosed herein is a method of making engineered cells comprising contacting a plurality of cells with a Clustered Regularly Interspaced Short Palindromic Repeats (CRISPR) system, thereby generating a plurality of engineered cells comprising a genomic disruption; and contacting engineered cells with an effective amount of adeno-associated viral (AAV) particles encoding a cellular receptor and comprising a first mutation in a VP1 region and a second mutation in a VP3 region in a capsid protein, thereby generating a plurality of engineered transduced cells, wherein expression of the cellular receptor is increased in the engineered transduced cells between about 10× to 300× at a mean of infectivity (MOI) of 200,000 GC/mL as compared to comparable cells contacted with wild type AAV particles or AAV particles comprising a single mutation in a VP1 region of said capsid protein at the MOI, wherein the wild type AAV particles or AAV particles comprising the single mutation in the VP1 region of the capsid protein also encode the cellular receptor. In some cases, the plurality of cells can be a plurality of primary cells. In some cases, primary cells are lymphocytes. In some cases, AAV particles can be AAV6. In some cases, a first mutation can be in an F encoding sequence at position 129 of a VP1 region of a polypeptide encoded by the nucleic acid. In some cases, a first mutation encodes a mutation from an F at position 129 of the polypeptide to a nonpolar aliphatic amino acid. In some cases, a nonpolar aliphatic amino acid can be selected from: leucine (L), isoleucine (I), and valine (V). A nonpolar aliphatic amino acid can be an L. A second mutation can be in a leucine (L) encoding sequence in a polypeptide. A second mutation can be in an L encoding sequence at position 584 of a polypeptide encoded by a nucleic acid. A second mutation can encode a mutation from an L at position 584 of a polypeptide to a polar amino acid. A polar amino acid can be selected from: asparagine (N) and glutamine (Q). A polar amino acid can be an N. In some cases, a second mutation encodes a mutation from an L at position 584 to a positively charged amino acid. In some cases, a positively charged amino acid is histidine (H). In some cases, a mutation encodes a mutation from an L at position 584 of the polypeptide to a negatively charged amino acid. A negatively charged amino acid can be selected from: aspartate (D) and glutamate (E). A negatively charged amino acid can be a D. In some cases, a second mutation can be in a valine (V) encoding sequence in the polypeptide. In some cases, a second mutation is in a V encoding sequence at position 598 of the polypeptide encoded by the nucleic acid. A mutation can encode a Vat position 598 of a polypeptide to a nonpolar aliphatic amino acid. In some cases, a nonpolar aliphatic amino acid can be selected from: leucine (L), isoleucine (I), and valine (V). A nonpolar aliphatic amino acid can be an L. A nonpolar aliphatic amino acid can be an I. A second mutation can be in a histidine (H) encoding region in a polypeptide. A second mutation can be in an H encoding region at position 642 in a polypeptide. In some cases, a second mutation encodes a mutation from an H at position 642 of a polypeptide to a polar amino acid. In some cases, a polar amino acid can be selected from: asparagine (N) and glutamine (Q). A polar amino acid can be an N. A first mutation can be in an aromatic amino acid encoding sequence in a nucleic acid prior to a second mutation, and a second mutation can encode a nonpolar aliphatic amino acid in a polypeptide encoded by a nucleic acid. An aromatic amino acid can be at position 129 of a VP1 polypeptide encoded by a VP1 region. A first mutation can be in a sequence encoding a more hydrophobic amino acid than the amino acid encoded at a position of a sequence prior to a second mutation. A second mutation can encode at least one mutation selected from the group consisting of an: a positively charged amino acid to a polar amino acid, a negatively charged amino acid to a polar amino acid. A second mutation encodes a conservative mutation. A conservative mutation can be selected from the group consisting of: a nonpolar aliphatic amino acid to a nonpolar aliphatic amino acid, a polar amino acid to a polar amino acid, a positively charged amino acid to a positively charged amino acid, a negatively charged amino acid to a negatively charged amino acid, and an aromatic amino acid to an aromatic amino acid. A first mutation can be in a sequence encoding a less hydrophobic amino acid than the amino acid encoded at a position of the sequence prior to the second mutation. A first mutation and a second mutation can be selected from the group consisting: F129L, H642N, and D418N; F129L, H642N, and L584N; F129L, H462N, and V598L; F129L, H462N, and V598I. A cellular receptor can be a T cell receptor. A method can further comprise expanding engineered cells. A method can further comprise administering engineered cells to a subject in need thereof. A subject can have a cancer. A cancer can be a solid cancer.

Disclosed herein is an isolated and purified adeno-associated virus (AAV) capsid nucleic acid sequence that comprises mutations F129L and H642N in the AAV polypeptide encoded by the capsid nucleic acid sequence.

Disclosed herein is an isolated and purified adeno-associated virus (AAV) capsid nucleic acid sequence that comprises mutations F129L and L584D in the AAV polypeptide encoded by the capsid nucleic acid sequence.

Disclosed herein is an isolated and purified adeno-associated virus (AAV) capsid nucleic acid sequence that comprises mutations F129L and D418N in the AAV polypeptide encoded by the capsid nucleic acid sequence.

Disclosed herein is an isolated and purified adeno-associated virus (AAV) capsid nucleic acid sequence that comprises mutations F129L and L584H in the AAV polypeptide encoded by the capsid nucleic acid sequence.

Disclosed herein is an isolated and purified adeno-associated virus (AAV) capsid nucleic acid sequence that comprises mutations F129L, H642N, and D418N in the AAV polypeptide encoded by the capsid nucleic acid sequence.

Disclosed herein is an isolated and purified adeno-associated virus (AAV) capsid nucleic acid sequence that comprises mutations F129L, H642N, and L584D in the AAV polypeptide encoded by the capsid nucleic acid sequence.

Disclosed herein is an isolated and purified adeno-associated virus (AAV) capsid nucleic acid sequence that comprises mutations F129L, H642N, and L584N in the AAV polypeptide encoded by the capsid nucleic acid sequence.

Disclosed herein is an isolated and purified adeno-associated virus (AAV) capsid nucleic acid sequence that comprises mutations F129L, H642N and L584H in the AAV polypeptide encoded by the capsid nucleic acid sequence.

Disclosed herein is an isolated and purified adeno-associated virus (AAV) capsid nucleic acid sequence that comprises mutations F129L, H642N, and V598L in the AAV polypeptide encoded by the capsid nucleic acid sequence.

Disclosed herein is an isolated and purified adeno-associated virus (AAV) capsid nucleic acid sequence that comprises mutations F129L, H642N, and V598I in the AAV polypeptide encoded by the capsid nucleic acid sequence.

Disclosed herein is a cell comprising an isolated and purified polynucleic acid.

Disclosed herein is a method of making an engineered cell comprising introducing to a cell a sequence a guiding nucleic acid.

Disclosed herein is a method of making engineered cells comprising contacting a plurality of cells with an effective amount of adeno-associated viral (AAV) particles comprising a VP1 sequence, a VP2 sequence, and a VP3 sequence, wherein two of the VP1 sequence, VP2 sequence, and VP3 sequence are from a first AAV serotype, and one of said VP1 sequence, VP2 sequence, and VP3 sequence are from a second AAV serotype, thereby generating a plurality of engineered cells, wherein expression of a transgene after transduction or transfection of the engineered cells is increased as compared to a comparable plurality of cells contacted with wild type AAV particles or AAV particles comprising wild-type VP1, VP2, or VP3 sequences.

Disclosed herein is a method of making engineered cells comprising contacting a plurality of cells with an effective amount of adeno-associated viral (AAV) particles comprising a VP1 sequence, a VP2 sequence, and a VP3 sequence, wherein two of the VP1 sequence, VP2 sequence, and VP3 sequence are from a first AAV serotype, and one of the VP1 sequence, VP2 sequence, and VP3 sequence are from a second AAV serotype, thereby generating a plurality of engineered cells, wherein expression of a transgene after transduction or transfection of said plurality of cells is increased between about 10× to 300× at a mean of infectivity (MOI) of 200,000 GC/mL as compared to a comparable plurality of cells contacted with wild type AAV particles or AAV particles comprising wild-type VP1, VP2, or VP3 sequences, at the MOI.

Disclosed herein is a method of making engineered cells comprising contacting a plurality of cells with an effective amount of adeno-associated viral (AAV) particles encoding a transgene and comprising a VP1 sequence, a VP2 sequence, and a VP3 sequence, wherein two of the VP1 sequence, VP2 sequence, and VP3 sequence are from a first AAV serotype, and one of the VP1 sequence, VP2 sequence, and VP3 sequence are from a second AAV serotype, thereby generating a plurality of engineered cells, wherein expression of the transgene in the plurality of cells is increased as compared to cells contacted with wild type AAV particles or AAV particles comprising a wild-type VP sequence, wherein the wild type AAV particles or AAV particles comprising the wild-type VP sequence of the capsid protein also encode the transgene. In some cases, a transgene encodes a cellular receptor or a portion thereof. In some cases, a cellular receptor or portion thereof is a T cell receptor. In some cases, a cellular receptor or portion thereof is a chimeric antigen receptor. In some cases, AAV particles comprise an AAV5 VP1u nucleotide sequence and AAV6 VP2 and VP3 nucleotide sequences. In some cases, AAV particles comprise AAV4 VP1 and VP2 nucleotide sequences and an AAV6 VP3 nucleotide sequence. In some cases, AAV particles comprise AAV5 VP1 and VP2 nucleotide sequences and an AAV6 VP2 and VP3 nucleotide sequence. In some cases, AAV particles comprise AAV11 VP1 and VP2 nucleotide sequences and an AAV6 VP3 nucleotide sequence. In some cases, AAV particles comprise AAV12 VP1 and VP2 nucleotide sequences and AAV6 VP3 nucleotide sequences. In some cases, AAV particles comprise an AAV1 VP1u nucleotide sequence and AAV6 VP2 and VP3 nucleotide sequences. In some cases, AAV particles comprise an AAV12 VP1u nucleotide sequence and AAV6 VP2 and VP3 nucleotide sequences. In some cases, AAV particles comprise an AAV5 VP1u sequence and AAV6 VP2 and VP3 sequences. In some cases, AAV particles comprise AAV4 VP1 and VP2 sequences and an AAV6 VP3 sequence. In some cases, AAV particles comprise AAV5 VP1 and VP2 sequences and AAV6 VP2 and VP3 sequences. In some cases, AAV particles comprise AAV11 VP1 and VP2 sequences and an AAV6 VP3 sequence. In some cases, AAV particles comprise AAV12 VP1 and VP2 sequences and an AAV6 VP3 sequence. In some cases, AAV particles comprise an AAV1 VP1u sequence and AAV6 VP2 and VP3 sequences. In some cases, AAV particles comprise an AAV12 VP1u sequence and AAV6 VP2 and VP3 sequences. In some cases, a method further comprises contacting a plurality of cells with a Clustered Regularly Interspaced Short Palindromic Repeats (CRISPR) system, thereby generating a plurality of engineered cells comprising a genomic disruption. In some cases, a contacting is before, concurrent, or after said contacting with said AAV particles.

Disclosed herein is a method of making engineered transduced cells comprising contacting a plurality of cells with a Clustered Regularly Interspaced Short Palindromic Repeats (CRISPR) system, thereby generating a plurality of engineered cells comprising a genomic disruption; and contacting the engineered cells with an effective amount of adeno-associated viral (AAV) particles encoding a cellular receptor and comprising a VP1 sequence, a VP2 sequence, and a VP3 sequence, wherein two of the VP1 sequence, VP2 sequence, and VP3 sequence are from a first AAV serotype, and one of the VP1 sequence, VP2 sequence, and VP3 sequence are from a second AAV serotype, thereby generating a plurality of engineered transduced cells, wherein expression of the cellular receptor is increased in said engineered transduced cells between about 10× to 300× at a mean of infectivity (MOI) of 200,000 GC/mL as compared to comparable cells contacted with wild-type AAV particles or AAV particles comprising a wild-type VP sequence, at said MOI, wherein said wild type AAV particles or AAV particles comprising the wild-type VP sequence also encode the cellular receptor. In some cases, a plurality of cells can be a plurality of primary cells. A method can further comprise administering engineered cells to a subject in need thereof. In some cases, a subject has a cancer. In some cases, AAV particles comprise an AAV5 VP1u nucleotide sequence and AAV6 VP2 and VP3 nucleotide sequences. In some cases, AAV particles comprise AAV4 VP1 and VP2 nucleotide sequences and an AAV6 VP3 nucleotide sequence. In some cases, AAV particles comprise AAV5 VP1 and VP2 nucleotide sequences and an AAV6 VP2 and VP3 nucleotide sequence. In some cases, AAV particles comprise AAV11 VP1 and VP2 nucleotide sequences and an AAV6 VP3 nucleotide sequence. In some cases, AAV particles comprise AAV12 VP1 and VP2 nucleotide sequences and AAV6 VP3 nucleotide sequences. In some cases, AAV particles comprise an AAV1 VP1u nucleotide sequence and AAV6 VP2 and VP3 nucleotide sequences. In some cases, AAV particles comprise an AAV12 VP1u nucleotide sequence and AAV6 VP2 and VP3 nucleotide sequences. In some cases, AAV particles comprise an AAV5 VP1u sequence and AAV6 VP2 and VP3 sequences. In some cases, AAV particles comprise AAV4 VP1 and VP2 sequences and an AAV6 VP3 sequence. In some cases, AAV particles comprise AAV5 VP1 and VP2 sequences and AAV6 VP2 and VP3 sequences. In some cases, AAV particles comprise AAV11 VP1 and VP2 sequences and an AAV6 VP3 sequence. In some cases, AAV particles comprise AAV12 VP1 and VP2 sequences and an AAV6 VP3 sequence. IN some cases, AAV particles comprise an AAV1 VP1u sequence and AAV6 VP2 and VP3 sequences. In some cases, AAV particles comprise an AAV12 VP1u sequence and AAV6 VP2 and VP3 sequences. In some cases, AAV particles can comprise AAV6 particles. In some cases, contacting can be before, concurrent, or after contacting with AAV particles. A CRISPR system comprises a guide RNA (gRNA) and an endonuclease. An endonuclease can be CAS. Cas can be selected from the group consisting of: Cas1, Cas1B, Cas2, Cas3, Cas4, Cas5, Cas6, Cas7, Cas8, Cas9 (also known as Csn1 or Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpfl, c2c1, c2c3, Cas9HiFi, homologues thereof, and modified versions thereof. A CRISPR system can be electroporated or nucleofected into a plurality of cells. A CRISPR system can be encoded by DNA, RNA, or a combination hereof. A CRISPR system can be encoded by RNA. A method can further comprise expanding engineered cells. Engineered cells can be expanded to at least about $1 \times 10^8$ cells.

Disclosed herein is an isolated and purified adeno-associated virus (AAV) nucleotide sequence that encodes a capsid comprising the F129L, H642N, and L584D mutations.

Disclosed herein is an isolated and purified adeno-associated virus (AAV) nucleotide sequence that encodes a capsid comprising the F129L, H642N, and D418N mutations.

Disclosed herein is an isolated and purified adeno-associated virus (AAV) nucleotide sequence that encodes a capsid comprising the F129L, H642N, and L584N mutations.

Disclosed herein is an isolated and purified adeno-associated virus (AAV) nucleotide sequence that encodes a capsid comprising the F129L, H642N, and L584D mutations.

Disclosed herein is an isolated and purified adeno-associated virus (AAV) nucleotide sequence that encodes a capsid comprising the F129L, H462N, and V598L mutations.

Disclosed herein is an isolated and purified adeno-associated virus (AAV) nucleotide sequence that encodes a capsid comprising the F129L, H642N, and V598I mutations.

Disclosed herein is an engineered cell generated by transfecting a cell with an isolated and purified AAV nucleotide sequence.

Disclosed herein is a plurality of adeno-associated viral (AAV) particles isolated from an engineered cell.

Disclosed herein is a container comprising a plurality of adeno-associated viral (AAV) particles.

Disclosed herein is an isolated and purified adeno-associated virus (AAV) nucleotide sequence that comprises AAV4 VP1 and VP2 nucleotide sequences and an AAV6 VP3 nucleotide sequence.

Disclosed herein is an isolated and purified adeno-associated virus (AAV) nucleotide sequence that comprises AAV5 VP1 and VP2 nucleotide sequences and an AAV6 VP2 and VP3 nucleotide sequence.

Disclosed herein is an isolated and purified adeno-associated virus (AAV) nucleotide sequence that comprises AAV11 VP1 and VP2 nucleotide sequences and an AAV6 VP3 nucleotide sequence.

Disclosed herein is an isolated and purified adeno-associated virus (AAV) nucleotide sequence that comprises AAV12 VP1 and VP2 nucleotide sequences and AAV6 VP3 nucleotide sequences.

Disclosed herein is an isolated and purified adeno-associated virus (AAV) nucleotide sequence that comprises an AAV1 VP1 nucleotide sequence and AAV6 VP2 and VP3 nucleotide sequences. In some embodiments, the AAV1 VP1 nucleotide sequence is an AAV1 VP1u nucleotide sequence.

Disclosed herein is an isolated and purified adeno-associated virus (AAV) nucleotide sequence that comprises an AAV12 VP1 nucleotide sequence and AAV6 VP2 and VP3 nucleotide sequences. In some embodiments, the AAV1 VP1 nucleotide sequence is an AAV1 VP1u nucleotide sequence.

Disclosed herein is an isolated and purified adeno-associated virus (AAV) nucleotide sequence that comprises an AAV5 VP1 sequence and AAV6 VP2 and VP3 sequences. In some embodiments, the AAV1 VP1 nucleotide sequence is an AAV1 VP1u nucleotide sequence.

Disclosed herein is an isolated and purified adeno-associated virus (AAV) nucleotide sequence that comprises AAV4 VP1 and VP2 sequences and an AAV6 VP3 sequence.

Disclosed herein is an isolated and purified adeno-associated virus (AAV) nucleotide sequence that comprises AAV5 VP1 and VP2 sequences and AAV6 VP2 and VP3 sequences.

Disclosed herein is an isolated and purified adeno-associated virus (AAV) nucleotide sequence that comprises AAV11 VP1 and VP2 sequences and an AAV6 VP3 sequence.

Disclosed herein is an isolated and purified adeno-associated virus (AAV) nucleotide sequence that comprises AAV12 VP1 and VP2 sequences and an AAV6 VP3 sequence.

Disclosed herein is an isolated and purified adeno-associated virus (AAV) nucleotide sequence that comprises an AAV1 VP1 sequence and AAV6 VP2 and VP3 sequences. In some embodiments, the AAV1 VP1 nucleotide sequence is an AAV1 VP1u nucleotide sequence.

Disclosed herein is an isolated and purified adeno-associated virus (AAV) nucleotide sequence that comprises an AAV12 VP1 sequence and AAV6 VP2 and VP3 sequences. In some embodiments, the AAV1 VP1 nucleotide sequence is an AAV1 VP1u nucleotide sequence.

Disclosed herein is an engineered cell generated by transfecting a cell with an isolated and purified AAV nucleotide sequence.

Disclosed herein is a plurality of adeno-associated viral (AAV) particles isolated from an engineered cell.

Disclosed herein is a container comprising a plurality of adeno-associated viral (AAV) particles.

Disclosed herein is an isolated non-naturally occurring nucleic acid that comprises an adeno-associated virus (AAV) nucleotide sequence that comprises a first mutation in a VP1 region and a second mutation in a VP3 region as compared to a wild-type AAV nucleotide sequence, wherein the isolated non-naturally occurring nucleic acid upon introduction into a plurality of cells confers increased AAV transduction efficiency in the plurality of cells as compared to a wild-type AAV nucleic acid. In some cases, an AAV can be of serotype AAV1, AAV2, AAV3, AAV4, AAV5, AAV6, AAV7, AAV8, AAV9, AAV10, AAV11, AAV12, and any combination thereof. In some cases, an AAV can be AAV6. A nucleic acid can be at least one of DNA or RNA. In some cases, a nucleic acid can be DNA. In some cases, a mutation can comprise at least one of a point mutation, missense mutation, nonsense mutation, insertion, deletion, duplication, frameshift, or repeat expansion. A mutation can be a point mutation. In some cases, first mutation in a VP1 region comprises an F to L mutation. In some cases, a first mutation in a VP1 region can occur at position 129 of an AAV nucleotide sequence. In some cases, a second mutation in a VP3 region can comprise at least one mutation selected from the group consisting of an: H to N, D to N, D to N, V to L, and V to I. In some cases, a second mutation in a VP3 region can occur at position 418, 462, 584, 598, or 642 of an AAV polypeptide sequence encoded by said AAV nucleotide sequence. In some cases, a nucleic acid can comprise at least one of F129L, H642N, and D418N. In some cases, a nucleic acid can comprise at least one of F129L, H642N, and L584N. In some cases, a nucleic acid can comprise at least one of F129L, H462N, or V598L. In some cases, a nucleic acid can comprise at least one of F129L, H462N, or V598I. In some cases, a plurality of cells can be primary cells. An AAV nucleotide sequence can encode at least a portion of an exogenous receptor sequence. In some cases, a nucleic acid can be formulated into a pharmaceutical composition. In some cases, a wild-type AAV nucleic acid can comprise at least 60% sequence identity to SEQ ID NO: 55.

Disclosed herein is an isolated and purified adeno-associated virus (AAV) nucleotide sequence that encodes a capsid comprising at least two mutations selected from the group consisting of: F129L, H642N, and D418N.

Disclosed herein is an isolated and purified adeno-associated virus (AAV) nucleotide sequence that encodes a capsid comprising the at least two mutations selected from the group consisting of: F129L, H642N, and L584N.

Disclosed herein is an isolated and purified adeno-associated virus (AAV) nucleotide sequence that encodes a capsid comprising the at least two mutations selected from the group consisting of: F129L, H462N, and V598L.

Disclosed herein is an isolated and purified adeno-associated virus (AAV) nucleotide sequence that encodes a capsid comprising the at least two \mutations selected from the group consisting of: F129L, H642N, and V598I.

Disclosed herein is an isolated and purified protein generated from the adeno-associated virus (AAV) nucleotide sequence.

Disclosed herein is an isolated and purified adeno-associated virus (AAV) nucleic acid sequence that comprises at least 60% sequence identity or similarity with any one of amino acid sequence SEQ ID NO: 1 to SEQ ID NO: 19. In some cases, a sequence identity can be from about 60%, 70%, 80%, 85%, 90%, 95%, 96%, 97%, 98%, 99%, and up to about 100%.

Disclosed herein is an isolated non-naturally occurring nucleic acid that comprises an adeno-associated virus (AAV) nucleotide sequence that comprises VP1, VP2, and VP3 sequences, wherein two of the VP1, VP2, and VP3 sequences are from a first AAV serotype, and one of the VP1, VP2, and VP3 sequences are from a second AAV serotype, wherein the isolated non-naturally occurring nucleic acid upon introduction into a plurality of cells confers increased AAV transduction efficiency as compared to a wild-type AAV nucleic acid. In some cases, a first AAV serotype and a second AAV serotype can be selected from AAV1, AAV2, AAV3, AAV4, AAV5, AAV6, AAV7, AAV8, AAV9, AAV10, AAV11, AAV12, or any combination thereof. In some cases, a first AAV serotype and a second AAV serotype can be selected from a group consisting of: AAV4 and AAV6, AAV5 and AAV6, AAV11 and AAV6, AAV12 and AAV6, and any combination thereof. In some cases, a nucleic acid can be at least one of DNA or RNA. A nucleic acid can be DNA. Transduction efficiency can comprise an expression of a transgene encoded by a nucleic acid on a plurality of cells. In some cases, cells can be primary cells. A transgene can encode at least a portion of an exogenous receptor sequence. In some cases, an isolated non-naturally occurring nucleic acid can be formulated into a pharmaceutical composition. In some cases, a VP1, VP2, and VP3 regions can comprise at least a portion of a capsid.

Disclosed herein is an isolated and purified adeno-associated virus (AAV) nucleic acid sequence that comprises at least 60% sequence identity or similarity with any one of amino acid sequence SEQ ID NO: 1 to SEQ ID NO: 19 and SEQ ID NO: 195 to SEQ ID NO: 213. In some cases, a sequence identity can be from about 60%, 70%, 80%, 85%, 90%, 95%, 96%, 97%, 98%, 99%, and up to about 100%.

Disclosed herein is an engineered cell generated by transfecting a cell with the isolated and purified AAV nucleic acid sequence.

Disclosed herein is a plurality of adeno-associated viral (AAV) particles that comprise at least one of: a first mutation in a first VP1 region and a second mutation in a firstVP3 region; and a second VP1, a first VP2, and a second VP3 sequence, wherein two of the second VP1, first VP2, and second VP3 sequences are from a first AAV serotype, and one of the second VP1, first VP2, and second VP3 sequences are from a second AAV serotype, wherein when the AAV particles transduce cells the AAV particles confer increased transduction efficiency as compared to a plurality of wild-type AAV particles. In some cases, a first and a second AAV serotype can be selected from AAV1, AAV2, AAV3, AAV4, AAV5, AAV6, AAV7, AAV8, AAV9, AAV10, AAV11, AAV12, and any combination thereof. In some cases, a first AAV serotype and a second AAV serotype can be selected from a group consisting of: AAV4 and AAV6, AAV5 and AAV6, AAV11 and AAV6, AAV12 and AAV6, and any combination thereof. A first AAV serotype and a second AAV serotype can be AAV4 and AAV6. A first AAV serotype and a second AAV serotype can be AAV5 and AAV6. A first AAV serotype and a second AAV serotype can be AAV11 and AAV6. A first AAV serotype and a second AAV serotype can be AAV12 and AAV6. In some cases, a first and a second mutation can be selected from the group consisting of a point mutation, missense mutation, nonsense mutation, insertion, deletion, duplication, frameshift, or repeat expansion. In some cases, a first mutation and second mutation are point mutations. A point mutation can be selected from the group consisting of F to L, H to N, D to N, D to N, V to L, and V to I. A first mutation in a first VP1 region can occur at position 129 of an AAV polypeptide sequence encoded by said AAV nucleotide sequence. A second mutation in a first VP3 region can occur at a position selected from a group consisting of: 418, 462, 584, 598, and 642 of an AAV polypeptide sequence encoded by said AAV nucleotide sequence. A first mutation and a second mutation can be at least two mutations selected from a group consisting of: F129L, H642N, and D418N; F129L, H642N, and L584N; F129L, H462N, and V598L; F129L, H462N, and V598I. A first mutation in a first VP1 region and a second mutation in a first VP3 region can be at least two mutations selected from F129L, H642N, and D418N. In some cases, a first mutation in a first VP1 region and a second mutation in a first VP3 region can be at least two mutations selected from F129L, H642N, and L584N. In some cases, a first mutation in a first VP1 region and a second mutation in a first VP3 region can be at least two mutations selected from L584N, F129L, and H462N. In some cases, a first mutation in a first VP1 region and a second mutation in a first VP3 region can be at least two mutations selected from F129L, H642N, and V598I. In some cases, a first mutation in a first VP1 region and a second mutation in a first VP3 region can occur on at least a portion of a viral capsid sequence. In some cases, a first mutation in a first VP1 region and a second mutation in a first VP3 region occur on an N-terminus or C-terminus of an AAV nucleotide sequence. In some cases, cells can be mammalian cells. Mammalian cells can be human cells. In some cases, human cells can be primary cells. In some cases, AAV particles can be introduced to a cell at a multiplicity of infection (MOI) from about 200 GC/mL up to about $1 \times 10^8$ GC/mL In some cases, a MOI can be $1 \times 10^6$ GC/mL. In some cases, an MOI can be from about $2.77 \times 10^{12}$ GC/ml to $2.80 \times 10^{14}$ GC/ml. In some cases, a transduction percentage can be from about 30%, 40%, 50%, 60%, and up to 100% of cells. A transduction percentage can be measured by flow cytometry. In some cases, AAV particles can encode at least a portion of an exogenous receptor. AAV particles can be cryopreserved. In some cases, AAV particles can be thawed prior to introduction to cells. AAV particles can be good manufacturing practices (GMP) compatible.

Disclosed herein is a method of making engineered cells comprising contacting cells with a plurality of AAV particles. In some cases, cells can be mammalian cells Mammalian cells can be human cells. Human cells can be primary cells. In some cases, cells can be stimulated prior to contacting of cells with a plurality of AAV particles. In some cases, stimulation can be performed with anti-CD3, anti-CD28, interleukin-2 (IL-2), and any combination thereof. In some cases, a contacting can be performed before, after, or concurrent with stimulation. In some cases, a contacting of cells with a plurality of AAV particles can be performed after stimulation. In some cases, stimulation can be performed from 4 days before to 24 hours before a contacting of cells with a plurality of AAV particles. In some cases, stimulation can be performed 3 days before a contacting of cells with a plurality of AAV particles. In some cases, a method can further comprise a genomic disruption. A genomic disruption can comprise a CRISPR system. In some cases, a genomic disruption can be performed prior to a contacting of cells with a plurality of AAV particles. In some cases, a method can further comprise expanding engineered cells. In some cases, a method can further comprise administering engineered cells in unit dosage form to a subject in need thereof An administering can be an infusion. An administering of engineered cells can at least partially ameliorate a disease or condition in a subject in need thereof. A disease or condition can comprise a cancer. In some cases, amelioration can comprise a reduction in a cancer by at least about 30% as measured by computerized tomography (CT) scan. Amelioration can comprise stabilizing tumor size as measured by a less than 10% change in a baseline measurement of a diameter of a tumor lesion as measured by computerized tomography (CT) scan.

Disclosed herein is a method of screening a plurality of engineered adeno associated viral (AAV) particles comprising: A. introducing at least one of a mutation or exogenous AAV genome to a genome of an adeno-associated virus (AAV) nucleotide sequence to form engineered AAV particles; B. introducing a plurality of the engineered AAV particles from A. to a plurality of cellular genomes; and C. quantifying a level of expression of a transgene encoded by the plurality of AAV particles in the plurality of cellular genomes wherein the level of expression is compared to a second level of expression obtained from a second AAV particle introduced a different mutation or exogenous AAV genome from A. A mutation can comprise at least one of a point mutation, missense mutation, nonsense mutation, insertion, deletion, duplication, frameshift, or repeat expansion. A mutation can comprise a point mutation. A genome of an adeno-associated virus (AAV) nucleotide sequence can be of serotype AAV6. An exogenous AAV genome can be of serotype AAV1, AAV2, AAV3, AAV4, AAV5, AAV7, AAV8, AAV9, AAV10, AAV11, or AAV12. An exogenous AAV genome can be AAV4. An exogenous AAV genome can be AAV5. An exogenous AAV genome can be AAV11. An exogenous AAV genome can be AAV12. In some cases, a cellular genome can be from a primary cell. In some cases, a quantifying of a level of an expression can be determined by flow cytometry. In some cases, engineered AAV particles when introduced to cellular genomes can confer increased transduction as compared to non-engineered AAV particles. In some cases, increased transduction can be from about 30%, 40%, 50%, 60%, and up to 100% as compared to a second level of expression obtained from a second AAV particle introduced a different mutation or exogenous AAV genome from A. A transduction can be measured by flow cytometry.

Disclosed herein is a method of making an engineered cell comprising introducing to a cell a viral sequence that is at least 95%, 96%, 97%, 98%, and up to 99% identical to at least one of SEQ ID NO: 195 to SEQ ID NO: 220. In some cases, engineered cells can be expanded to a population of engineered cells. A population of engineered cells can be formulated into a pharmaceutical composition.

Disclosed herein is a method of making a viral supernatant comprising introducing to a cell a polynucleic acid. In some cases, a method can further comprise collecting viral supernatant from a cell or cells from at least about 24 to 72 hours post an introducing. In some cases, collecting can comprise determining a concentration of a viral particle in a supernatant. A method can further comprise cryopreserving a viral supernatant in unit dosage form.

Disclosed herein is a method of increasing expression of an exogenous transgene in a cell comprising introducing to a cell a viral supernatant.

Disclosed herein is a method of making engineered cells comprising: genomically disrupting at least a portion of a gene with a CRISPR system; introducing to cells a plurality of adeno-associated viral (AAV) particles comprising at least one of a mutation in a capsid protein or a serologically chimeric capsid protein; and expanding the cells. Cells can be primary cells. A gene can be an immune checkpoint gene. AAV particles can be AAV6. A mutation can be selected from a group consisting: F129L, H642N, and D418N; F129L, H642N, and L584N; F129L, H462N, and V598L; F129L, H462N, and V598I. A serologically chimeric capsid protein can comprise at least a portion of a capsid from AAV4 and AAV6, AAV5 and AAV6, AAV11 and AAV6, AAV12 and AAV6, and any combination thereof. AAV particles can encode at least one transgene. A transgene can encode an exogenous receptor. In some cases, a method can further comprise administering engineered cells to a subject in need thereof. In some cases, a subject can have a cancer.

Disclosed herein is an isolated and purified adeno-associated virus (AAV) nucleic acid sequence that comprises mutations F129L and H642N in an AAV nucleic acid sequence.

Disclosed herein is an isolated and purified adeno-associated virus (AAV) nucleic acid sequence that comprises mutations F129L and L584D in an AAV nucleic acid sequence.

Disclosed herein is an isolated and purified adeno-associated virus (AAV) nucleic acid sequence that comprises mutations F129L and D418N in an AAV nucleic acid sequence.

Disclosed herein is an isolated and purified adeno-associated virus (AAV) nucleic acid sequence that comprises mutations F129L and L584H in an AAV nucleic acid sequence.

Disclosed herein is an isolated and purified adeno-associated virus (AAV) nucleic acid sequence that comprises mutations F129L, H642N, and D418N in an AAV nucleic acid sequence.

Disclosed herein is an isolated and purified adeno-associated virus (AAV) nucleic acid sequence that comprises mutations F129L, H642N, and L584D in an AAV nucleic acid sequence.

Disclosed herein is an isolated and purified adeno-associated virus (AAV) nucleic acid sequence that comprises mutations F129L, H642N, and L584N in an AAV nucleic acid sequence.

Disclosed herein is an isolated and purified adeno-associated virus (AAV) nucleic acid sequence that comprises mutations F129L, H642N and L584H in an AAV nucleic acid sequence.

Disclosed herein is an isolated and purified adeno-associated virus (AAV) nucleic acid sequence that comprises mutations F129L, H642N, and V598L in an AAV nucleic acid sequence.

Disclosed herein is an isolated and purified adeno-associated virus (AAV) nucleic acid sequence that comprises mutations F129L, H642N, and V598I in an AAV nucleic acid sequence.

Disclosed herein is a method of making engineered cells comprising genomically disrupting at least a portion of a gene with a CRISPR system; introducing to a plurality of cells a plurality of adeno-associated viral (AAV) particles comprising at least one of a first mutation in a VP1 region and a second mutation in a VP3 region in a capsid protein or a serologically chimeric capsid protein comprising at least a portion of an AAV6 capsid protein; and expanding the cells.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 13 shows an annotated AAV6 WT sequence (SEQ ID NO: 246).

FIG. 22C shows average packaging efficiency of the four AAV variants, n=3.

FIG. 25A and FIG. 25B show a schematic of a PCR strategy to amplify regions of the AAV signature region to identify AAV serotypes.

FIG. 26C shows a western blot of human PBMC donors screened for AAV using primers forward-2 and reverse-3 that yield a 258 bp product.

DETAILED DESCRIPTION OF THE DISCLOSURE

Figure 1:
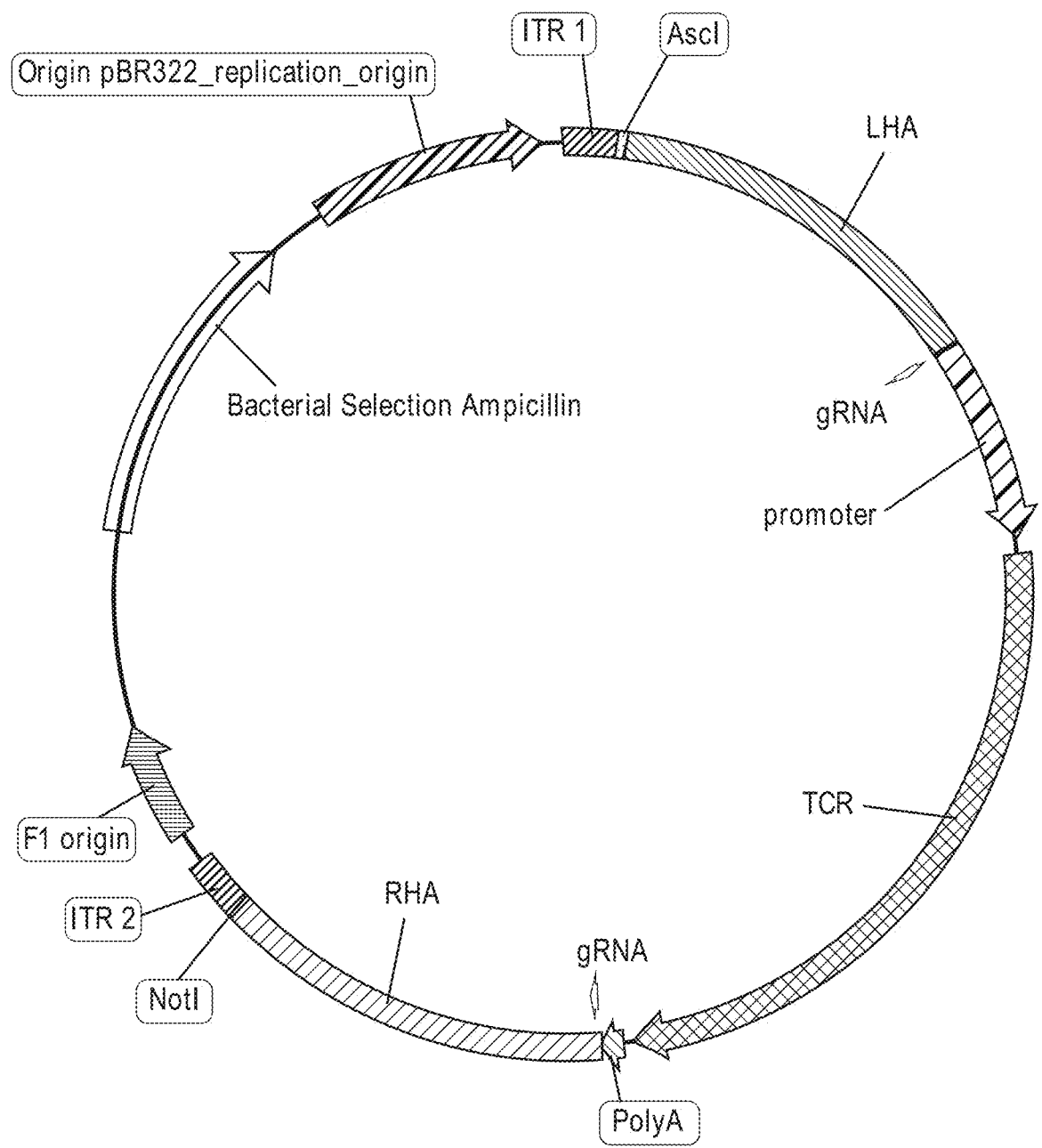
FIG. 1 shows an exemplary AAV vector that encodes for an exogenous TCR.
Figure 2:
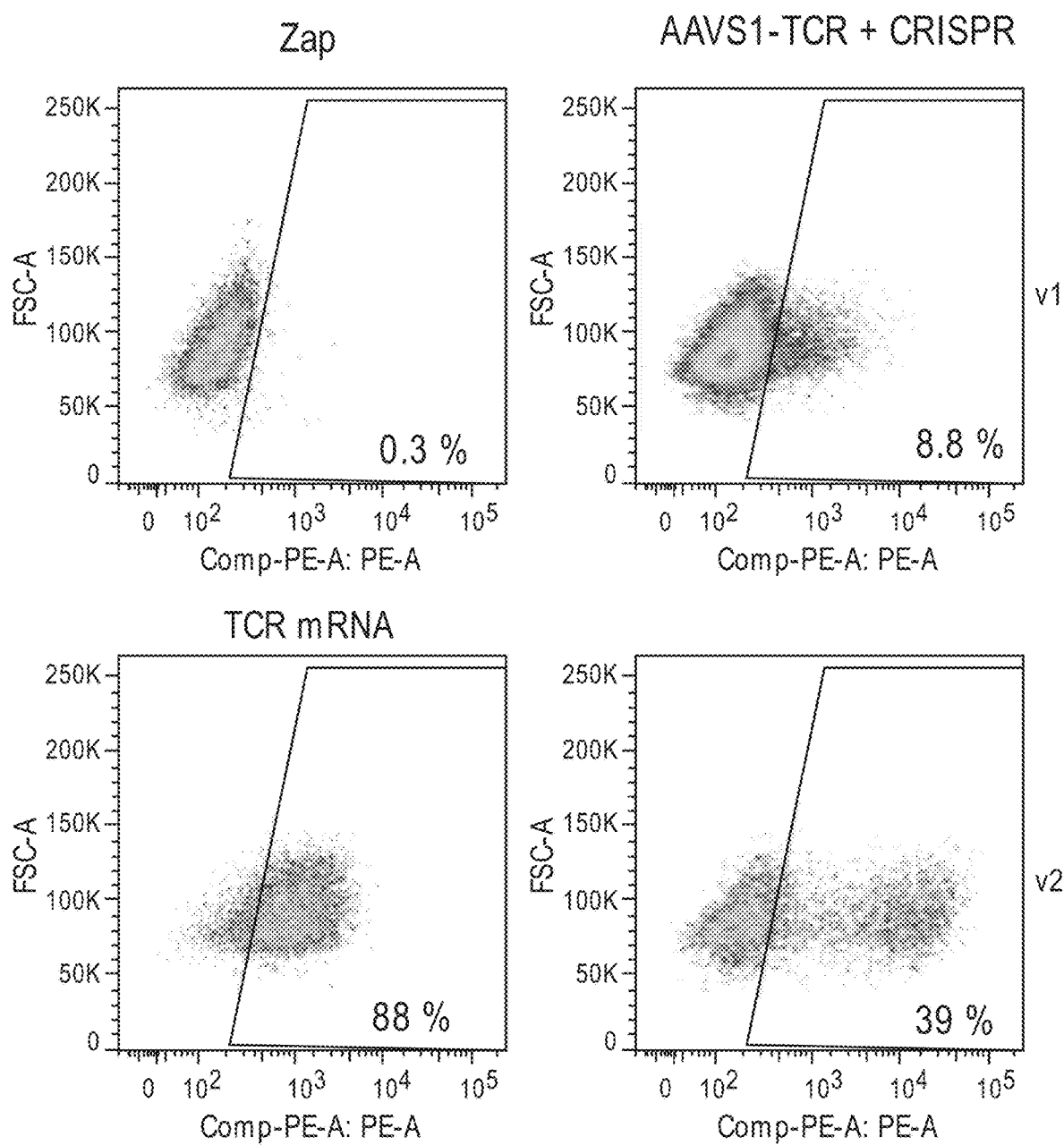
FIG. 2 shows a comparison of percent receptor expression in human primary cells transduced with AAV V1 (WT) or F129L (V2) and CRISPR at target gene sites as compared to control (electroporation with no CRISPR). Experiment was performed at a MOI of $1 \times 10^6$ GC/mL.
Figure 2:
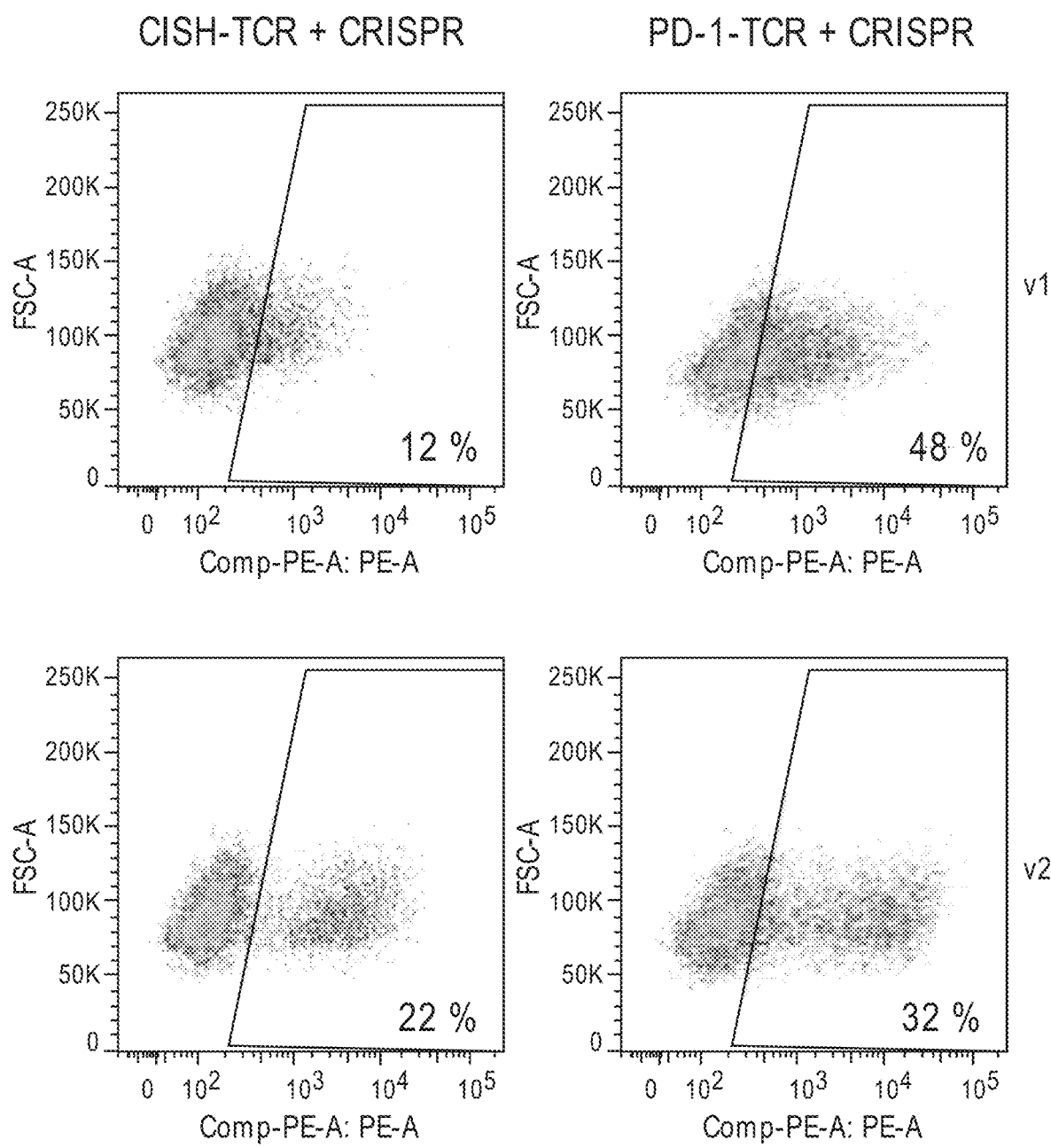
Figure 3A:
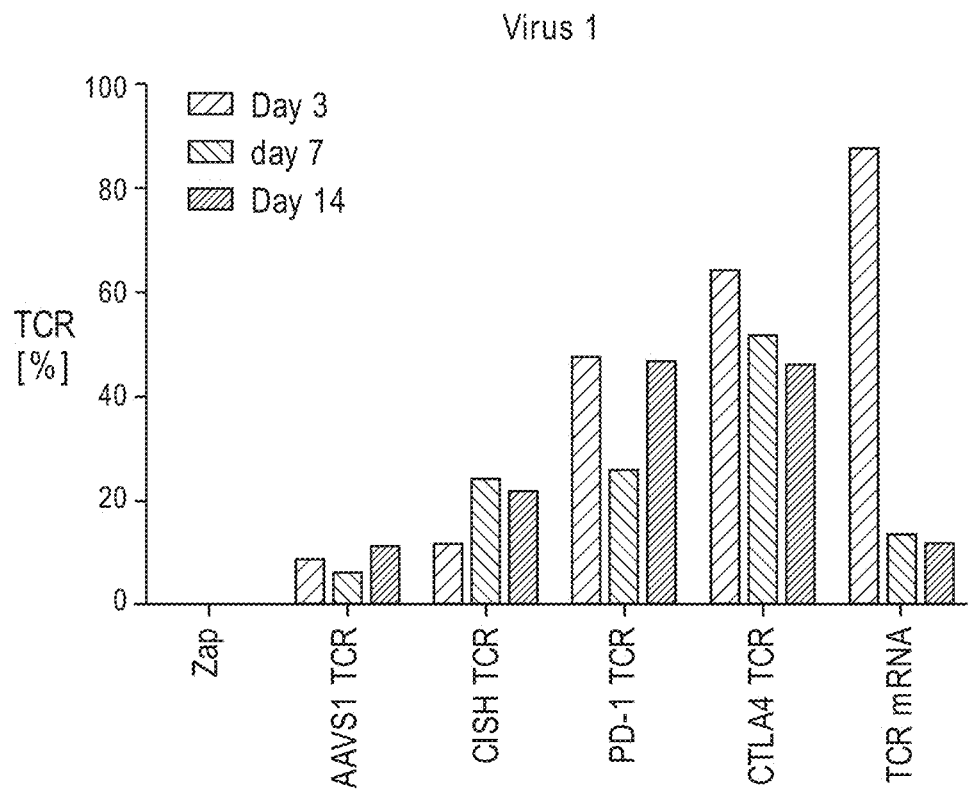
FIG. 3A shows a summary of percent receptor expression determined by flow cytometry of a sequential electroporation experiment. Primary human cells were electroporated with CRISPR gRNA at target gene sites and transduced with AAV V1 (WT).
Figure 3B:
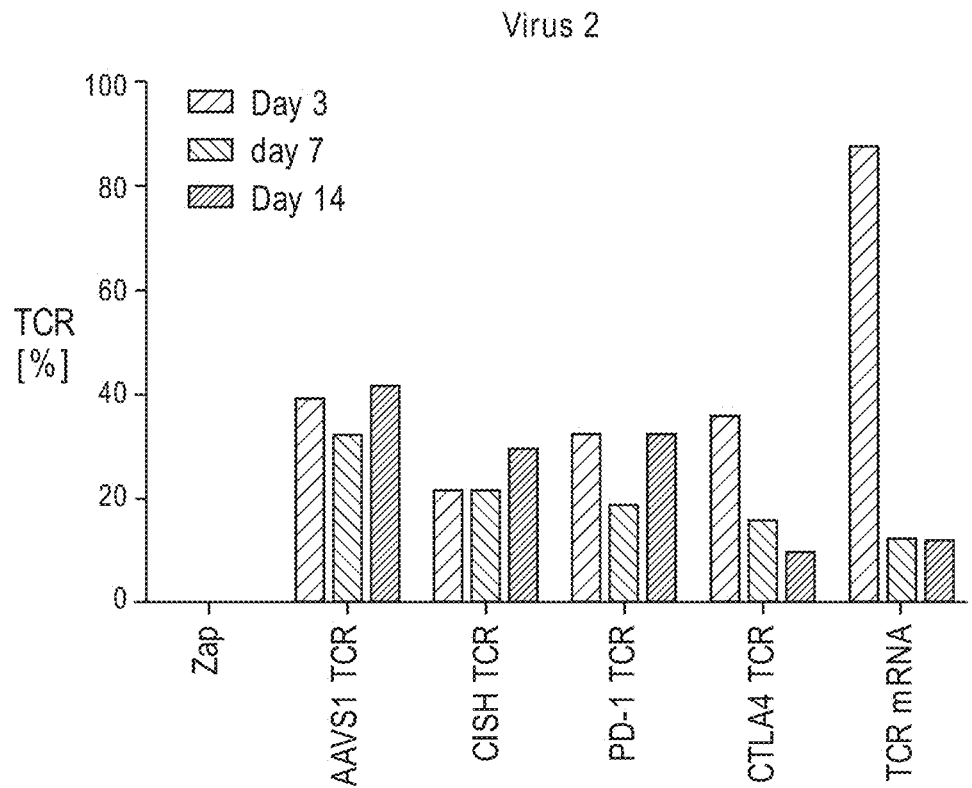
FIG. 3B shows a summary of percent receptor expression determined by flow cytometry of a sequential electroporation experiment. Human primary cells were electroporated with CRISPR gRNA to target gene sites and transduced with AAV V2 (F129L).
Figure 4:
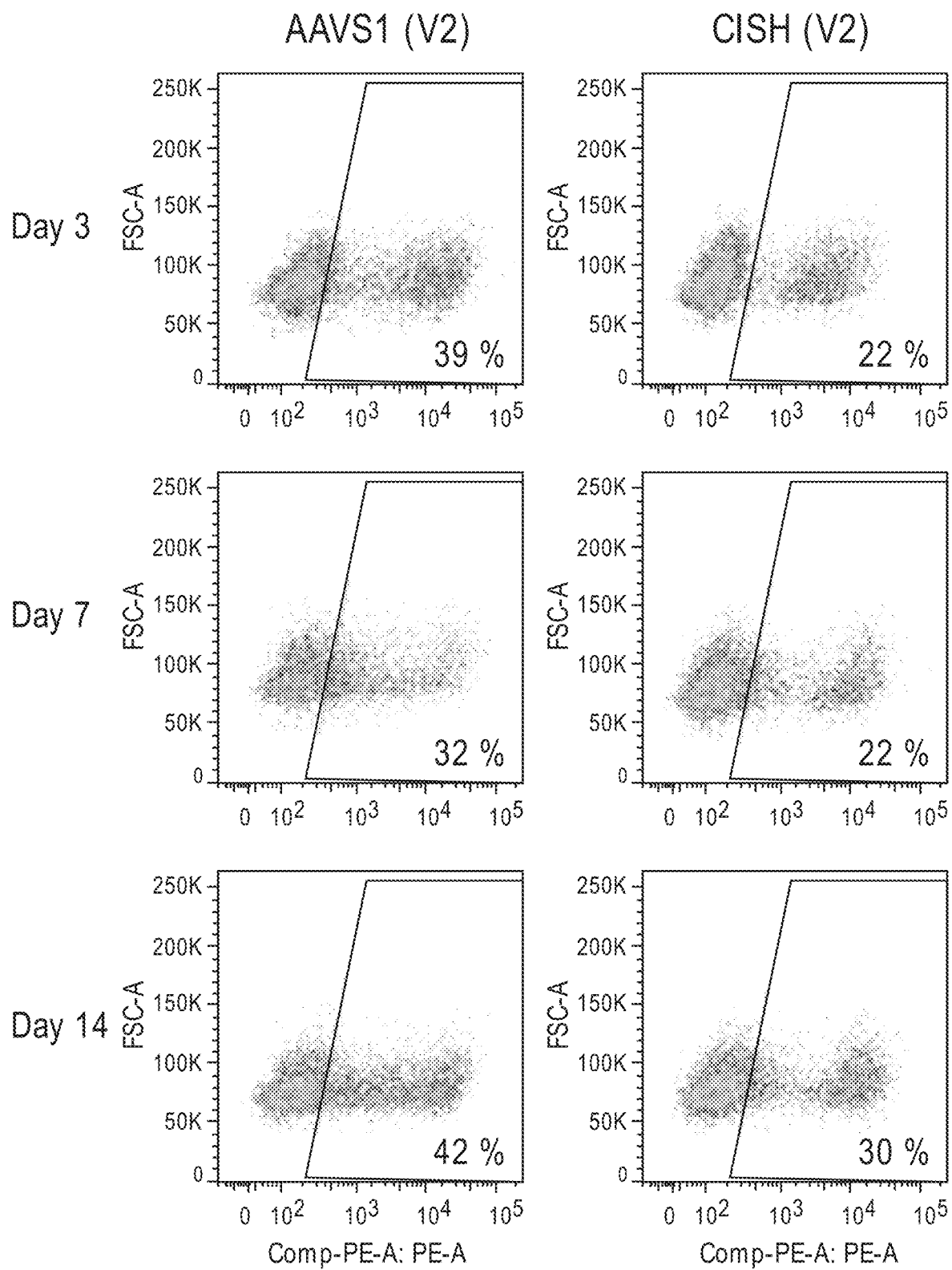
FIG. 4 shows percent TCR receptor expression on days 3, 7, and 14 post genomic modification with CRISPR and an AAV vector, V1 (WT) or V2 (F129L) encoding an exogenous TCR transgene.
Figure 4:
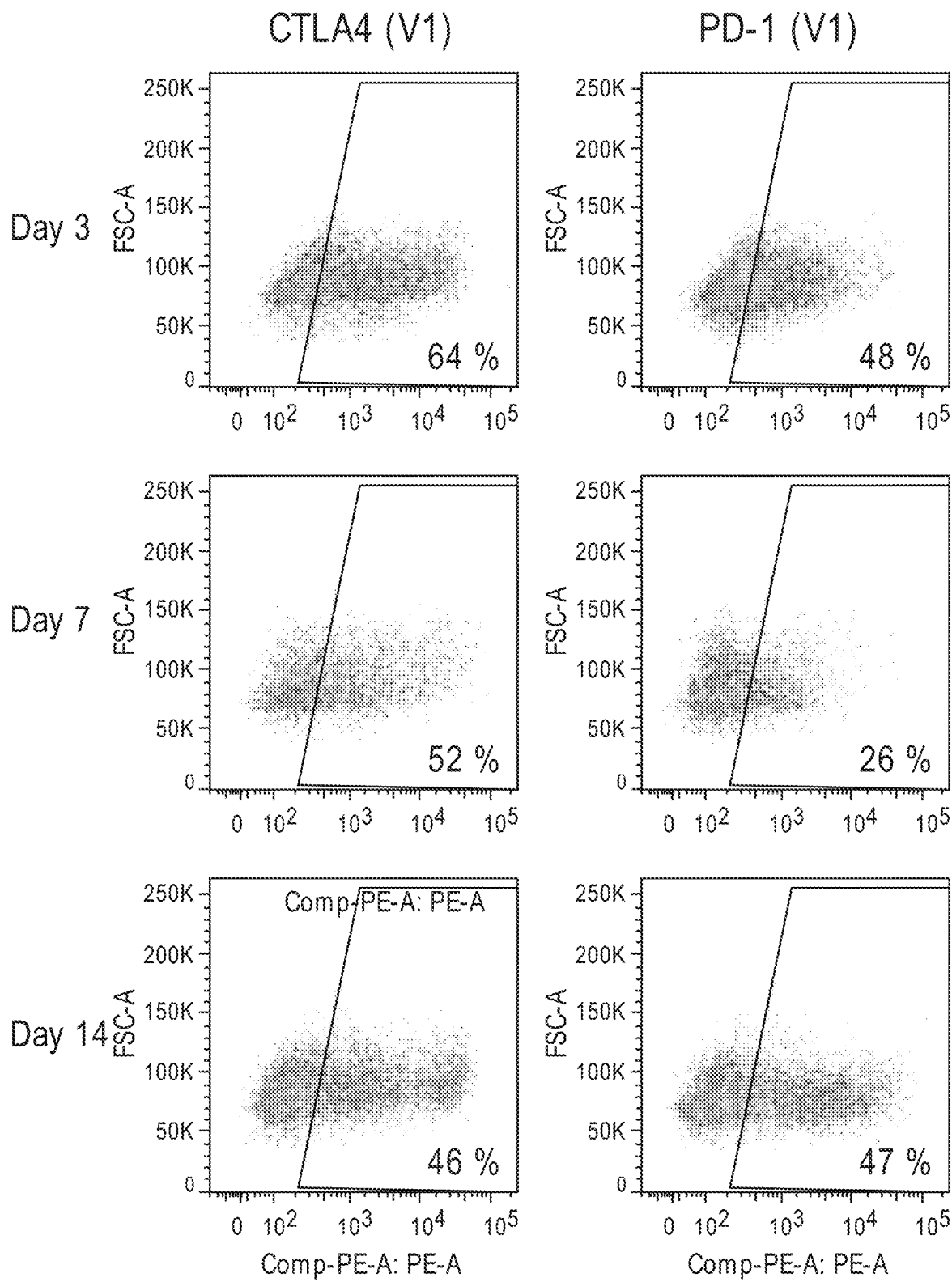

The following description and examples illustrate embodiments of the invention in detail. It is to be understood that this invention is not limited to the particular embodiments described herein and as such can vary. Those of skill in the art will recognize that there are numerous variations and modifications of this invention, which are encompassed within its scope.

Definitions

The terms "AAV," "AAV construct," or "recombinant AAV" or "AAV" refer to adeno-associated virus of any of the known serotypes, including AAV-1, AAV-2, AAV-3, AAV-4, AAV-5, AAV-6, AAV-7, AAV-8, AAV-9, AAV-10, AAV-11, or AAV-12, scAAV, rh10, chimeric or hybrid AAV, or any combination, derivative, or variant thereof. AAV is a small non-enveloped single-stranded DNA virus. They are non-pathogenic parvoviruses and can require helper viruses, such as adenovirus, herpes simplex virus, vaccinia virus, and CMV, for replication. Wild-type AAV is common in the general population, and is not associated with any known pathologies. A hybrid AAV is an AAV comprising a capsid protein of one AAV serotype and genomic material from another AAV serotype. A chimeric AAV comprises genetic and/or protein sequences derived from two or more AAV serotypes, and can include mutations made to the genetic sequences of those two or more AAV serotypes. An exemplary chimeric AAV can comprise a chimeric AAV capsid, for example, a capsid protein with one or more regions of amino acids derived from two or more AAV serotypes. An AAV variant is an AAV comprising one or more amino acid mutations in its genome or proteins as compared to its parental AAV, e.g., one or more amino acid mutations in its capsid protein as compared to its parental AAV. AAV, as used herein, includes avian AAV, bovine AAV, canine AAV, equine AAV, primate AAV, non-primate AAV, and ovine AAV, wherein primate AAV refers to AAV that infect non-primates, and wherein non-primate AAV refers to AAV that infect non-primate animals, such as avian AAV that infects avian animals. In some cases, the wild-type AAV contains rep and cap genes, wherein the rep gene is required for viral replication and the cap gene is required for the synthesis of capsid proteins. As used herein, the terms "recombinant AAV" and "rAAV" are interchangeable.

The terms "recombinant AAV vector" or "AAV vector" or "AAV vector" refer to a vector derived from any of the AAV serotypes mentioned above. In some cases, an AAV vector can comprise one or more of the AAV wild-type genes deleted in whole or part, such as the rep and/or cap genes, but contains functional elements that are required for packaging and use of AAV virus for gene therapy. For example, functional inverted terminal repeats or ITR sequences that flank an open reading frame or exogenous sequences cloned in are known to be important for replication and packaging of an AAV virion, but the ITR sequences can be modified from the wild-type nucleotide sequences, including insertions, deletions, or substitutions of nucleotides, so that the AAV is suitable for use for the embodiments described herein, such as a gene therapy or gene delivery system. In some aspects, a self-complementary vector (sc) can be used, such as a self-complementary AAV vector, which can bypass the requirement for viral second-strand DNA synthesis and can lead to higher rate of expression of a transgene protein, as described in Wu, Hum Gene Ther. 2007, 18(2):171-82, incorporated by reference herein. In some aspects, AAV vectors can be generated to allow selection of an optimal serotype, promoter, and transgene. In some cases, the vector can be targeted vector or a modified vector that selectively binds or infects immune cells.

The terms "AAV virion" or "AAV virion" refer to a virus particle comprising a capsid comprising at least one AAV capsid protein that encapsidates an AAV vector as described herein, wherein the vector can further comprise a heterologous polynucleotide sequence or a transgene in some embodiments.

The term "about" and its grammatical equivalents in relation to a reference numerical value and its grammatical equivalents as used herein can include a range of values plus or minus 10% from that value. For example, the amount "about 10" includes amounts from 9 to 11. The term "about" in relation to a reference numerical value can also include a range of values plus or minus 10%, 9%, 8%, 7%, 6%, 5%, 4%, 3%, 2%, or 1% from that value.

The term "activation" and its grammatical equivalents as used herein can refer to a process whereby a cell transitions from a resting state to an active state. This process can comprise a response to an antigen, migration, and/or a phenotypic or genetic change to a functionally active state. For example, the term "activation" can refer to the stepwise process of T cell activation. For example, a T cell can require at least two signals to become fully activated. The first signal can occur after engagement of a TCR by the antigen-MHC complex, and the second signal can occur by engagement of co-stimulatory molecules. Anti-CD3 can mimic the first signal and anti-CD28 can mimic the second signal in vitro.

The term "adjacent" and its grammatical equivalents as used herein can refer to right next to the object of reference. For example, the term adjacent in the context of a nucleotide sequence can mean without any nucleotides in between. For instance, polynucleotide A adjacent to polynucleotide B can mean AB without any nucleotides in between A and B.

The term "antigen" and its grammatical equivalents as used herein can refer to a molecule that contains one or more epitopes capable of being bound by one or more receptors. For example, an antigen can stimulate a host's immune system to make a cellular antigen-specific immune response when the antigen is presented, or a humoral antibody response. An antigen can also have the ability to elicit a cellular and/or humoral response by itself or when present in combination with another molecule. For example, a tumor cell antigen can be recognized by a TCR.

The term "epitope" and its grammatical equivalents as used herein can refer to a part of an antigen that can be recognized by antibodies, B cells, T cells or engineered cells. For example, an epitope can be a cancer epitope that is recognized by a TCR. Multiple epitopes within an antigen can also be recognized. The epitope can also be mutated.

The term "autologous" and its grammatical equivalents as used herein can refer to as originating from the same being. For example, a sample (e.g., cells) can be removed, processed, and given back to the same subject (e.g., subject) at a later time. An autologous process is distinguished from an allogenic process where the donor and the recipient are different subjects.

The term "barcoded to" refers to a relationship between molecules where a first molecule contains a barcode that can be used to identify a second molecule.

The term "cancer" and its grammatical equivalents as used herein can refer to a hyperproliferation of cells whose unique trait—loss of normal controls—results in unregulated growth, lack of differentiation, local tissue invasion, and metastasis. With respect to the inventive methods, the cancer can be any cancer, including any of acute lymphocytic cancer, acute myeloid leukemia, alveolar rhabdomyosarcoma, bladder cancer, bone cancer, brain cancer, breast cancer, cancer of the anus, anal canal, rectum, cancer of the eye, cancer of the intrahepatic bile duct, cancer of the joints, cancer of the neck, gallbladder, or pleura, cancer of the nose, nasal cavity, or middle ear, cancer of the oral cavity, cancer of the vulva, chronic lymphocytic leukemia, chronic myeloid cancer, colon cancer, esophageal cancer, cervical cancer, fibrosarcoma, gastrointestinal carcinoid tumor, Hodgkin lymphoma, hypopharynx cancer, kidney cancer, larynx cancer, leukemia, liquid tumors, liver cancer, lung cancer, lymphoma, malignant mesothelioma, mastocytoma, melanoma, multiple myeloma, nasopharynx cancer, non-Hodgkin lymphoma, ovarian cancer, pancreatic cancer, peritoneum, omentum, and mesentery cancer, pharynx cancer, prostate cancer, rectal cancer, renal cancer, skin cancer, small intestine cancer, soft tissue cancer, solid tumors, stomach cancer, testicular cancer, thyroid cancer, ureter cancer, and/or urinary bladder cancer. As used herein, the term "tumor" refers to an abnormal growth of cells or tissues, e.g., of malignant type or benign type.

The term "cancer neo-antigen" or "neo-antigen" or "neo-epitope" and its grammatical equivalents as used herein can refer to antigens that are not encoded in a normal, non-mutated host genome. A "neo-antigen" can in some instances represent either oncogenic viral proteins or abnormal proteins that arise as a consequence of somatic mutations. For example, a neo-antigen can arise by the disruption of cellular mechanisms through the activity of viral proteins. Another example can be an exposure of a carcinogenic compound, which in some cases can lead to a somatic mutation. This somatic mutation can ultimately lead to the formation of a tumor/cancer.

The term "cytotoxicity" as used in this specification, refers to an unintended or undesirable alteration in the normal state of a cell. The normal state of a cell can refer to a state that is manifested or exists prior to the cell's exposure to a cytotoxic composition, agent and/or condition. Generally, a cell that is in a normal state is one that is in homeostasis. An unintended or undesirable alteration in the normal state of a cell can be manifested in the form of, for example, cell death (e.g., programmed cell death), a decrease in replicative potential, a decrease in cellular integrity such as membrane integrity, a decrease in metabolic activity, a decrease in developmental capability, or any of the cytotoxic effects disclosed in the present application.

The phrase "reducing cytotoxicity" or "reduce cytotoxicity" refers to a reduction in degree or frequency of unintended or undesirable alterations in the normal state of a cell upon exposure to a cytotoxic composition, agent and/or condition. The phrase can refer to reducing the degree of cytotoxicity in an individual cell that is exposed to a cytotoxic composition, agent and/or condition, or to reducing the number of cells of a population that exhibit cytotoxicity when the population of cells is exposed to a cytotoxic composition, agent and/or condition.

The term "engineered" and its grammatical equivalents as used herein can refer to one or more alterations of a nucleic acid, e.g., the nucleic acid within an organism's genome. The term "engineered" can refer to alterations, additions, and/or deletion of genes. An engineered cell can also refer to a cell with an added, deleted and/or altered gene.

The term "cell" or "engineered cell" and their grammatical equivalents as used herein can refer to a cell of human or non-human animal origin.

The term "checkpoint gene" and its grammatical equivalents as used herein can refer to any gene that is involved in an inhibitory process (e.g., feedback loop) that acts to regulate the amplitude of an immune response, for example, an immune inhibitory feedback loop that mitigates uncontrolled propagation of harmful responses. These responses can include contributing to a molecular shield that protects against collateral tissue damage that might occur during immune responses to infections and/or maintenance of peripheral self-tolerance. Non-limiting examples of checkpoint genes can include members of the extended CD28 family of receptors and their ligands as well as genes involved in co-inhibitory pathways (e.g., CTLA-4 and PD-1). The term "checkpoint gene" can also refer to an immune checkpoint gene.

A "CRISPR," "CRISPR system system," or "CRISPR nuclease system" and their grammatical equivalents can include a non-coding RNA molecule (e.g., guide RNA) that binds to DNA and Cas proteins (e.g., Cas9) with nuclease functionality (e.g., two nuclease domains). See, e.g., Sander, J. D., et al., "CRISPR-Cas systems for editing, regulating and targeting genomes," Nature Biotechnology, 32:347-355 (2014); see also e.g., Hsu, P. D., et al., "Development and applications of CRISPR-Cas9 for genome engineering," Cell 157(6):1262-1278 (2014).

The term "disrupting" and its grammatical equivalents as used herein can refer to a process of altering a gene, e.g., by deletion, insertion, mutation, rearrangement, or any combination thereof. For example, a gene can be disrupted by knockout. Disrupting a gene can be partially reducing or completely suppressing expression of the gene. Disrupting a gene can also cause activation of a different gene, for example, a downstream gene.

The term "engineered" and its grammatical equivalents as used herein can refer to one or more alterations of a nucleic acid, e.g., the nucleic acid within an organism's genome. The term "engineered" can refer to alterations, additions, and/or deletion of genes. An engineered cell can also refer to a cell with an added, deleted and/or altered gene.

The term "function" and its grammatical equivalents as used herein can refer to the capability of operating, having, or serving an intended purpose. Functional can comprise any percent from baseline to 100% of normal function. For example, functional can comprise or comprise about 5, 10, 15, 20, 25, 30, 35, 40, 45, 50, 55, 60, 65, 70, 75, 80, 85, 90, 95, and/or 100% of normal function. In some cases, the term functional can mean over or over about 100% of normal function, for example, 125, 150, 175, 200, 250, 300% and/or above normal function.

The term "gene editing" and its grammatical equivalents as used herein can refer to genetic engineering in which one or more nucleotides are inserted, replaced, or removed from a genome. Gene editing can be performed using a nuclease (e.g., a natural-existing nuclease or an artificially engineered nuclease).

The term "good manufacturing practices" (GMP) and its grammatical equivalents as used herein can refer to products that are safe, effective, or pure according to the FDA. GMP can also sometimes be referred to as "cGMP". The "c" stands for "current." Manufacturers of a product can employ technologies and systems which are up-to-date in order to comply with regulation of GMP products. GMP compatible products are typically utilized in the clinical setting as opposed to the research setting.

The term "mutation" and its grammatical equivalents as used herein can include the substitution, deletion, and insertion of one or more nucleotides in a polynucleotide. For example, up to 1, 2, 3, 4, 5, 6, 7, 8, 9, 10, 11, 12, 13, 14, 15, 20, 25, 30, 40, 50, or more nucleotides/amino acids in a polynucleotide (cDNA, gene) or a polypeptide sequence can be substituted, deleted, and/or inserted. A mutation can affect the coding sequence of a gene or its regulatory sequence. A mutation can also affect the structure of the genomic sequence or the structure/stability of the encoded mRNA. A mutation in a nucleic acid can encode a mutation that increases or decreases the hydrophilicity of the amino acid encoded at the position being mutated. A mutation in a nucleic acid can encode a mutation that increases or decreases the hydrophobicity of the amino acid encoded at the position being mutated. A mutation in a nucleic acid can encode an amino acid selected from: nonpolar aliphatic amino acids (e.g., G, A, V, L, I, M), aromatic amino acids (e.g., F, Y, W), positively charged amino acids (e.g., K, R, H), negatively charged amino acids (e.g., D, E), and polar amino acids (e.g., S, T, C, P, N, Q). A mutation in a nucleic acid can alter the encoded amino acid within one of the above groups (e.g., a V to I mutation) or between groups (e.g., an F to L mutation). In some embodiments, a mutation can encode an aromatic amino acid to nonpolar aliphatic amino acid change. In some embodiments, a mutation can encode a positively charged amino acid to polar amino acid change. In some embodiments, a mutation can encode a change from a nonpolar aliphatic amino acid to another nonpolar amino acid. In some embodiments, a mutation can encode a nonpolar aliphatic amino acid to negatively charged amino acid change. In some embodiments, a mutation can encode a nonpolar aliphatic amino acid to positively charged amino acid change.

The term "non-human animal" and its grammatical equivalents as used herein can include all animal species other than humans, including non-human mammals, which can be a native animal or a genetically modified non-human animal. The terms "nucleic acid," "polynucleotide," "polynucleic acid," and "oligonucleotide" and their grammatical equivalents can be used interchangeably and can refer to a deoxyribonucleotide or ribonucleotide polymer, in linear or circular conformation, and in either single- or double-stranded form. For the purposes of the present disclosure, these terms should not to be construed as limiting with respect to length. The terms can also encompass analogues of natural nucleotides, as well as nucleotides that are modified in the base, sugar and/or phosphate moieties (e.g., phosphorothioate backbones). Modifications of the terms can also encompass demethylation, addition of CpG methylation, removal of bacterial methylation, and/or addition of mammalian methylation. In general, an analogue of a particular nucleotide can have the same base-pairing specificity, i.e., an analogue of A can base-pair with T.

The term "percent (%) identity" can be readily determined for amino acid sequences, over the full-length of a protein, or a fragment thereof. Suitably, a fragment is at least about 8 amino acids in length, and can be up to about 700 amino acids. Generally, when referring to "identity", "homology", or "similarity" between two different adeno-associated viruses, "identity", "homology" or "similarity" is determined in reference to "aligned" sequences. "Aligned" sequences or "alignments" refer to multiple nucleic acid sequences or protein (amino acids) sequences, often containing corrections for missing or additional bases or amino acids as compared to a reference sequence.

The term "peripheral blood lymphocytes" (PBL) and its grammatical equivalents as used herein can refer to lymphocytes that circulate in the blood (e.g., peripheral blood). Peripheral blood lymphocytes can refer to lymphocytes that are not localized to organs. Peripheral blood lymphocytes can comprise T cells, NK cells, B cell, or any combinations thereof.

The term "phenotype" and its grammatical equivalents as used herein can refer to a composite of an organism's observable characteristics or traits, such as its morphology, development, biochemical or physiological properties, phenology, behavior, and products of behavior. Depending on the context, the term "phenotype" can sometimes refer to a composite of a population's observable characteristics or traits.

The term "protospacer" and its grammatical equivalents as used herein can refer to a PAM-adjacent nucleic acid sequence capable to hybridizing to a portion of a guide RNA, such as the spacer sequence or engineered targeting portion of the guide RNA. A protospacer can be a nucleotide sequence within gene, genome, or chromosome that is targeted by a guide RNA. In the native state, a protospacer is adjacent to a PAM (protospacer adjacent motif). The site of cleavage by an RNA-guided nuclease is within a protospacer sequence. For example, when a guide RNA targets a specific protospacer, the Cas protein will generate a double strand break within the protospacer sequence, thereby cleaving the protospacer. Following cleavage, disruption of the protospacer can result though non-homologous end joining (NHEJ) or homology-directed repair (HDR). Disruption of the protospacer can result in the deletion of the protospacer. Additionally or alternatively, disruption of the protospacer can result in an exogenous nucleic acid sequence being inserted into or replacing the protospacer.

The term "recipient" and their grammatical equivalents as used herein can refer to a human or non-human animal. The recipient can also be in need thereof.

The term "recombination" and its grammatical equivalents as used herein can refer to a process of exchange of genetic information between two polynucleic acids. For the purposes of this disclosure, "homologous recombination" or "HR" can refer to a specialized form of such genetic exchange that can take place, for example, during repair of double-strand breaks. This process can require nucleotide sequence homology, for example, using a donor molecule to template repair of a target molecule (e.g., a molecule that experienced the double-strand break), and is sometimes known as non-crossover gene conversion or short tract gene conversion. Such transfer can also involve mismatch correction of heteroduplex DNA that forms between the broken target and the donor, and/or synthesis-dependent strand annealing, in which the donor can be used to resynthesize genetic information that can become part of the target, and/or related processes. Such specialized HR can often result in an alteration of the sequence of the target molecule such that part or all of the sequence of the donor polynucleotide can be incorporated into the target polynucleotide. In some cases, the terms "recombination arms" and "homology arms" can be used interchangeably.

The terms "target vector" and "targeting vector" are used interchangeably herein.

The term "transgene" and its grammatical equivalents as used herein can refer to a gene or genetic material that is transferred into an organism. For example, a transgene can be a stretch or segment of DNA containing a gene that is introduced into an organism. When a transgene is transferred into an organism, the organism is then referred to as a transgenic organism. A transgene can retain its ability to produce RNA or polypeptides (e.g., proteins) in a transgenic organism. A transgene can be composed of different nucleic acids, for example RNA or DNA. A transgene can encode for an engineered T cell receptor, for example a TCR transgene. A transgene can be a TCR sequence. A transgene can be a receptor. A transgene can comprise recombination arms. A transgene can comprise engineered sites.

The term "T cell" and its grammatical equivalents as used herein can refer to a T cell from any origin. For example, a T cell can be a primary T cell, e.g., an autologous T cell, a cell line, etc. The T cell can also be human or non-human.

The term "TIL" or tumor infiltrating lymphocyte and its grammatical equivalents as used herein can refer to a cell isolated from a tumor. For example, a TIL can be a cell that has migrated to a tumor. A TIL can also be a cell that has infiltrated a tumor. A TIL can be any cell found within a tumor. For example, a TIL can be a T cell, B cell, monocyte, natural killer cell, or any combination thereof. A TIL can be a mixed population of cells. A population of TILs can comprise cells of different phenotypes, cells of different degrees of differentiation, cells of different lineages, or any combination thereof.

A "therapeutic effect" can occur if there is a change in the condition being treated. The change can be positive or negative. For example, a 'positive effect' can correspond to an increase in the number of activated T-cells in a subject. In another example, a 'negative effect' can correspond to a decrease in the amount or size of a tumor in a subject. There is a "change" in the condition being treated if there is at least 10% improvement, preferably at least 25%, more preferably at least 50%, even more preferably at least 75%, and most preferably 100%. The change can be based on improvements in the severity of the treated condition in an individual, or on a difference in the frequency of improved conditions in populations of individuals with and without treatment with the therapeutic compositions with which the compositions of the present invention are administered in combination. Similarly, a method of the present disclosure can comprise administering to a subject an amount of cells that is "therapeutically effective". The term "therapeutically effective" should be understood to have a definition corresponding to 'having a therapeutic effect'.

The term "safe harbor" and "immune safe harbor", and their grammatical equivalents as used herein can refer to a location within a genome that can be used for integrating exogenous nucleic acids wherein the integration does not cause any significant effect on the growth of the host cell by the addition of the nucleic acid alone. Non-limiting examples of safe harbors can include HPRT, AAVS SITE (e.g. AAVS1, AAVS2, ETC.), CCR5, or Rosa26. For example, the human parvovirus, AAV, is known to integrate preferentially into human chromosome 19 q13.3-qter, or the AAVS1 locus. Integration of a gene of interest at the AAVS1 locus can support stable expression of a transgene in various cell types. In some cases, a nuclease can be engineered to target generation of a double strand break at the AAVS1 locus to allow for integration of a transgene at the AAVS1 locus or to facilitate homologous recombination at the AAVS1 locus for integrating an exogenous nucleic acid sequence at the AAVS1 site, such as a transgene, a cell receptor, or any gene of interest as disclosed herein. In some cases, an AAV viral vector is used to deliver a transgene for integration at the AAVS1 site with or without an exogenous nuclease. A viral vector that targets AAVS1 can be for example FIG. 25A or FIG. 25B.

The term "sequence" and its grammatical equivalents as used herein can refer to a nucleotide sequence, which can be DNA or RNA; can be linear, circular or branched; and can be either single-stranded or double stranded. A sequence can be mutated. A sequence can be of any length, for example, between 2 and 1,000,000 or more nucleotides in length (or any integer value there between or there above), e.g., between about 100 and about 10,000 nucleotides or between about 200 and about 500 nucleotides.

The term "viral vector" refers to a gene transfer vector or a gene delivery system derived from a virus. Such vector can be constructed using recombinant techniques known in the art. In some aspects, the virus for deriving such vector is selected from adeno-associated virus (AAV), helper-dependent adenovirus, hybrid adenovirus, Epstein-Bar virus, retrovirus, lentivirus, herpes simplex virus, hemmaglutinating virus of Japan (HVJ), Moloney murine leukemia virus, poxvirus, and HIV-based virus.

Overview

Disclosed herein are modified adeno-associated viral vector compositions and methods useful for performing an intracellular genomic transplant. An intracellular genomic transplant can comprise genetically modifying cells and nucleic acids for therapeutic applications utilizing modified adeno-associated viral vectors. The compositions and methods described throughout can use a mutated or chimeric adeno-associated viral vector for delivering an exogenous cellular receptor in a way that improves physiologic and immunologic potency of an engineered cell. Modified adeno-associated viral vectors can be useful to treat various indications, including for instance cancer (e.g., metastatic cancer) subjects. For example, autologous peripheral blood lymphocytes (PBL) can be modified using adeno-associated viral methods to express exogenous cellular receptors that recognize unique mutations, neo-antigens, on cancer cells and can be used in the disclosed compositions and methods of an intracellular genomic transplant. In some cases, adeno-associated vector-modified cells can also comprise a genomic disruption of at least one gene or portion thereof. These compositions utilizing mutated and chimeric adeno-associated viral vectors and methods utilizing said AAV vectors for intracellular genomic transplant can provide a cancer therapy with many advantages. For example, they can provide high efficiency gene transfer, expression, increased cell survival rates, an efficient introduction of recombinogenic double strand breaks, and a process that favors the Homology Directed Repair (HDR) over Non-Homologous End Joining (NHEJ) mechanism, and efficient recovery and expansion of homologous recombinants.

Intracellular genomic transplant can be a method of genetically modifying cells and nucleic acids for therapeutic applications. The compositions and methods described throughout can use mutated and chimeric adeno-associated viral vectors to improve upon existing viral delivery mechanisms. Effective adoptive cell transfer-based immunotherapies (ACT) can be useful to treat various indications including for instance cancer (e.g., metastatic cancer) subjects. For example, autologous peripheral blood lymphocytes (PBL) can be modified using modified adeno-associated viral vectors with mutations in at least a portion of a capsid protein or adeno-associated viral vectors with capsid proteins from at least two different serologies. Engineered adeno-associated viral vectors can include mutations in a capsid protein such as any of VP1, VP2, and VP3. In direct contrast to the current literature, the disclosed modified adeno-associated viral vectors improve upon comparable vectors by enhancing rates of transgene expression in transduced cells. Modified adeno-associated viral vectors, as described herein, provide a novel avenue for delivering a payload to a primary cell with an increased degree of transduction efficiency and transgene expression. Modified adeno-associated viral vectors can be combined with various systems of genomic modification, such as CRISPR, to provide engineered cells with at least one genomic disruption and high rates of transgene expression, such as a cellular receptor, for immunotherapy of various conditions, such as cancer.

In some cases, a first step of modifying a primary cell with a modified adeno-associated viral vector can include stimulation of primary cells by contacting primary cells with at least one stimulatory agent. For example, to stimulate proliferation of either CD4 T cells or CD8 T cells, an anti-CD3 antibody and an anti-CD28 antibody can be used. For example, the agents providing a signal can be in solution or coupled to a surface. The ratio of particles to cells can depend on particle size relative to the target cell. In further embodiments, the cells, such as T cells, can be combined with agent-coated beads, where the beads and the cells can be subsequently separated, and optionally cultured. Each bead can be coated with either anti-CD3 antibody or an anti-CD28 antibody, or in some cases, a combination of the two. In an alternative embodiment, prior to culture, the agent-coated beads and cells are not separated but are cultured together. Cell surface proteins can be ligated by allowing paramagnetic beads to which anti-CD3 and anti-CD28 can be attached (3×28 beads) to contact the T cells. In one embodiment the cells and beads (for example, DYNABEADS® M-450 CD3/CD28 T paramagnetic beads at a ratio of 1:1) are combined in a buffer, for example, phosphate buffered saline (PBS) (e.g., without divalent cations such as, calcium and magnesium). Any cell concentration can be used. The mixture can be cultured for or for about several hours (e.g., about 3 hours) to or to about 14 days or any hourly integer value in between. In another embodiment, the mixture can be cultured for or for about 21 days or for up to or for up to about 21 days. Conditions appropriate for T cell culture can include an appropriate media (e.g., Minimal Essential Media or RPMI Media 1640 or, X-vivo 5, (Lonza)) that can contain factors necessary for proliferation and viability, including serum (e.g., fetal bovine or human serum), interleukin-2 (IL-2), insulin, IFN-g, IL-4, IL-7, GM-CSF, IL-10, IL-21, IL-15, TGF beta, and TNF alpha or any other additives for the growth of cells. Other additives for the growth of cells include, but are not limited to, surfactant, plasmanate, and reducing agents such as N-acetyl-cysteine and 2-mercaptoethanol. Media can include RPMI 1640, A1 M-V, DMEM, MEM, α-MEM, F-12, X-Vivo 1, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, can be included only in experimental cultures, possibly not in cultures of cells that are to be infused into a subject. The target cells can be maintained under conditions necessary to support growth; for example, an appropriate temperature (e.g., 37° C.) and atmosphere (e.g., air plus 5% $CO_2$). In some instances, T cells that have been exposed to varied stimulation times can exhibit different characteristics. In some cases, a soluble monospecific tetrameric antibody against human CD3, CD28, CD2, or any combination thereof can be used.

In some cases, cells to undergo genomic transplant can be activated or expanded by co-culturing with tissue or cells. A cell can be an antigen presenting cell. An artificial antigen presenting cells (aAPCs) can express ligands for T cell receptor and costimulatory molecules and can activate and expand T cells for transfer, while improving their potency and function in some cases. An aAPC can be engineered to express any gene for T cell activation. An aAPC can be engineered to express any gene for T cell expansion. An aAPC can be a bead, a cell, a protein, an antibody, a cytokine, or any combination. An aAPC can deliver signals to a cell population that can undergo genomic transplant. For example, an aAPC can deliver a signal 1, signal, 2, signal 3 or any combination. A signal 1 can be an antigen recognition signal. For example, signal 1 can be ligation of a TCR by a peptide-MHC complex or binding of agonistic antibodies directed towards CD3 that can lead to activation of the CD3 signal-transduction complex. Signal 2 can be a co-stimulatory signal. For example, a co-stimulatory signal can be anti-CD28, inducible co-stimulator (ICOS), CD27, and 4-1BB (CD137), which bind to ICOS-L, CD70, and 4-1BBL, respectively. Signal 3 can be a cytokine signal. A cytokine can be any cytokine. A cytokine can be IL-2, IL-7, IL-12, IL-15, IL-21, or any combination thereof. In some cases, IL-2, IL-7, and IL-15 are used to culture cells of the invention.

In some cases an artificial antigen presenting cell (aAPC) can be used to activate and/or expand a cell population. In some cases, an aAPC does not induce allospecificity. In some cases, an aAPC does not express HLA. An aAPC can be genetically modified to stably express genes that can be used in activation and/or stimulation. In some cases, a K562 cell can be used for activation. A K562 cell can also be used for expansion. A K562 cell can be a human erythroleukemic cell line. A K562 cell can be engineered to express genes of interest. In some cases, K562 cells do not endogenously express HLA class I, II, or CD1d molecules but can express ICAM-1 (CD54) and LFA-3 (CD58). K562 can be engineered to deliver a signal 1 to T cells. For example, K562 cells can be engineered to express HLA class I. In some cases, K562 cells can be engineered to express additional molecules such as B7, CD80, CD83, CD86, CD32, CD64, 4-1BBL, anti-CD3, anti-CD3 mAb, anti-CD28, anti-CD28mAb, CD1d, anti-CD2, membrane-bound IL-15, membrane-bound IL-17, membrane-bound IL-21, membrane-bound IL-2, truncated CD19, or any combination. In some cases, an engineered K562 cell can expresses a membranous form of anti-CD3 mAb, clone OKT3, in addition to CD80 and CD83. In some cases, an engineered K562 cell can expresses a membranous form of anti-CD3 mAb, clone OKT3, membranous form of anti-CD28 mAb in addition to CD80 and CD83.

An aAPC can be a bead. A spherical polystyrene bead can be coated with antibodies against CD3 and CD28 and be used for T cell activation. A bead can be of any size. In some cases, a bead can be or can be about 3 and 6 micrometers. A bead can be or can be about 4.5 micrometers in size. A bead can be utilized at any cell to bead ratio. For example, a 3 to 1 bead to cell ratio at 1 million cells per milliliter can be used. An aAPC can also be a rigid spherical particle, a polystyrene latex microbeads, a magnetic nano- or microparticles, a nanosized quantum dot, a 4, poly(lactic-co-glycolic acid) (PLGA) microsphere, a nonspherical particle, a 5, carbon nanotube bundle, a 6, ellipsoid PLGA micropar-ticle, a 7, nanoworms, a fluidic lipid bilayer-containing system, an 8, 2D-supported lipid bilayer (2D-SLBs), a 9, liposome, a 10, RAFTsomes/microdomain liposome, an 11, SLB particle, or any combination thereof.

In some cases, an aAPC can expand CD4 T cells. For example, an aAPC can be engineered to mimic an antigen processing and presentation pathway of HLA class II-restricted CD4 T cells. A K562 can be engineered to express HLA-D, DP α, DP β chains, Ii, DM α, DM β, CD80, CD83, or any combination thereof. For example, engineered K562 cells can be pulsed with an HLA-restricted peptide in order to expand HLA-restricted antigen-specific CD4 T cells.

In some cases, the use of aAPCs can be combined with exogenously introduced cytokines for T cell activation, expansion, or any combination. Cells can also be expanded in vivo, for example in the subject's blood after administration of genomically transplanted cells into a subject.

In some aspects, the methods disclosed herein comprise introducing into a cell one or more nucleic acids (e.g., a first nucleic acid or a second acid). A person of skill in the art will appreciate that a nucleic acid can generally refer to a substance whose molecules consist of many nucleotides linked in a long chain Non-limiting examples of the nucleic acid include an artificial nucleic acid analog (e.g., a peptide nucleic acid, a morpholino oligomer, a locked nucleic acid, a glycol nucleic acid, or a threose nucleic acid), a circular nucleic acid, a DNA, a single stranded DNA, a double stranded DNA, a genomic DNA, a mini-circle DNA, a plasmid, a plasmid DNA, a viral DNA, a viral vector, a gamma-retroviral vector, a lentiviral vector, an adeno-associated viral vector, an RNA, short hairpin RNA, psiRNA and/or a hybrid or combination thereof. In some embodiments, a method can comprise a nucleic acid, and the nucleic acid is synthetic. In some embodiments, a sample can comprise a nucleic acid, and the nucleic acid can be fragmented. In some cases, a nucleic acid is a minicircle. A nucleic acid can encode for a transgene such as an exogenous TCR. An exogenous TCR can bind a cancer cell. Specific epitopes that can be bound by an exogenous TCR can be immunogenic epitopes encoded by mutations in a subject's cancer, for instance as described in WO2016053338. For example, a cancer-specific TCR transgene can be inserted into the genome of a cell (e.g., T cell) using random or specific insertions. In some cases, an insertion can be a viral insertion. In some cases, a viral insertion of a transgene can be targeted to a particular genomic site or in other cases a viral insertion of a transgene can be a random insertion into a genomic site.

In some cases, a nucleic acid can readily bind to another nucleic acid (e.g., the nucleic acid comprises a sticky end or nucleotide overhang). For example, the nucleic acid can comprise an overhang at a first end of the nucleic acid. Generally, a sticky end or overhang can refer to a series of unpaired nucleotides at the end of a nucleic acid. In some cases, the nucleic acid can comprise a single stranded overhang at one or more ends of the nucleic acid. In some cases, the overhang can occur on the 3' end of the nucleic acid. In some cases, the overhang can occur on the 5' end of the nucleic acid. The overhang can comprise any number of nucleotides. For example, the overhang can comprise 1 nucleotide, 2 nucleotides, 3 nucleotides, 4 nucleotides, or 5 or more nucleotides. In some cases, the nucleic acid can require modification prior to binding to another nucleic acid (e.g., the nucleic acid can need to be digested with an endonuclease). In some cases, modification of the nucleic acid can generate a nucleotide overhang, and the overhang can comprise any number of nucleotides. For example, the overhang can comprise 1 nucleotide, 2 nucleotides, 3 nucleotides, 4 nucleotides, or 5 or more nucleotides. In one example, the nucleic acid can comprise a restriction site, wherein digesting the nucleic acid at the restriction site with a restriction enzyme (e.g., NotI) produces a 4 nucleotide overhang. In some cases, the modifying comprises generating a blunt end at one or more ends of the nucleic acid. Generally, a blunt end can refer to a double stranded nucleic acid wherein both strands terminate in a base pair. In one example, the nucleic acid can comprise a restriction site, wherein digesting the nucleic acid at the restriction site with a restriction enzyme (e.g., BsaI) produces a blunt end.

Promoters are sequences of nucleic acid that control the binding of RNA polymerase and transcription factors, and can have a major effect on the efficiency of gene transcription, where a gene can be expressed in the cell, and/or what cell types a gene can be expressed in. Non limiting examples of promoters include a cytomegalovirus (CMV) promoter, an elongation factor 1 alpha (EF1α) promoter, a simian vacuolating virus (SV40) promoter, a phosphoglycerate kinase (PGK1) promoter, a ubiquitin C (Ubc) promoter, a human beta actin promoter, a CAG promoter, a Tetracycline response element (TRE) promoter, a UAS promoter, an Actin 5c (Ac5) promoter, a polyhedron promoter, Ca2+/calmodulin-dependent protein kinase II (CaMKIIa) promoter, a GAL1 promoter, a GAL 10 promoter, a TEF1 promoter, a glyceraldehyde 3-phosphage dehydrogenase (GDS) promoter, an ADH1 promoter, a CaMV35S promoter, a Ubi promoter, a human polymerase III RNA (H1) promoter, a U6 promoter, or a combination thereof.

A promoter can be cytomegalovirus (CMV), U6, myeloproliferative sarcoma virus enhancer, negative control region deleted, d1587rev primer-binding site substituted (MND), or EF1a. In some cases, a promoter can be adjacent to an exogenous TCR sequence. In some cases, an AAV vector can further comprises a splicing acceptor. In some cases, the splicing acceptor can be adjacent to the exogenous TCR sequence. A promoter sequence can be a PKG or an MND promoter. An MND promoter can be a synthetic promoter that contains a U3 region of a modified MoMuLV LTR with a myeloproliferative sarcoma virus enhancer.

Modified Adeno-Associated Viral Vectors

In some cases, a viral vector can be utilized to introduce a transgene into a cell. A viral vector can be, without limitation, a lentivirus, a retrovirus, or an adeno-associated virus. A viral vector can be an adeno-associated viral vector. In some cases, an adeno-associated virus can be used to introduce an exogenous transgene, such as a cellular receptor. A viral vector can be isogenic in some cases. In some embodiments, a viral vector can be integrated into a portion of a genome with known SNPs in some cases. In some embodiments, an adeno-associated viral vector is not be integrated into a portion of a genome with known SNPs. For example, an AAV can be designed to be isogenic or homologous to a subjects own genomic DNA. In some cases, an isogenic vector can improve efficiency of homologous recombination. In some cases, a gRNA can be designed so that it does not target a region with known SNPs to improve the expression of an integrated vector transgene. The frequency of SNPs at checkpoint genes, such as PD-1, CISH, AAVS1, and CTLA-4, can be determined. In some cases, the frequency of SNPs at an endogenous TCR gene can be determined. An adeno-associated virus (AAV) can be a non-pathogenic single-stranded DNA parvovirus. An AAV can have a capsid diameter of about 26 nm. A capsid diameter can also be from about 20 nm to about 50 nm in some cases. Each end of the AAV single-stranded DNA genome can contain an inverted terminal repeat (ITR), which can be the only cis-acting element required for genome replication and packaging. An ITR can be from any AAV serotype. For example, an ITR can be from AAV1, AAV2, AAV3, AAV4, AAV5, AAV6, AAV7, AAV8, AAV9, AAV10, AAV11, or AAV12. In some cases, an ITR is from AAV2. The genome carries two viral genes: rep and cap. The virus utilizes two promoters and alternative splicing to generate four proteins necessary for replication (Rep78, Rep 68, Rep 52 and Rep 40), while a third promoter generates the transcript for three structural viral capsid proteins, 1, 2 and 3 (VP1, VP2 and VP3), through a combination of alternate splicing and alternate translation start codons. As used herein, VP1u is the unique sequence of VP1 (i.e. the sequence that does not overlap with VP2 and/or VP3). The three capsid proteins share the same C-terminal 533 amino acids, while VP2 and VP1 contain additional N-terminal sequences of 65 and 202 amino acids, respectively. The AAV virion can contain a total of 60 copies of VP1, VP2, and VP3 at a 1:1:20 ratio, arranged in a T=1 icosahedral symmetry. In some cases, a REP protein (for example, Rep78, Rep 68, Rep 52 or Rep 40) or a capsid protein can be modified and utilized in the disclosed compositions and methods. In some cases, the capsid is comprised of three VPs: VP1, VP2, and VP3. VP1 contains the entire VP2 sequence in addition to a unique 137-amino-acid N-terminal region (VP1u), while the VP2 protein contains the entire VP3 sequence in addition to an 65-amino-acid N-terminal region (VP1/2 common region). In some embodiments, an AAV provided herein comprises an assembly-activating protein (AAP). In certain embodiments, the AAP promotes capsid assembly. In some cases, an AAV can comprise a AAP polypeptide modified to enhance AAV capsid structure and function, for example by improving capsid assembly.

For example, in some embodiments a modified REP protein or capsid protein can provide improved packaging efficiency, yield, infectivity, transduction efficiency, or transfection efficiency.

At the cellular level, AAV can undergo 5 steps prior to achieving gene expression: 1) binding or attachment to cellular surface receptors, 2) endocytosis, 3) trafficking to the nucleus, 4) uncoating of the virus to release the genome and 5) conversion of the genome from single-stranded to double-stranded DNA as a template for transcription in the nucleus. The cumulative efficiency with which AAV can successfully execute each individual step can determine the overall transduction efficiency. Rate limiting steps in AAV transduction can include the absence or low abundance of required cellular surface receptors for viral attachment and internalization, inefficient endosomal escape leading to lysosomal degradation, and slow conversion of single-stranded to double-stranded DNA template. Therefore, vectors with modifications to the genome and/or the capsids can be designed to facilitate more efficient or more specific transduction or cells or tissues for gene therapy.

Figure 26A:
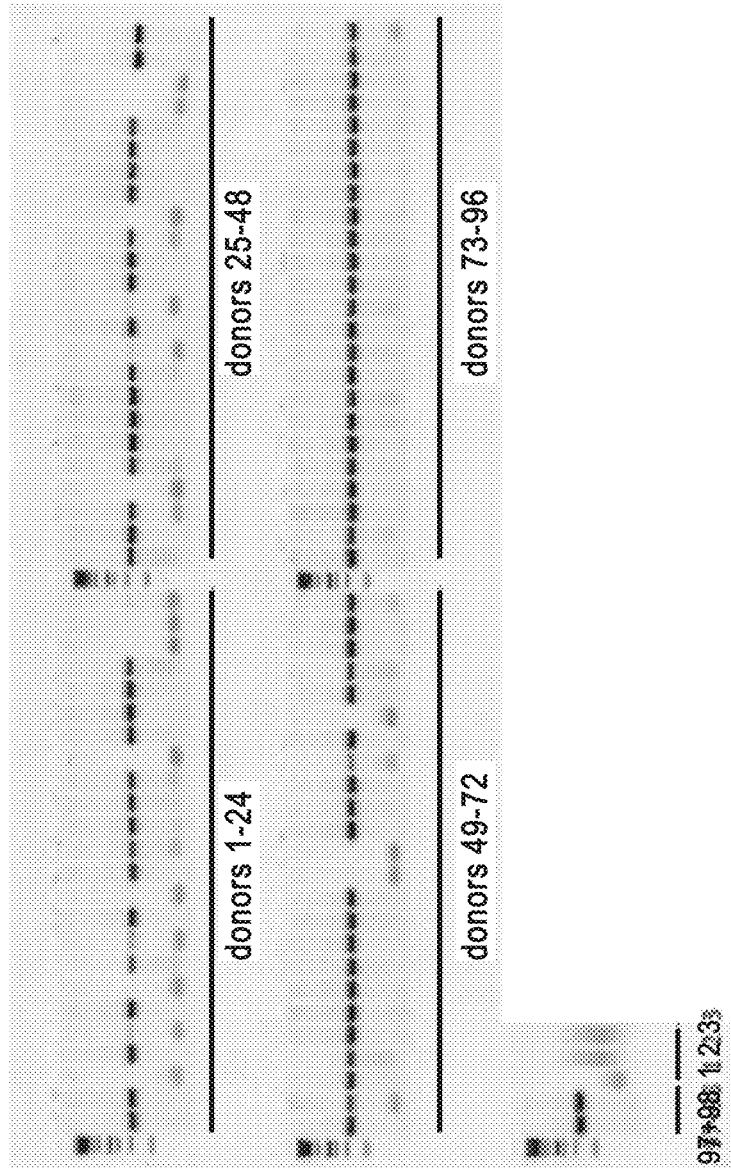
FIG. 26A shows a western blot of human PBMC donors screened for AAV signature using CISH control primers, Forward primer: 0752 and Reverse primer 0753; amplicon size: 455 bp, and AAV signature region controls NTC, pAAV DJ, and pDG.
Figure 26B:
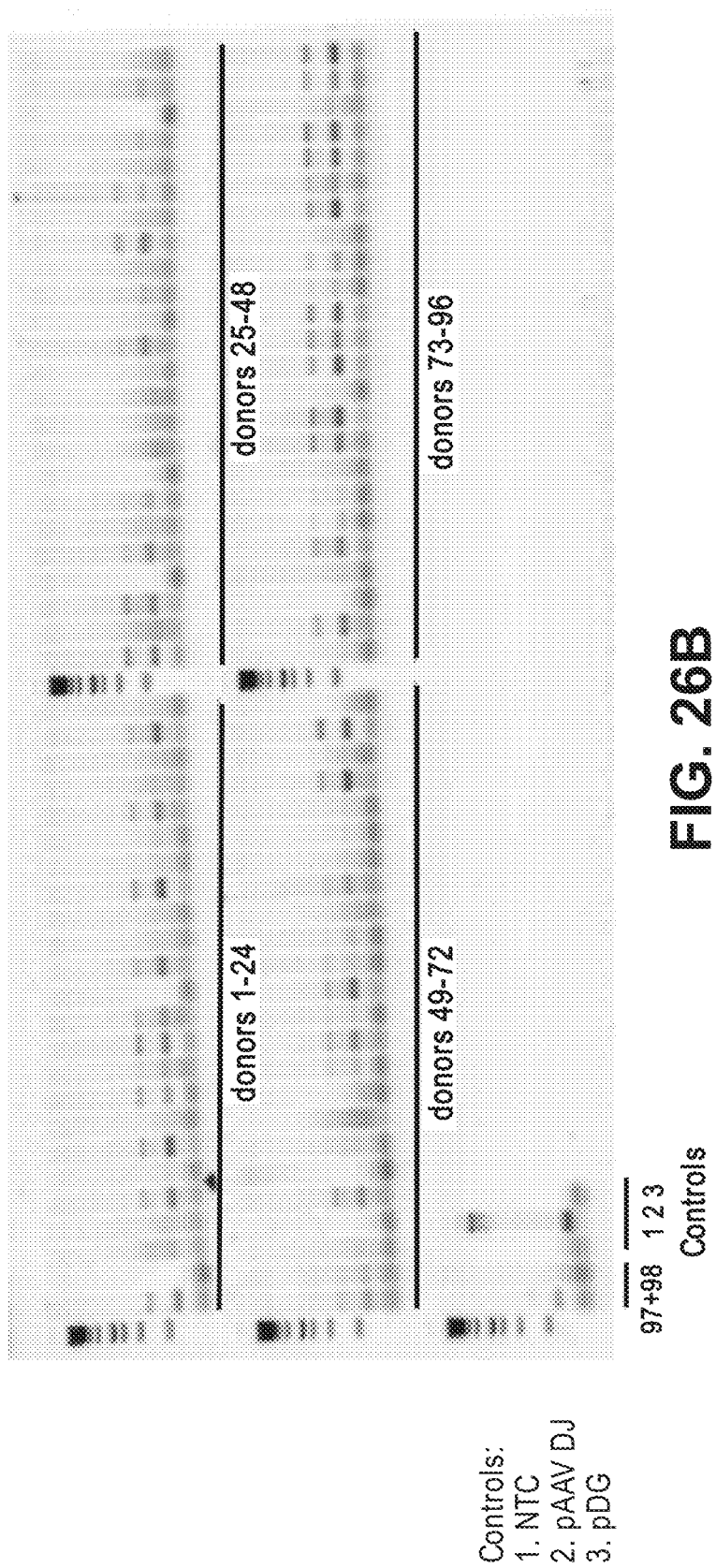
FIG. 26B shows a western blot of human PBMC donors screened for AAV using primers forward-2 and reverse-4 that yield a 1600 bp product.
Figure 26D:
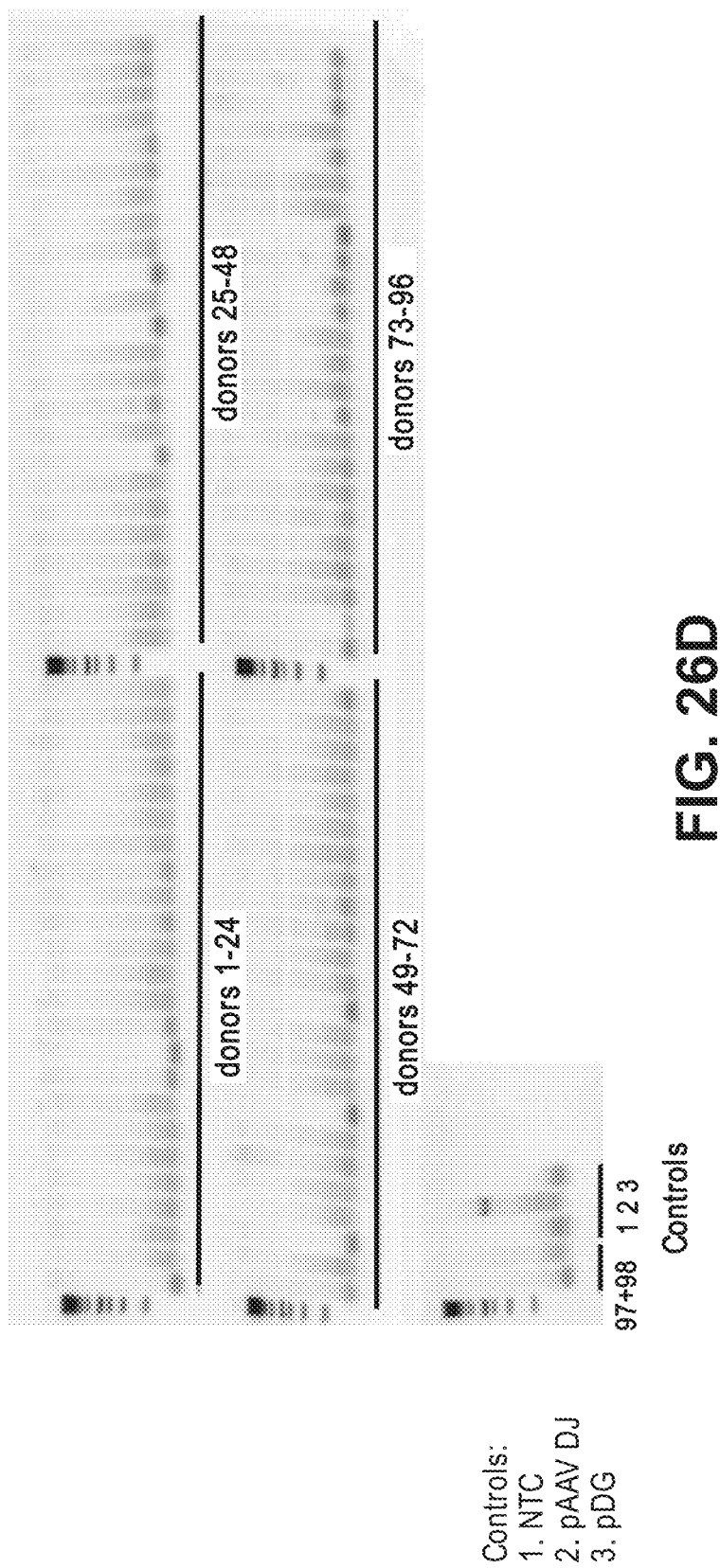
FIG. 26D shows a western blot of human PBMC donors screened for AAV using primers forward-5 and reverse-3 that yield a 921 bp product.
Figure 26E:
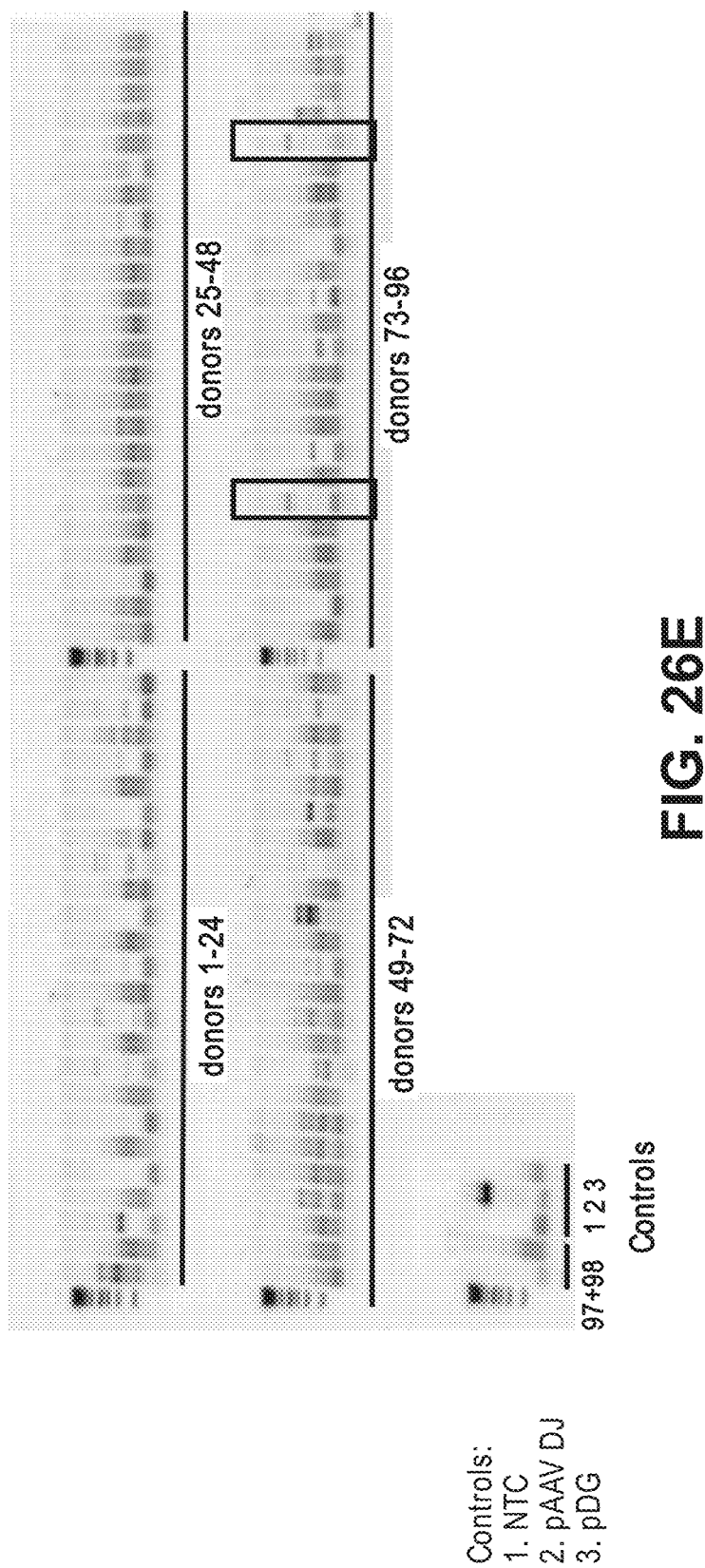
FIG. 26E shows a western blot of human PBMC donors screened for AAV using primers forward-6 and reverse-4 that yield a 1639 bp product.

Disclosed herein can be a method of identifying an AAV serotype. In some cases, an AAV serotype can be identified using a PCR approach. Using PCR one can amplify regions of the AAV genome, principally a 255 bp fragment of the capsid gene called the "signature region" in which the 5' and 3' sequences can be conserved but the central sequence can be variable and unique to each AAV serotype. In some cases, the signature region can be from about 50 bp, 75 bp, 80 bp, 100 bp, 125 bp, 150 bp, 175 bp, 200 bp, 225 bp, 255 bp, 260 bp, 270 bp, 280 bp, 290 bp, 300 bp, 325 bp, 350 bp, 375 bp, 400 bp, or up to about 450 bp. Primers can be designed to anneal to conserved regions of the Rep and Cap genes to amplify and identify novel AAV serotypes (for instance as shown in Gao et al., 2002). Three primer pairs were used to amplify the signature region, either alone or to include flanking sequences of the AAV rep and capsid genes (as illustrated in FIG. 26A). The signature region of AAV can be amplified from genomic DNA. Genomic DNA can be extracted from a mammalian cell or a non-mammalian cell. In some cases, genomic DNA can be extracted from a cell line such as HCT116, HEK293, Jurkat, U-937, NCI-H838, pDG, AAV DJ, or a combination thereof. In some cases, genomic DNA can be extracted from a human cell. Genomic DNA can be extracted from peripheral blood mononuclear cells (PBMCs). Genomic DNA can be extracted from liver, cardiac, brain, kidney, lung, spleen, bone, skin, buccal, blood, saliva, and the like.

Figure 15:
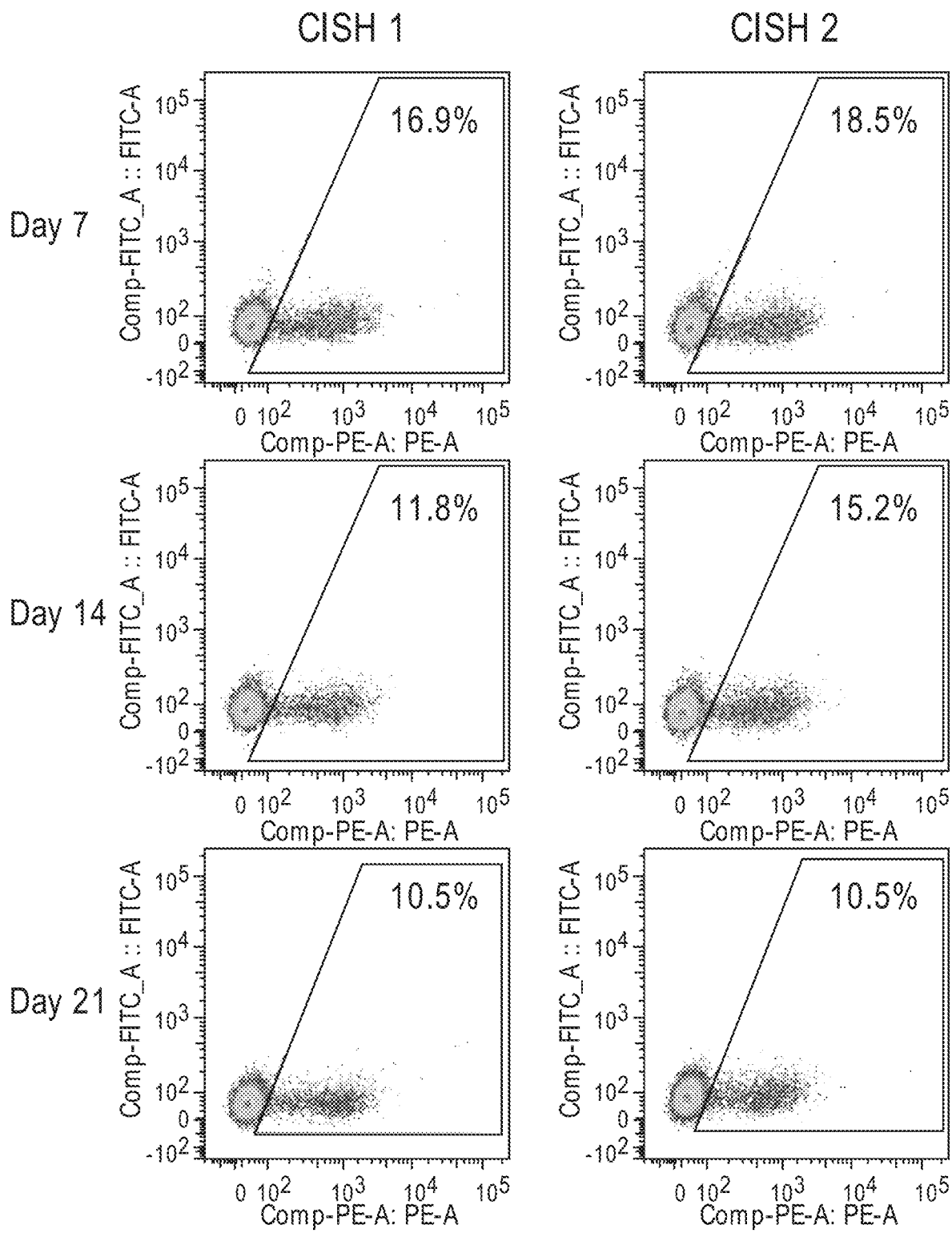
FIG. 15 shows flow cytometric plots of triplicate experiments of TCR expression on days 7, 14, or 21 post-transduction with VP1 F129L mutant AAV viral particles encoding for the exogenous TCR. The cells were also genomically edited with a CRISPR system specific for CISH gene disruption.
Figure 15:
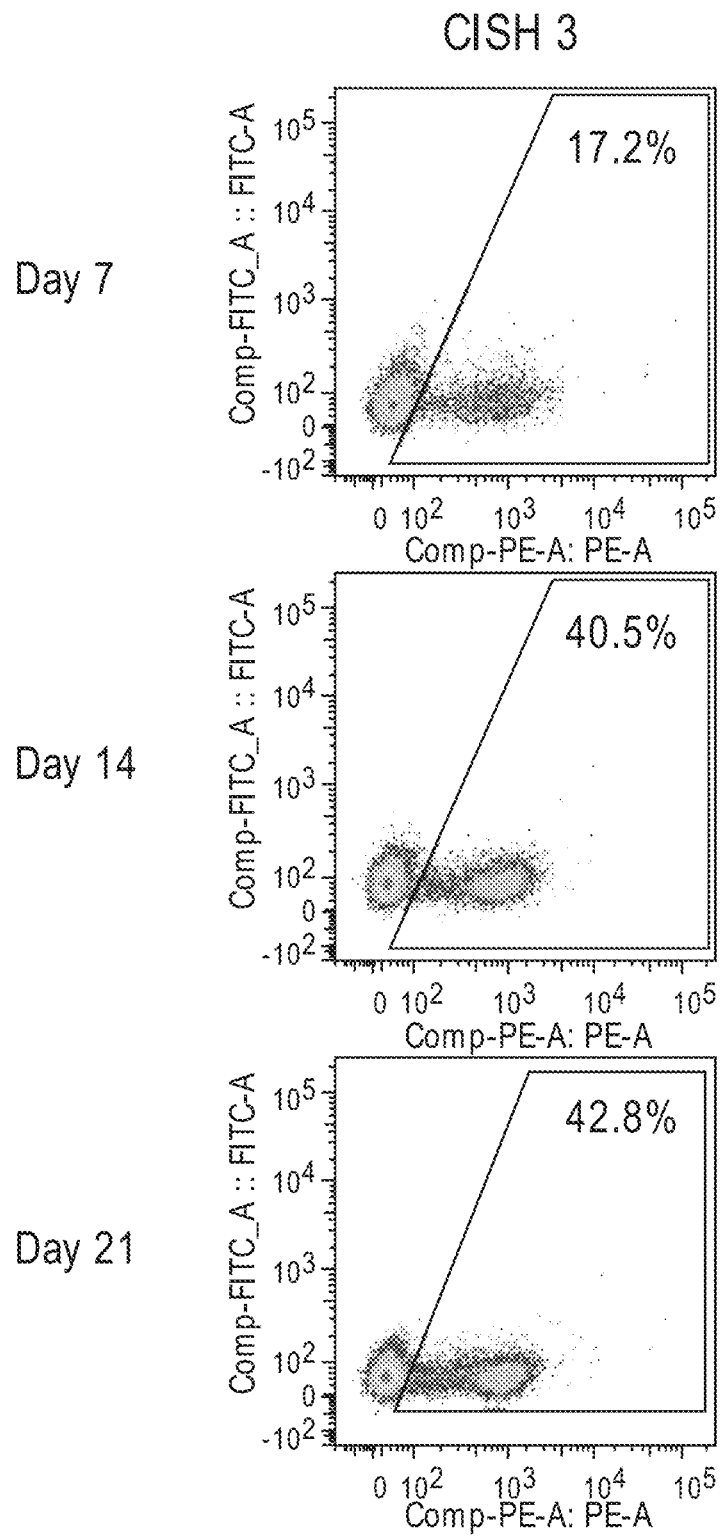
Figure 16:
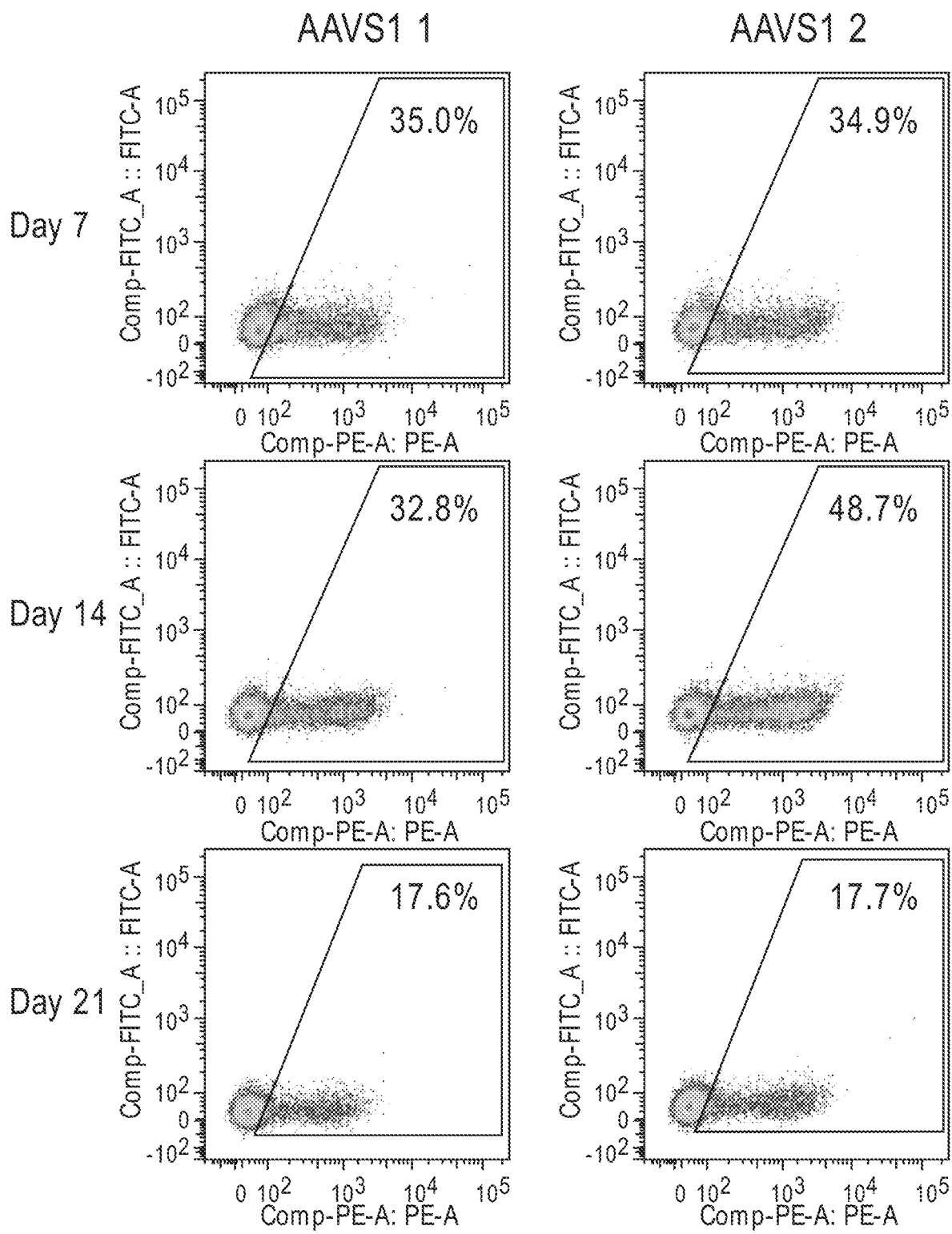
FIG. 16 shows flow cytometric plots of triplicate experiments of TCR expression on days 7, 14, or 21 post-transduction with VP1 F129L mutant AAV viral particles encoding for the TCR. The cells were also genomically edited with a CRISPR system specific for AAVS1 gene disruption.
Figure 16:
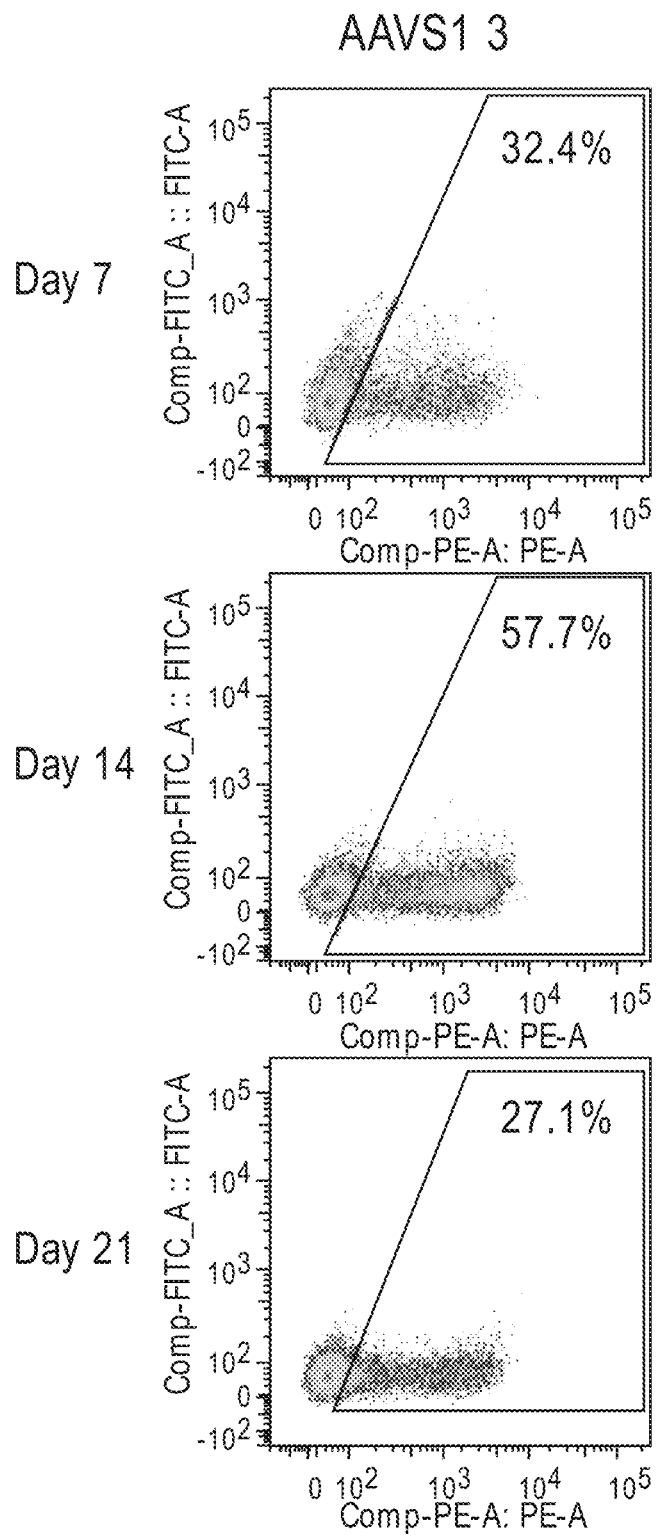

In some cases, an AAV viral capsid can be modified. A modification can be of any AAV serotype. In some cases, a modification is of a wildtype AAV6, FIG. 15. A modification can include modifying a combination of capsid components. For example, a mosaic capsid AAV is a virion that can be composed of a mixture of viral capsid proteins from different serotypes. The capsid proteins can be provided by complementation with separate plasmids that are mixed at various ratios. During viral assembly, the different serotypes capsid proteins can be mixed in each virion, at subunit ratios stoichiometrically reflecting the ratios of the complementing plasmids. A mosaic capsid can confer increased binding efficacy to certain cell types or improved performance as compared to an unmodified capsid.

In some cases, a chimeric capsid AAV can be generated. A chimeric capsid can have an insertion of a foreign protein sequence, either from another wild-type (wt) AAV sequence or an unrelated protein, into the open reading frame of the capsid gene. Chimeric modifications can include the use of naturally existing serotypes as templates, which can involve AAV capsid sequences lacking a certain function being co-transfected with DNA sequences from another capsid. In some cases, a chimera can include at least one cap polypeptide from an AAV serotype chosen from: AAV1, AAV2, AAV3, AAV4, AAV5, AAV6, AAV7, AAV8, AAV9, AAV10, AAV11, and AAV12. In some cases, a viral vector can include a polypeptide comprising a VP1 from an AAV serotype chosen from: AAV1, AAV2, AAV3, AAV4, AAV5, AAV6, AAV7, AAV8, AAV9, AAV10, AAV11, and AAV12. In other cases, a viral vector can include a polypeptide comprising a VP2 from an AAV serotype chosen from: AAV1, AAV2, AAV3, AAV4, AAV5, AAV6, AAV7, AAV8, AAV9, AAV10, AAV11, and AAV12. In still other cases, a viral vector can include a polypeptide comprising a VP3 from an AAV serotype chosen from: AAV1, AAV2, AAV3, AAV4, AAV5, AAV6, AAV7, AAV8, AAV9, AAV10, AAV11, and AAV12.

In some cases, a viral vector can comprise a chimera with capsids from: AAV4 and AAV6, AAV5 and AAV6, AAV11 and AAV6, AAV12 and AAV6, and any combination thereof. In some cases, a first AAV serotypes can be AAV4 and a second serotype can be AAV6. In some cases, a first AAV serotype and a second AAV serotype of a chimeric AAV vector can be AAV5 and AAV6. In some cases, a first AAV serotype and a second AAV serotype of a chimeric AAV vector can be AAV11 and AAV6. In some cases, a first AAV serotype and a second AAV serotype of a chimeric AAV vector can be AAV12 and AAV6.

Homologous recombination occurs at crossover points leading to capsids with new features and unique properties. In other cases, the use of epitope coding sequences fused to either the N or C termini of the capsid coding sequences to attempt to expose new peptides on the surface of the viral capsid without affecting gene function. In some cases, the use of epitope sequences inserted into specific positions in the capsid coding sequence, but using a different approach of tagging the epitope into the coding sequences itself can be performed. A chimeric capsid can also include the use of an epitope identified from a peptide library inserted into a specific position in the capsid coding sequence. The use of gene library to screen can be performed. For example, a screen of chimeras or mutant AAVs can be performed to identify chimeras and mutants that when used to transduce a cell confer increased transduction efficiency and/or increased expression of a transgene, such as an exogenous receptor. Chimeric capsids in AAV vectors can expand the range of cell types that can be transfected and can increase the efficiency of transduction. Increased transduction or transfection can be from about a 10%, 20%, 30%, 40%, 50%, 60%, 70%, 80%, 90%, 100%, 150%, 200%, 250% increase to about a 300% increase as compared to a transduction using an AAV with an unmodified capsid. For example, increased transduction or transfection can be measured as compared to a wild-type AAV in terms of the detection of a transgene present (as a nucleic acid or polypeptide) on or in a cell. In some embodiments, an AAV comprising a chimeric capsid of two different AAV serotypes will have increased transduction efficiency as compared to one of or both of the wild-type AAVs from which the capsid was derived. A chimeric capsid can contain a degenerate, recombined, shuffled or otherwise modified Cap protein. For example targeted insertion of receptor-specific ligands or single-chain antibodies at the N-terminus of VP proteins can be performed. An insertion of a lymphocyte antibody or target into an AAV can be performed to improve binding and infection of a T cell. In some cases, virions having chimeric capsids (e.g., capsids containing a degenerate or otherwise modified Cap protein) can be made. To further alter the capsids of such virions, e.g., to enhance or modify the binding affinity for a specific cell type, such as a lymphocyte, additional mutations can be introduced into the capsid of the virion. For example, suitable chimeric capsids can have ligand insertion mutations for facilitating viral targeting to specific cell types. The construction and characterization of AAV capsid mutants including insertion mutants, alanine screening mutants, and epitope tag mutants is described in Wu et al., J. Virol. 74:8635-45, 2000. Methods of making AAV capsid mutants are known, and include site-directed mutagenesis (Wu et al., J. Virol. 72:5919-5926); molecular breeding, nucleic acid, exon, and DNA family shuffling (Soong et al., Nat. Genet. 25:436-439, 2000; Coco et al., Nature Biotech. 2001; 19:354; and U.S. Pat. Nos. 5,837,458; 5,811,238; and 6,180,406; Kolkman and Stemmer, Nat. Biotech. 19:423-428, 2001; Fisch et al., Proceedings of the National Academy of Sciences 93:7761-7766, 1996; Christians et al., Nat. Biotech. 17:259-264, 1999); ligand insertions (Girod et al. Nat. Med. 9:1052-1056, 1999); cassette mutagenesis (Rueda et al. Virology 263:89-99, 1999; Boyer et al., J. Virol. 66:1031-1039, 1992); and the insertion of short random oligonucleotide sequences.

In some cases, a transcapsidation can be performed. Transcapsidation can be a process that involves the packaging of the ITR of one serotype of AAV into the capsid of a different serotype. In another case, adsorption of receptor ligands to an AAV capsid surface can be performed and can be the addition of foreign peptides to the surface of an AAV capsid. In some cases, this can confer the ability to specifically target cells that no AAV serotype currently has a tropism towards, and this can greatly expand the uses of AAV as a gene therapy tool.

In some cases, an AAV vector can be modified. For example, an AAV vector can comprise a modification such as an insertion, deletion, chemical alteration, or synthetic modification. In some cases, a single nucleotide is inserted into an AAV vector. In other cases, multiple nucleotides are inserted into a vector. Nucleotides that can be inserted can range from about 1 nucleotide to about 5 kb. Nucleotides that can be inserted can encode for a functional protein. A nucleotide that can be inserted can be endogenous or exogenous to a subject receiving a vector. For example, a human cell can receive an AAV vector that can contain at least a portion of a murine genome, such as a portion of a TCR. In some cases, a modification such as an insertion or deletion of an AAV vector can comprise a protein coding region or a non-coding region of a vector. In some cases, a modification can improve activity of a vector when introduced into a cell. For example, a modification can improve expression of protein coding regions of a vector when introduced into a human cell.

In some cases, a host cell can contain sequences which drive expression of a novel AAV capsid protein (or a capsid protein comprising a fragment thereof) in the host cell and rep sequences of the same source as the source of the AAV ITRs, or a cross-complementing source. The AAV cap and rep sequences can be independently obtained from an AAV source as described above and can be introduced into the host cell in any manner known to one in the art as described above. Additionally, when pseudotyping an AAV vector, the sequences encoding each of the rep proteins can be supplied by different AAV sources (e.g., AAV1, AAV2, AAV3, AAV4, AAV5, AAV6, AAV7, AAV8, AAV9, AAV10, AAV11, AAV12). In some cases, a host cell stably contains the capsid protein under the control of a suitable promoter. In other cases, a capsid protein can be expressed under the control of an inducible promoter. In another embodiment, a capsid protein can be supplied to the host cell in trans. When delivered to the host cell in trans, the capsid protein can be delivered via a plasmid which contains the sequences necessary to direct expression of the selected capsid protein in the host cell. In some cases, when delivered to a host cell in trans, a plasmid carrying a capsid protein also carries other sequences required for packaging the AAV, e.g., the rep sequences. In some cases, rep and cap sequences can be transfected into a host cell on a single nucleic acid molecule and exist stably in the cell as an episome. In another embodiment, the rep and cap sequences are stably integrated into the chromosome of the cell. Another embodiment has the rep and cap sequences transiently expressed in the host cell. For example, a useful nucleic acid molecule for such transfection comprises, from 5' to 3', a promoter, an optional spacer interposed between the promoter and the start site of the rep gene sequence, an AAV rep gene sequence, and an AAV cap gene sequence.

In some cases, the present disclosure provides construction of helper vectors that provide AAV Rep and Cap proteins for producing stocks of virions composed of an AAV vector (e.g., a vector encoding an exogenous receptor sequence) and a chimeric capsid (e.g., a capsid containing a degenerate, recombined, shuffled or otherwise modified Cap protein). In some cases, a modification can involve the production of AAV cap nucleic acids that are modified, e.g., cap nucleic acids that contain portions of sequences derived from more than one AAV serotype (e.g., AAV serotypes 1-12). Such chimeric nucleic acids can be produced by a number of mutagenesis techniques. A method for generating chimeric cap genes can involve the use of degenerate oligonucleotides in an in vitro DNA amplification reaction. A protocol for incorporating degenerate mutations (e.g., polymorphisms from different AAV serotypes) into a nucleic acid sequence is described in Coco et al. (Nature Biotechnology 20:1246-1250, 2002. In this method, known as degenerate homoduplex recombination, "top-strand" oligonucleotides are constructed that contain polymorphisms (degeneracies) from genes within a gene family. Complementary degeneracies are engineered into multiple bridging "scaffold" oligonucleotides. A single sequence of annealing, gap-filling, and ligation steps results in the production of a library of nucleic acids capturing every possible permutation of the parental polymorphisms. Any portion of a capsid gene can be mutated using methods such as degenerate homoduplex recombination. Particular capsid gene sequences, however, are preferred. For example, critical residues responsible for binding of an AAV2 capsid to its cell surface receptor heparin sulfate proteoglycan (HSPG) have been mapped. Arginine residues at positions 585 and 588 appear to be critical for binding, as non-conservative mutations within these residues eliminate binding to heparin-agarose. Computer modeling of the AAV2 and AAV4 atomic structures identified seven hypervariable regions that overlap arginine residues 585 and 588, and that are exposed to the surface of the capsid. These hypervariable regions are thought to be exposed as surface loops on the capsid that mediates receptor binding. Therefore, these loops can be used as targets for mutagenesis in methods of producing chimeric virions with tropisms different from WT virions.

In some cases, novel AAV amino acid sequences, peptides and proteins can be expressed from AAV nucleic acid sequences described herein. Additionally, these amino acid sequences, peptides and proteins can be generated by other methods known in the art, including, e.g., by chemical synthesis, by other synthetic techniques, or by other methods. The sequences of any of the AAV capsids provided herein can be readily generated using a variety of techniques. Suitable production techniques are well known to those of skill in the art. See, e.g., Sambrook et al, Molecular Cloning: A Laboratory Manual, Cold Spring Harbor Press (Cold Spring Harbor, N.Y.). Alternatively, peptides can also be synthesized by the well-known solid phase peptide synthesis methods (Merrifield, J. Am. Chem. Soc., 85:2149 (1962); Stewart and Young, Solid Phase Peptide Synthesis (Freeman, San Francisco, 1969) pp. 27-62). The sequences and proteins described herein can be produced by any suitable means, including recombinant production, chemical synthesis, or other synthetic means. Such production methods are within the knowledge of those of skill in the art.

In some cases, sequences can encode an AAV capsid or engineered AAV vector described herein. In another embodiment, vectors can contain, at a minimum, sequences encoding an AAV rep protein or a fragment thereof. Optionally, vectors can contain both AAV cap and rep proteins. In vectors in which both AAV rep and cap are provided, the AAV rep and AAV cap sequences can originate from an AAV of the same Glade. Alternatively, provided herein can be vectors in which a rep sequences are from an AAV source which differs from that which is providing the cap sequences. In one embodiment, the rep and cap sequences are expressed from separate sources (e.g., separate vectors, or a host cell and a vector). In another embodiment, these rep sequences are fused in frame to cap sequences of a different AAV source to form a chimeric AAV vector. Optionally, vectors can be vectors packaged in an AAV capsid. These vectors and other vectors described herein can further contain a transgene comprising a selected transgene which is flanked by AAV 5' ITR and AAV 3' ITR.

A subject mutant AAV virion can comprise a mutation in at least one capsid protein (e.g., at least one of VP1, VP2, and VP3). Thus, at least one of VP1, VP2, and VP3 has at least one amino acid substitution compared to wild-type AAV capsid protein. In some cases, a mutation can occur in VP1 and VP2, in VP1 and VP3, in VP2 and VP3, or in VP1, VP2, and VP3. In some cases, a VP can be removed. For example, in some embodiments a mutant AAV does not comprise at least one of VP1, VP2, or VP3. In some cases, a mutation in a VP1 region can be an F to L mutation. In some cases, a mutation in a VP1 region can be at position 129 of an AAV VP1 polypeptide sequence encoded by said AAV nucleotide sequence. In some cases, a VP2 and/or VP3 region can have any number of mutations. A VP1, VP2, and/or VP3 region can have mutations that can include: H to N, D to N, D to N, V to L, and V to I. Mutations in a capsid can occur at positions 418, 462, 584, 598, or 642 of an AAV polypeptide sequence encoded by said AAV nucleotide sequence. Any number of mutations can be performed on an AAV capsid protein or portion thereof. In some cases, mutations can include at least one of F129L, H642N, and D418N. In some cases, mutations can include at least one of: F129L, H642N, and L584N. In some cases, mutations can include: F129L, H462N, or V598L. In some cases, any of the above mutations can be made, alone or in combination, in a nucleic acid encoding a polypeptide of SEQ ID NO: 20, or a fragment of SEQ ID NO: 20. Likewise, any of the above mutations can be made alone or in combination in a nucleic acid encoding any one of SEQ ID NOS: 21-24, in a position aligning to that in SEQ ID NO: 20.

In some cases, mutations can include at least one of: F129L, H462N, or V598I. Mutations in an AAV capsid can occur at additional locations. For example, mutations in an AAV capsid can occur at positions: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 718, 719, 720, 721, 722, 723, 724, 725, 726, 727, 728, 729, 730, 731, 732, 733, 734, 735, or up to 736 and any combination thereof of a polypeptide or nucleotide sequence. Mutations of an AAV capsid can be made with reference to the start location of the capsid protein. The AAV capsid, comprises three polypeptides encoded by the cap gene (VP1, VP2, and VP3, e.g. of AAV6). Thus the VP1 polypeptide can be said to comprise VP2 and VP3 regions. These three polypeptides are formed by alternative splicing from the mRNA transcribed from the cap gene. As used herein, references to particular positions are with respect to the VP1 capsid protein. The skilled worker will appreciate that, where a mutation has been made, at a position that encodes more than one of VP1, VP2, and VP3, this mutation will be present in each of the resultant polypeptides containing an amino acid at that position. The skilled worker will also appreciate that the mutations described herein can be made in an AAV of a selected serotype as described herein at the corresponding position of the capsid of that serotype.

In some cases, a mutation can occur at any of the previously mentioned AAV capsid positions and can include any number of mutations. In some cases, a mutation can be from one amino acid to another amino acid. Any combination or permutation of the canonical amino acids can be performed. Any of the following amino acid modifications can be made at any of VP1, VP2, and VP3: A to R, A to N, A to D, A to C, A to Q, A to E, A to G, A to H, A to I, A to L, A to K, A to M, A to F, A to P, A to S, A to T, A to W, A to Y, A to V, R to N, R to D, R to C, R to Q, R to E, R to G, R to H, R to I, R to L, R to K, R to M, R to F, R to P, R to S, R to T, R to W, R to Y, R to V, N to D, N to C, N to Q, N to E, N to G, N to H, N to I, N to L, N to K, N to M, N to F, N to P, N to S, N to T, N to W, N to Y, N to V, D to C, D to Q, D to E, D to G, D to H, D to I, D to L, D to K, D to M, D to F, D to P, D to S, D to T, D to W, D to Y, D to V, C to Q, C to E, C to G, C to H, C to I, C to L, C to K, C to M, C to F, C to P, C to S, C to T, C to W, C to Y, C to V, Q to E, Q to G, Q to H, Q to I, Q to L, Q to K, Q to M, Q to F, Q to P, Q to S, Q to T, Q to W, Q to Y, Q to V, E to G, E to H, E to I, E to L, E to K, E to M, E to F, E to P, E to S, E to T, E to W, E to Y, E to V, G to H, G to I, G to L, G to K, G to M, G to F, G to P, G to S, G to T, G to W, G to Y, G to V, H to I, H to L, H to K, H to M, H to F, H to P, H to S, H to T, H to W, H to Y, H to V, I to L, I to K, I to M, I to F, I to P, I to S, I to T, I to W, I to Y, I to V, L to K, L to M, L to F, L to P, L to S, L to T, L to W, L to Y, L to V, K to M, K to F, K to P, K to S, K to T, K to W, K to Y, K to V, M to F, M to P, M to S, M to T, M to W, M to Y, M to V, F to P, F to S, F to T, F to W, F to Y, F to V, P to S, P to T, P to W, P to Y, P to V, S to T, S to W, S to Y, S to V, T to W, T to Y, T to V, W to Y, W to V, Y to V, and any of the previously described mutations in reverse.

A mutation can be a conservative mutation or replacement. For example, 20 naturally occurring amino acids can share similar characteristics. Aliphatic amino acids can be: glycine, alanine, valine, leucine, or isoleucine. Hydroxyl or sulfur/selenium-containing amino acids can be: Serine, cysteine, selenocysteine, threonine, or methionine. A cyclic amino acid can be proline. An aromatic amino acid can be phenylalanine, tyrosine, or tryptophan. A basic amino acid can be histidine, lysine, and arginine. An acidic amino acid can be aspartate, glutamate, asparagine, or glutamine. A conservative mutation can be, serine to glycine, serine to alanine, serine to serine, serine to threonine, serine to proline. A conservative mutation can be arginine to asparagine, arginine to lysine, arginine to glutamine, arginine to arginine, arginine to histidine. A conservative mutation can be Leucine to phenylalanine, leucine to isoleucine, leucine to valine, leucine to leucine, leucine to methionine. A conservative mutation can be proline to glycine, proline to alanine, proline to serine, proline to threonine, proline to proline. A conservative mutation can be threonine to glycine, threonine to alanine, threonine to serine, threonine to threonine, threonine to proline. A conservative mutation can be alanine to glycine, alanine to threonine, alanine to proline, alanine to alanine, alanine to serine. A conservative mutation can be valine to methionine, valine to phenylalanine, valine to isoleucine, valine to leucine, valine to valine. A conservative mutation can be glycine to alanine, glycine to threonine, glycine to proline, glycine to serine, glycine to glycine. A conservative mutation can be Isoleucine to phenylalanine, isoleucine to isoleucine, isoleucine to valine, isoleucine to leucine, isoleucine to methionine. A conservative mutation can be phenylalanine to tryptophan, phenylalanine to phenylalanine, phenylalanine to tyrosine. A conservative mutation can be tyrosine to tryptophan, tyrosine to phenylalanine, tyrosine to tyrosine. A conservative mutation can be cysteine to serine, cysteine to threonine, cysteine to cysteine. A conservative mutation can be histidine to asparagine, histidine to lysine, histidine to glutamine, histidine to arginine, histidine to histidine. A conservative mutation can be glutamine to glutamic acid, glutamine to asparagine, glutamine to aspartic acid, glutamine to glutamine. A conservative mutation can be asparagine to glutamic acid, asparagine to asparagine, asparagine to aspartic acid, asparagine to glutamine. A conservative mutation can be lysine to asparagine, lysine to lysine, lysine to glutamine, lysine to arginine, lysine to histidine. A conservative mutation can be aspartic acid to glutamic acid, aspartic acid to asparagine, aspartic acid to aspartic acid, aspartic acid to glutamine. A conservative mutation can be glutamine to glutamine, glutamine to asparagine, glutamine to aspartic acid, glutamine to glutamine. A conservative mutation can be methionine to phenylalanine, methionine to isoleucine, methionine to valine, methionine to leucine, methionine to methionine. A conservative mutation can be tryptophan to tryptophan, tryptophan to phenylalanine, tryptophan to tyrosine.

In some embodiments, at least one of VP1, VP2, and VP3 has from one to about 25 amino acid substitutions compared to wild-type AAV VP1, VP2, and VP3, e.g., from about one to about 5, from about 5 to about 10, from about 10 to about 15, from about 15 to about 20, or from about 20 to about 25 amino acid substitutions compared to wild-type AAV VP1, VP2, and VP3. In some cases, a mutant AAV virion can have from about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or up to about 100 mutations in at least a portion of an AAV sequence, such as a capsid sequence. A mutation in a capsid sequence can be within anyone of VP1, VP2, VP3, or combinations thereof. In some cases, a mutant AAV variant can have 1 mutation in a capsid sequence. In some cases, a mutant AAV variant can have 2 mutations in a capsid sequence. In some cases, a mutant AAV variant can have 3 mutations in a capsid sequence. Alternatively, a subject mutant AAV virion comprises one or more amino acid deletions and/or insertions in at least one capsid protein relative to wild-type capsid protein. In some embodiments, a subject mutant AAV virion comprises one or more amino acid substitutions and/or deletions and/or insertions in a capsid protein relative to a wild-type capsid protein. In some cases, a mutation can be a point mutation. In some cases, at least a portion of an AAV can be mutated. For example, a capsid of an AAV can have a mutation such as a point mutation, missense mutation, nonsense mutation, insertion, deletion, duplication, frameshift, or repeat expansion.

In some cases, a mutant AAV library can be generated that comprises one or more mutations relative to a WT AAV cap gene. A WT cap gene can be a cap comprising a nucleotide sequence as set forth in SEQ ID NOs: 55. Mutations in the AAV cap gene are generated using any known method. Suitable methods for mutagenesis of a starter AAV cap gene include, but are not limited to, a polymerase chain reaction (PCR)-based method, oligonucleotide-directed mutagenesis, saturation mutagenesis, loop-swapping mutagenesis, fragment shuffling mutagenesis (i.e., DNA shuffling), and the like. Methods for generating mutations are well described in the art. See, e.g., Zhao et al. Nat Biotechnol. 1998 March; 16(3):234-5; Koerber et. al.; Mol Ther. 2008 October; 16(10): 1703-9; Koerber et. al.; Mol Ther. 2009 December; 17(12):2088-95; U.S. Pat. Nos. 6,579,678; 6,573,098; and 6,582,914; all of which are hereby incorporated by reference for their teachings related to mutagenesis. Once a library is generated, it can be selected for a particular virion property (i.e., an altered property of infection or increased transfection or transduction efficiency). Viral particles are generated (thus producing a library of modified AAV virions), and subjected to one or more selection steps to identify a modified AAV virion with an altered property of infection as compared to a WT AAV. Properties of infection that are selected for can include, but are not limited to: 1) altered binding (e.g., decreased binding) to AAV neutralizing antibodies; 2) increased evasion of AAV neutralizing antibodies; 3) increased infectivity of a cell that is resistant to infection with AAV; and 4) increased expression of a transgene in a transduced cell. In some cases, modified AAV can have increased transfection, transduction, or infectivity function as compared to unmodified cells. For example, modified AAV vectors can function from about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or up to about 100% over a comparable WT AAV vector. In some cases, mutated or chimeric AAV vectors can function over 100% of a WT AAV vector as measured by percent expression of a transgene in a transfected or transduced cell. For example, cells transfected or transduced can function 110, 120, 130, 140, 150, 160, 170, 180, 190, 200, 250, 300, 400, 500, 600, 700, 800, 900, 1000, or up to about 5000% of a comparable cell transfected or transduced with a WT AAV vector encoding a comparable transgene.

In some cases, a mutant AAV library comprising mutations in the cap gene can be generated using a staggered extension process. A staggered extension process can involve amplification of the cap gene using a PCR-based method. The template cap gene can be primed using specific PCR primers, followed by repeated cycles of denaturation and very short annealing/polymerase-catalyzed extension. In each cycle, the growing fragments anneal to different templates based on sequence complementarity and extend further. The cycles of denaturation, annealing, and extension are repeated until full-length sequences form. The resulting full-length sequences include at least one mutation in the cap gene compared to a wild-type AAV cap gene.

In some cases, a modification can be of an AAV serotype 6 capsid. Modifications to a capsid can be single, double, or triple mutations in a capsid sequence. In some cases a subject variant AAV capsid protein (or the variant AAV capsid protein encoded by a subject nucleic acid) can comprise homology to any one of the nucleic, SEQ ID NO: 1 to SEQ ID NO: 19, or protein sequences, SEQ ID NO: 267 to SEQ ID NO: 285 of Table 1, from about 10%, 15%, 20%, 25%, 30%, 35%, 40%, 45%, 50%, 55%, 60%, 65%, 70%, 75%, 80%, 85% 90%, 91%, 92%, 93%, 94%, 95%, 96%, 97%, 98%, 99% or up to 100%. In some cases a subject mutated or modified vector can comprise homology to any one of the sequences disclosed in Table 12, SEQ ID NO: 195 to SEQ ID NO: 213, from about 10%, 15%, 20%, 25%, 30%, 35%, 40%, 45%, 50%, 55%, 60%, 65%, 70%, 75%, 80%, 85% 90%, 91%, 92%, 93%, 94%, 95%, 96%, 97%, 98%, 99% or up to 100%.

TABLE 1

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Mutation | Nucleic acid sequence of the synthesised fragment to clone into the AAV6 Rep Cap vector using restriction sites HindIII and AgeI | SEQ ID NO | Capsid protein sequence |
|---|---|---|---|---|
| 1 | F129L | ggtaccaaaacaaatgttctcgtcacgtgggcatg<br>aatctgatgctgtttccctgcagacaatgcgagag<br>aatgaatcagaattcaaatatctgcttcactcacg<br>gacagaaagactgtttagagtgctttcccgtgtca<br>gaatctcaaccgtttctgtcgtcaaaaaggcgta<br>tcagaaactgtgctacattcatcatatcatgggaa<br>aggtgccagacgcttgcactgcctgcgatctggtc<br>aatgtggatttggatgactgcatctttgaacaata<br>a*tgatttaaatcaggt*ATGGCTGCCGATGGTTAT<br>CTTCCAGATTGGCTCGAGGACAACCTCTCTGAGGG<br>CATTCGCGAGTGGTGGGACTTGAAACCTGGAGCCC<br>CGAAACCCAAAGCCAACCAGCAAAAGCAGGACGAC<br>GGCCGGGGTCTGGTGCTTCCTGGCTACAAGTACCT<br>CGGACCCTTCAACGGACTCGACAAGGGGGAGCCCG<br>TCAACGCGGCGGATGCAGCGGCCCTCGAGCACGAC<br>AAGGCCTACGACCAGCAGCTCAAAGCGGGTGACAA<br>TCCGTACCTGCGGTATAACCACGCCGACGCCGAGT<br>TTCAGGAGCGTCTGCAAGAAGATACGTCTTTTGGG<br>GGCAACCTCGGGCGAGCAGTCTTCCAGGCCAAGAA<br>GAGGGTTCTCGAACCTTTAGGTCTGGTTGAGGAAG<br>GTGCTAAG*ACG*GCTCCTGGAAAGAAACGTCCGGTA<br>GAGCAGTCGCCACAAGAGCCAGACTCCTCCTGGG<br>CATTGGCAAGACAGGCCAGCAGCCCGCTAAAAAGA<br>GACTCAATTTTGGTCAGACTGGCGACTCAGAGTCA<br>GTCCCCGACCCACAACCTCTCGGAGAACCTCCAGC<br>AACCCCCGCTGCTGTGGGACCTACTACAATGGCTT<br>CAGGCGGTGGCGCACCAATGGCAGACAATAACGAA<br>GGCGCCGACGGAGTGGGTAATGCCTCAGGAAATTG<br>GCATTGCGATTCCACATGGCTGGGCGACAGAGTCA<br>TCACCACCAGCACCCGAACATGGGCCTTGCCCACC<br>TATAACAACCACCTCTACAAGCAAATCTCCAGTGC<br>TTCAACGGGGCCAGCAACGACAACCACTACTTCG<br>GCTACAGCACCCCCTGGGGGTATTTTGATTTCAAC<br>AGATTCCACTGCCATTTCTCACCACGTGACTGGCA<br>GCGACTCATCAACAACAATTGGGGATTCCGGCCCA<br>AGAGACTCAACTTCAAGCTCTTCAACATCCAAGTC<br>AAGGAGGTCACGACGAATGATGGCGTCACGACCAT<br>CGCTAATAACCTTACCAGCACGGTTCAAGTCTTCT<br>CGGACTCGGAGTACCAGTTGCCGTACGTCCTCGGC<br>TCTGCGCACCAGGGCTGCCTCCCTCCGTTCCCGGC<br>GGACGTGTTCATGATTCCGCAGTACGGCTACCTAA<br>CGCTCAACAATGGCAGCCAGGCAGTGGGACGGTCA<br>TCCTTTTACTGCCTGGAATATTTCCCATCGCAGAT<br>GCTGAGAACGGGCAATAACTTTACCTTCAGCTACA<br>CCTTCGAGGACGTGCCTTTCCACAGCAGCTACGCG<br>CACAGCCAGAGCCTGGACCGGCTGATGAATCCTCT<br>CATCGACCAGTACCTGTATTACCTGAACAGAACTC<br>AGAATCAGTCCGGAAGTGCCCAAAACAAGGACTTG<br>CTGTTTAGCCGGGGGTCTCCAGCTGGCATGTCTGT<br>TCAGCCCAAAAACTGGCTACCTGGACCCTGTTACC<br>GGCAGCAGCGCGTTTCTAAAACAAAAACAGACAAC<br>AACAACAGCAACTTTACCTGGACTGGTGCTTCAAA<br>ATATAACCTTAATGGGCGTGAATCTATAATCAACC<br>CTGGCACTGCTATGGCCTCACACAAAGACGACAAA<br>GACAAGTTCTTTCCCATGAGCGGTGTCATGATTTT<br>TGGAAAGGAGAGCGCCGGAGCTTCAAACACTGCAT<br>TGGACAATGTCATGATCACAGACGAAGAGGAAATC<br>AAAGCCACTAACCCCGTGGCCACCGAAAGATTTGG<br>GACTGTGGCAGTCAATCTCCAGAGCAGCAGCACAG | 267 | MAADGYLPDWLE<br>DNLSEGIREWWD<br>LKPGAPKPKANQ<br>QKQDDGRGLVLP<br>GYKYLGPFNGLD<br>KGEPVNAADAAA<br>LEHDKAYDQQLK<br>AGDNPYLRYNHA<br>DAEFQERLQEDT<br>SFGGNLGRAVFQ<br>AKKRVLEPLGLV<br>EEGAK*T*APGKKR<br>PVEQSPQEPDSS<br>SGIGKTGQQPAK<br>KRLNFGQTGDSE<br>SVPDPQPLGEPP<br>ATPAAVGPTTMA<br>SGGGAPMADNNE<br>GADGVGNASGNW<br>HCDSTWLGDRVI<br>TTSTRTWALPTY<br>NNHLYKQISSAS<br>TGASNDNHYFGY<br>STPWGYFDFNRF<br>HCHFSPRDWQRL<br>INNNWGFRPKRL<br>NFKLFNIQVKEV<br>TTNDGVTTIANN<br>LTSTVQVFSDSE<br>YQLPYVLGSAHQ<br>GCLPPFPADVFM<br>IPQYGYLTLNNG<br>SQAVGRSSFYCL<br>EYFPSQMLRTGN<br>NFTFSYTFEDVP<br>FHSSYAHSQSLD<br>RLMNPLIDQYLY<br>YLNRTQNQSGSA<br>QNKDLLFSRGSP<br>AGMSVQPKNWLP<br>GPCYRQQRVSKT<br>KTDNNNSNFTWT<br>GASKYNLNGRES<br>IINPGTAMASHK<br>DDKDKFFPMSGV<br>MIFGKESAGASN<br>TALDNVMITDEE<br>EIKATNPVATER<br>FGTVAVNLQSSS<br>TDPATGDVHVMG<br>ALPGMVWQDRDV<br>YLQGPIWAKIPH<br>TDGHFHPSPLMG<br>GFGLKHPPPQIL<br>IKNTPVPANPPA<br>EFSATKFASFIT<br>QYSTGQVSVEIE<br>WELQKENSKRWN<br>PEVQYTSNYAKS |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Mutation | Nucleic acid sequence of the synthesised fragment to clone into the AAV6 Rep Cap vector using restriction sites HindIII and AgeI | SEQ ID NO | Capsid protein sequence |
|---|---|---|---|---|
| | | ACCCTGCGACCGGAGATGTGCATGTTATGGGAGCC<br>TTACCTGGAATGGTGTGGCAAGACAGAGACGTATA<br>CCTGCAGGGTCCTATTTGGGCCAAAATTCCTCACA<br>CGGATGGACACTTTCACCCGTCTCCTCTCATGGGC<br>GGCTTTGGACTTAAGCACCCGCCTCCTCAGATCCT<br>CATCAAAAACACGCCTGTTCCTGCGAATCCTCCGG<br>CAGAGTTTTCGGCTACAAAGTTTGCTTCATTCATC<br>ACCCAGTATTCCACAGGACAAGTGAGCGTGGAGAT<br>TGAATGGGAGCTGCAGAAAGAAAACAGCAAACGCT<br>GGAATCCCGAAGTGCAGTATACATCTAACTATGCA<br>AAATCTGCCAACGTTGATTTCACTGTGGACAACAA<br>TGGACTTTATACTGAGCCTCGCCCCATTGGCACCC<br>GTTACCTCACCCGTCCCCTGTAA*tgtgtgttaat*<br>*caataa*accggt | | ANVDFTVDNNGL<br>YTEPRPIGTRYL<br>TRPL |
| 2 | D418E | ggtaccaaaacaaatgttctcgtcacgtgggcatg<br>aatctgatgctgtttccctgcagacaatgcgagag<br>aatgaatcagaattcaaatatctgcttcactcacg<br>gacagaaagactgtttagagtgctttcccgtgtca<br>gaatctcaacccgtttctgtcgtcaaaaaggcgta<br>tcagaaactgtgctacattcatatatcatgggaa<br>aggtgccagacgcttgcactgcctgcgatctggtc<br>aatgtggatttggatgactgcatctttgaacaata<br>a*tgatttaaatcaggt*<u>ATG</u>GCTGCCGATGGTTAT<br>CTTCCAGATTGGCTCGAGGACAACCTCTCTGAGGG<br>CATTCGCGAGTGGTGGGACTTGAAACCTGGAGCCC<br>CGAAACCCAAAGCCAACCAGCAAAAGCAGGACGAC<br>GGCCGGGGTCTGGTGCTTCCTGGCTACAAGTACCT<br>CGGACCCTTCAACGGACTCGACAAGGGGGAGCCCG<br>TCAACGCGGCGGATGCAGCGGCCCTCGAGCACGAC<br>AAGGCCTACGACCAGCAGCTCAAAGCGGGTGACAA<br>TCCGTACCTGCGGTATAACCACGCCGACGCCGAGT<br>TTCAGGAGCGTCTGCAAGAAGATACGTCTTTTGGG<br>GGCAACCTCGGGCGAGCAGTCTTCCAGGCCAAGAA<br>GAGGGTTCTCGAACCTTTTGGTCTGGTTGAGGAAG<br>GTGCTAAG*ACG*GCTCCTGGAAAGAAACGTCCGGTA<br>GAGCAGTCGCCACAAGAGCCAGACTCCTCTCGGG<br>CATTGGCAAGACAGGCCAGCAGCCCGCTAAAAAGA<br>GACTCAATTTTGGTCAGACTGGCGACTCAGAGTCA<br>GTCCCCGACCCACAACCTCTCGGAGAACCTCCAGC<br>AACCCCCGCTGCTGTGGGACCTACTAC<u>AATG</u>GCTT<br>CAGGCGGTGGCGCACCAATGGCAGACAATAACGAA<br>GGCGCCGACGGAGTGGGTAATGCCTCAGGAAATTG<br>GCATTGCGATTCCACATGGCTGGGCGACAGAGTCA<br>TCACCACCAGCACCCGAACATGGGCCTTGCCCACC<br>TATAACAACCACCTCTACAAGCAAATCTCCAGTGC<br>TTCAACGGGGGCCAGCAACGACAACCACTACTTCG<br>GCTACAGCACCCCCTGGGGGTATTTTGATTTCAAC<br>AGATTCCACTGCCATTTCTCACCACGTGACTGGCA<br>GCGACTCATCAACAACAATTGGGGATTCCGGCCCA<br>AGAGACTCAACTTCAAGCTCTTCAACATCCAAGTC<br>AAGGAGGTCACGACGAATGATGGCGTCACGACCAT<br>CGCTAATAACCTTACCAGCACGGTTCAAGTCTTCT<br>CGGACTCGGAGTACCAGTTGCCGTACGTCCTCGGC<br>TCTGCGCACCAGGGCTGCCTCCCTCCGTTCCCGGC<br>GGACGTGTTCATGATTCCGCAGTACGGCTACCTAA<br>CGCTCAACAATGGCAGCCAGGCAGTGGGACGGTCA<br>TCCTTTTACTGCCTGGAATATTTCCCATCGCAGAT<br>GCTGAGAACGGGCAATAACTTTACCTTCAGCTACA<br>CCTTCGAGGAGGTGCCTTTCCACAGCAGCTACGCG<br>CACAGCCAGAGCCTGGACCGGCTGATGAATCCTCT<br>CATCGACCAGTACCTGTATTACCTGAACAGAACTC<br>AGAATCAGTCCGGAAGTGCCCAAAACAAGGACTTG<br>CTGTTTAGCCGGGGGTCTCCAGCTGGCATGTCTGT<br>TCAGCCCAAAAACTGGCTACCTGGACCCTGTTACC<br>GGCAGCAGCGCGTTTCTAAAACAAAAACAGACAAC<br>AACAACAGCAACTTTACCTGGACTGGTGCTTCAAA | 268 | <u>M</u>AADGYLPDWLE<br>DNLSEGIREWWD<br>LKPGAPKPKANQ<br>QKQDDGRGLVLP<br>GYKYLGPFNGLD<br>KGEPVNAADAAA<br>LEHDKAYDQQLK<br>AGDNPYLRYNHA<br>DAEFQERLQEDT<br>SFGGNLGRAVFQ<br>AKKRVLEPFGLV<br>EEGAKTAPGKKR<br>PVEQSPQEPDSS<br>SGIGKTGQQPAK<br>KRLNFGQTGDSE<br>SVPDPQPLGEPP<br>ATPAAVGPTTMA<br>SGGGAPMADNNE<br>GADGVGNASGNW<br>HCDSTWLGDRVI<br>TTSTRTWALPTY<br>NNHLYKQISSAS<br>TGASNDNHYFGY<br>STPWGYFDFNRF<br>HCHFSPRDWQRL<br>INNNWGFRPKRL<br>NFKLFNIQVKEV<br>TTNDGVTTIANN<br>LTSTVQVFSDSE<br>YQLPYVLGSAHQ<br>GCLPPFPADVFM<br>IPQYGYLTLNNG<br>SQAVGRSSFYCL<br>EYFPSQMLRTGN<br>NFTFSYTFEEVP<br>FHSSYAHSQSLD<br>RLMNPLIDQYLY<br>YLNRTQNQSGSA<br>QNKDLLFSRGSP<br>AGMSVQPKNWLP<br>GPCYRQQRVSKT<br>KTDNNNSNFTWT<br>GASKYNLNGRES<br>IINPGTAMASHK<br>DDKDKFFPMSGV<br>MIFGKESAGASN<br>TALDNVMITDEE<br>EIKATNPVATER<br>FGTVAVNLQSSS<br>TDPATGDVHVMG<br>ALPGMVWQDRDV<br>YLQGPIWAKIPH |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Muta-tion | Nucleic acid sequence of the synthesised fragment to clone into the AAV6 Rep Cap vector using restriction sites HindIII and AgeI | SEQ ID NO | Capsid protein sequence |
|---|---|---|---|---|
| | | ATATAACCTTAATGGGCGTGAATCTATAATCAACC CTGGCACTGCTATGGCCTCACACAAAGACGACAAA GACAAGTTCTTTCCCATGAGCGGTGTCATGATTTT TGGAAAGGAGAGCGCCGGAGCTTCAAACACTGCAT TGGACAATGTCATGATCACAGACGAAGAGGAAATC AAAGCCACTAACCCCGTGGCCACCGAAAGATTTGG GACTGTGGCAGTCAATCTCCAGAGCAGCAGCACAG ACCCTGCGACCGGAGATGTGCATGTTATGGGAGCC TTACCTGGAATGGTGTGGCAAGACAGAGACGTATA CCTGCAGGGTCCTATTTGGGCCAAAATTCCTCACA CGGATGGACACTTTCACCCGTCTCCTCTCATGGGC GGCTTTGGACTTAAGCACCCGCCTCCTCAGATCCT CATCAAAAACACGCCTGTTCCTGCGAATCCTCCGG CAGAGTTTTCGGCTACAAAGTTTGCTTCATTCATC ACCCAGTATTCCACAGGACAAGTGAGCGTGGAGAT TGAATGGGAGCTGCAGAAAGAAAACAGCAAACGCT GGAATCCCGAAGTGCAGTATACATCTAACTATGCA AAATCTGCCAACGTTGATTTCACTGTGGACAACAA TGGACTTTATACTGAGCCTCGCCCCATTGGCACCC GTTACCTCACCCGTCCCCTGTAAttgtgtgttaat caataa<span style="border:1px solid">accggt</span> | | TDGHFHPSPLMG GFGLKHPPPQIL IKNTPVPANPPA EFSATKFASFIT QYSTGQVSVEIE WELQKENSKRWN PEVQYTSNYAKS ANVDFTVDNNGL YTEPRPIGTRYL TRPL |
| 3 | D418N | ggtaccaaaacaaatgttctcgtcacgtgggcatg aatctgatgctgtttccctgcagacaatgcgagag aatgaatcagaattcaaatatctgcttcactcacg gacagaaagactgtttagagtgctttcccgtgtca gaatctcaacccgtttctgtcgtcaaaaaggcgta tcagaaactgtgctacattcatcatatcatgggaa aggtgccagacgcttgcactgcctgcgatctggtc aatgtggatttggatgactgcatctttgaacaata a_atgatttaaatcaggt_<u>ATG</u>GCTGCCGATGGTTAT CTTCCAGATTGGCTCGAGGACAACCTCTCTGAGGG CATTCGCGAGTGGTGGGACTTGAAACCTGGAGCCC CGAAACCCAAAGCCAACCAGCAAAAGCAGGACGAC GGCCGGGGTCTGGTGCTTCCTGGCTACAAGTACCT CGGACCCTTCAACGGACTCGACAAGGGGGAGCCCG TCAACGCGGCGGATGCAGCGGCCCTCGAGCACGAC AAGGCCTACGACCAGCAGCTCAAAGCGGGTGACAA TCCGTACCTGCGGTATAACCACGCCGACGCCGAGT TCAGGAGCGTCTGCAAGAAGATACGTCTTTTGGG GGCAACCTCGGGCGAGCAGTCTTCCAGGCCAAGAA GAGGGTTCTCGAACCTTTTGGTCTGGTTGAGGAAG GTGCTAAG_ACG_GCTCCTGGAAAGAAACGTCCGGTA GAGCAGTCGCCACAAGAGCCAGACTCCTCCTCGGG CATTGGCAAGACAGGCCAGCAGCCCGCTAAAAAGA GACTCAATTTTGGTCAGACTGGCGACTCAGAGTCA GTCCCCGACCCACAACCTCTCGGAGAACCTCCAGC AACCCCCGCTGCTGTGGGACCTACTACA<u>ATG</u>GCTT CAGGCGGTGGCGCACCAATGGCAGACAATAACGAA GGCGCCGACGGAGTGGGTAATGCCCTCAGGAAATTG GCATTGCGATTCCACATGGCTGGGCGACAGAGTCA TCACCACCAGCACCCGAACATGGGCCTTGCCCACC TATAACAACCACCTCTACAAGCAAATCTCCAGTGC TTCAACGGGGGCCAGCAACGACAACCACTACTTCG GCTACAGCACCCCCTGGGGGTATTTTGATTTCAAC AGATTCCACTGCCATTTCTCACCACGTGACTGGCA GCGACTCATCAACAACAATTGGGGATTCCGGCCCA AGAGACTCAACTTCAAGCTCTTCAACATCCAAGTC AAGGAGGTCACGACGAATGATGGCGTCACGACCAT CGCTAATAACCTTACCAGCACGGTTCAAGTCTTCT CGGACTCGGAGTACCAGTTGCCGTACGTCCTCGGC TCTGCGCACCAGGGCTGCCTCCCTCCGTTCCCGGC GGACGTGTTCATGATTCCGCAGTACGGCTACCTAA CGCTCAACAATGGCAGCCAGGCAGTGGGACGGTCA TCCTTTTACTGCCTGGAATATTTCCCATCGCAGAT GCTGAGAACGGGCAATAACTTTACCTTCAGCTACA CCTTCGAGAACGTGCCTTTCCACAGCAGCTACGCG | 269 | MAADGYLPDWLE DNLSEGIREWWD LKPGAPKPKANQ QKQDDGRGLVLP GYKYLGPFNGLD KGEPVNAADAAA LEHDKAYDQQLK AGDNPYLRYNHA DAEFQERLQEDT SFGGNLGRAVFQ AKKRVLEPFGLV EEGAKTAPGKKR PVEQSPQEPDSS SGIGKTGQQPAK KRLNFGQTGDSE SVPDPQPLGEPP ATPAAVGPTTMA SGGGAPMADNNE GADGVGNASGNW HCDSTWLGDRVI TTSTRTWALPTY NNHLYKQISSAS TGASNDNHYFGY STPWGYFDFNRF HCHFSPRDWQRL INNNWGFRPKRL NFKLFNIQVKEV TTNDGVTTIANN LTSTVQVFSDSE YQLPYVLGSAHQ GCLPPFPADVFM IPQYGYLTLNNG SQAVGRSSFYCL EYFPSQMLRTGN NFTFSYTFENVP FHSSYAHSQSLD RLMNPLIDQYLY YLNRTQNQSGSA QNKDLLFSRGSP AGMSVQPKNWLP GPCYRQQRVSKT KTDNNNSNFTWT GASKYNLNGRES IINPGTAMASHK DDKDKFFPMSGV |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Mutation | Nucleic acid sequence of the synthesised fragment to clone into the AAV6 Rep Cap vector using restriction sites HindIII and AgeI | SEQ ID NO | Capsid protein sequence |
|---|---|---|---|---|
| | | CACAGCCAGAGCCTGGACCGGCTGATGAATCCTCT CATCGACCAGTACCTGTATTACCTGAACAGAACTC AGAATCAGTCCGGAAGTGCCCAAAACAAGGACTTG CTGTTTAGCCGGGGGTCTCCAGCTGGCATGTCTGT TCAGCCCAAAAACTGGCTACCTGGACCCTGTTACC GGCAGCAGCGCGTTTCTAAAACAAAAACAGACAAC AACAACAGCAACTTTACCTGGACTGGTGCTTCAAA ATATAACCTTAATGGGCGTGAATCTATAATCAACC CTGGCACTGCTATGGCCTCACACAAAGACGACAAA GACAAGTTCTTTCCCATGAGCGGTGTCATGATTTT TGGAAAGGAGAGCGCCGGAGCTTCAAACACTGCAT TGGACAATGTCATGATCACAGACGAAGAGGAAATC AAAGCCACTAACCCCGTGGCCACCGAAAGATTTGG GACTGTGGCAGTCAATCTCCAGAGCAGCAGCACAG ACCCTGCGACCGGAGATGTGCATGTTATGGGAGCC TTACCTGGAATGGTGTGGCAAGACAGAGACGTATA CCTGCAGGGTCCTATTTGGGCCAAAATTCCTCACA CGGATGGACACTTTCACCCGTCCTCTCATGGGC GGCTTTGGACTTAAGCACCCGCCTCCTCAGATCCT CATCAAAAACACGCCTGTTCCTGCGAATCCTCCGG CAGAGTTTTCGGCTACAAAGTTTGCTTCATTCATC ACCCAGTATTCCACAGGACAAGTGAGCGTGGAGAT TGAATGGGAGCTGCAGAAAGAAAACAGCAAACGCT GGAATCCCGAAGTGCAGTATACATCTAACTATGCA AAATCTGCCAACGTTGATTTCACTGTGGACAACAA TGGACTTTATACTGAGCCTCGCCCCATTGGCACCC GTTACCTCACCCGTCCCCTGTAAttgtgtgttaat caataa accggt | | MIFGKESAGASN TALDNVMITDEE EIKATNPVATER FGTVAVNLQSSS TDPATGDVHVMG ALPGMVWQDRDV YLQGPIWAKIPH TDGHFHPSPLMG GFGLKHPPPQIL IKNTPVPANPPA EFSATKFASFIT QYSTGQVSVEIE WELQKENSKRWN PEVQYTSNYAKS ANVDFTVDNNGL YTEPRPIGTRYL TRPL |
| 4 | L584N | ggtaccaaaacaaatgttctcgtcacgtgggcatg aatctgatgctgtttccctgcagacaatgcgagag aatgaatcagaattcaaatatctgcttcactcacg gacagaaagactgtttagagtgcttccccgtgtca gaatctcaacccgtttctgtcgtcaaaaaggcgta tcagaaactgtgctacattcatatatcatgggaa aggtgccagacgcttgcactgcctgcgatctggtc aatgtggatttggatgactgcatctttgaacaata a atgatttaaatcaggt ATGGCTGCCGATGGTTAT CTTCCAGATTGGCTCGAGGACAACCTCTCTGAGGG CATTCGCGAGTGGTGGGACTTGAAACCTGGAGCCC CGAAACCCAAAGCCAACCAGCAAAAGCAGGACGAC GGCCGGGGTCTGGTGCTTCCTGGCTACAAGTACCT CGGACCCTTCAACGGACTCGACAAGGGGGAGCCCG TCAACGCGGCGGATGCAGCGGCCCTCGAGCACGAC AAGGCCTACGACCAGCAGCTCAAAGCGGGTGACAA TCCGTACCTGCGGTATAACCACGCCGACGCCGAGT TTCAGGAGCGTCTGCAAGAAGATACGTCTTTTGGG GGCAACCTCGGGCGAGCAGTCTTCCAGGCCAAGAA GAGGGTTCTCGAACCTTTTGGTCTGGTTGAGGAAG GTGCTAAG*ACG*GCTCCTGGAAAGAAACGTCCGGTA GAGCAGTCGCCACAAGAGCCAGACTCCTCCTCGGG CATTGGCAAGACAGGCCAGCAGCCCGCTAAAAAGA GACTCAATTTTGGTCAGACTGGCGACTCAGAGTCA GTCCCCGACCCACAACCTCTCGGAGAACCTCCAGC AACCCCCGCTGCTGTGGGACCTACTACATGGCTT CAGGCGGTGGCGCACCAATGGCAGACAATAACGAA GGCGCCGACGGAGTGGGTAATGCCTCAGGAAATTG GCATTGCGATTCCACATGGCTGGGCGACAGAGTCA TCACCACCAGCACCCGAACATGGGCCTTGCCCACC TATAACAACCACCTCTACAAGCAAATCTCCAGTGC TTCAACGGGGGCCAGCAACGACAACCACTACTTCG GCTACAGCACCCCCTGGGGGTATTTTGATTTCAAC AGATTCCACTGCCATTTCTCACCACGTGACTGGCA GCGACTCATCAACAACAATTGGGGATTCCGGCCCA AGAGACTCAACTTCAAGCTCTTCAACATCCAAGTC AAGGAGGTCACGACGAATGATGGCGTCACGACCAT CGCTAATAACCTTACCAGCACGGTTCAAGTCTTCT | 270 | MAADGYLPDWLE DNLSEGIREWWD LKPGAPKPKANQ QKQDDGRGLVLP GYKYLGPFNGLD KGEPVNAADAAA LEHDKAYDQQLK AGDNPYLRYNHA DAEFQERLQEDT SFGGNLGRAVFQ AKKRVLEPFGLV EEGAK*T*APGKKR PVEQSPQEPDSS SGIGKTGQQPAK KRLNFGQTGDSE SVPDPQPLGEPP ATPAAVGPTTMA SGGGAPMADNNE GADGVGNASGNW HCDSTWLGDRVI TTSTRTWALPTY NNHLYKQISSAS TGASNDNHYFGY STPWGYFDFNRF HCHFSPRDWQRL INNNWGFRPKRL NFKLFNIQVKEV TTNDGVTTIANN LTSTVQVFSDSE YQLPYVLGSAHQ GCLPPFPADVFM IPQYGYLTLNNG SQAVGRSSFYCL EYFPSQMLRTGN NFTFSYTFEDVP FHSSYAHSQSLD RLMNPLIDQYLY YLNRTQNQSGSA |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Muta- tion | Nucleic acid sequence of the synthesised fragment to clone into the AAV6 Rep Cap vector using restriction sites HindIII and AgeI | SEQ ID NO | Capsid protein sequence |
|---|---|---|---|---|
| | | CGGACTCGGAGTACCAGTTGCCGTACGTCCTCGGC | | QNKDLLFSRGSP |
| | | TCTGCGCACCAGGGCTGCCTCCCTCCGTTCCCGGC | | AGMSVQPKNWLP |
| | | GGACGTGTTCATGATTCCGCAGTACGGCTACCTAA | | GPCYRQQRVSKT |
| | | CGCTCAACAATGGCAGCCAGGCAGTGGGACGGTCA | | KTDNNNSNFTWT |
| | | TCCTTTTACTGCCTGGAATATTTCCCATCGCAGAT | | GASKYNLNGRES |
| | | GCTGAGAACGGGCAATAACTTTACCTTCAGCTACA | | IINPGTAMASHK |
| | | CCTTCGAGGACGTGCCTTTCCACAGCAGCTACGCG | | DDKDKFFPMSGV |
| | | CACAGCCAGAGCCTGGACCGGCTGATGAATCCTCT | | MIFGKESAGASN |
| | | CATCGACCAGTACCTGTATTACCTGAACAGAACTC | | TALDNVMITDEE |
| | | AGAATCAGTCCGGAAGTGCCCAAAACAAGGACTTG | | EIKATNPVATER |
| | | CTGTTTAGCCGGGGGTCTCCAGCTGGCATGTCTGT | | FGTVAVNNQSSS |
| | | TCAGCCCAAAAACTGGCTACCTGGACCCTGTTACC | | TDPATGDVHVMG |
| | | GGCAGCAGCGCGTTTCTAAAACAAAAACAGACAAC | | ALPGMVWQDRDV |
| | | AACAACAGCAACTTTACCTGGACTGGTGCTTCAAA | | YLQGPIWAKIPH |
| | | ATATAACCTTAATGGGCGTGAATCTATAATCAACC | | TDGHFHPSPLMG |
| | | CTGGCACTGCTATGGCCTCACACAAAGACGACAAA | | GFGLKHPPPQIL |
| | | GACAAGTTCTTTCCCATGAGCGGTGTCATGATTTT | | IKNTPVPANPPA |
| | | TGGAAAGGAGAGCGCCGGAGCTTCAAACACTGCAT | | EFSATKFASFIT |
| | | TGGACAATGTCATGATCACAGACGAAGAGGAAATC | | QYSTGQVSVEIE |
| | | AAAGCCACTAACCCCGTGGCCACCGAAAGATTTGG | | WELQKENSKRWN |
| | | GACTGTGGCAGTCAATAACCAGAGCAGCAGCACAG | | PEVQYTSNYAKS |
| | | ACCCTGCGACCGGAGATGTGCATGTTATGGGAGCC | | ANVDFTVDNNGL |
| | | TTACCTGGAATGGTGTGGCAAGACAGAGACGTATA | | YTEPRPIGTRYL |
| | | CCTGCAGGGTCCTATTTGGGCCAAAATTCCTCACA | | TRPL |
| | | CGGATGGACACTTTCACCCGTCTCCTCTCATGGGC | | |
| | | GGCTTTGGACTTAAGCACCCGCCTCCTCAGATCCT | | |
| | | CATCAAAAACACGCCTGTTCCTGCGAATCCTCCGG | | |
| | | CAGAGTTTTCGGCTACAAAGTTTGCTTCATTCATC | | |
| | | ACCCAGTATTCCACAGGACAAGTGAGCGTGGAGAT | | |
| | | TGAATGGGAGCTGCAGAAAGAAAACAGCAAACGCT | | |
| | | GGAATCCCGAAGTGCAGTATACATCTAACTATGCA | | |
| | | AAATCTGCCAACGTTGATTTCACTGTGGACAACAA | | |
| | | TGGACTTTATACTGAGCCTCGCCCCATTGGCACCC | | |
| | | GTTACCTCACCCGTCCCCTGTAAttgtgtgttaat | | |
| | | caataaaccggt | | |
| 5 | L584H | ggtaccaaaacaaatgttctcgtcacgtgggcatg | 271 | MAADGYLPDWLE |
| | | aatctgatgctgtttccctgcagacaatgcgagag | | DNLSEGIREWWD |
| | | aatgaatcagaattcaaatatctgcttcactcacg | | LKPGAPKPKANQ |
| | | gacagaaagactgtttagagtgctttcccgtgtca | | QKQDDGRGLVLP |
| | | gaatctcaacccgtttctgtcgtcaaaaaggcgta | | GYKYLGPFNGLD |
| | | tcagaaactgtgctacattcatcatatcatgggaa | | KGEPVNAADAAA |
| | | aggtgccagacgcttgcactgcctgcgatctggtc | | LEHDKAYDQQLK |
| | | aatgtggatttggatgactgcatctttgaacaata | | AGDNPYLRYNHA |
| | | a*atgatttaaatcaggt*ATGGCTGCCGATGGTTAT | | DAEFQERLQEDT |
| | | CTTCCAGATTGGCTCGAGGACAACCTCTCTGAGGG | | SFGGNLGRAVFQ |
| | | CATTCGCGAGTGGTGGGACTTGAAACCTGGAGCCC | | AKKRVLEPFGLV |
| | | CGAAACCCAAAGCCAACCAGCAAAAGCAGGACGAC | | EEGAK*T*APGKKR |
| | | GGCCGGGGTCTGGTGCTTCCTGGCTACAAGTACCT | | PVEQSPQEPDSS |
| | | CGGACCCTTCAACGGACTCGACAAGGGGGAGCCCG | | SGIGKTGQQPAK |
| | | TCAACGCGGCGGATGCAGCGGCCCTCGAGCACGAC | | KRLNFGQTGDSE |
| | | AAGGCCTACGACCAGCAGCTCAAAGCGGGTGACAA | | SVPDPQPLGEPP |
| | | TCCGTACCTGCGGGTATAACCACGCCGACGCCGAGT | | ATPAAVGPTTMA |
| | | TTCAGGAGCGTCTGCAAGAAGATACGTCTTTTGGG | | SGGGAPMADNNE |
| | | GGCAACCTCGGGCGAGCAGTCTTCCAGGCCAAGAA | | GADGVGNASGNW |
| | | GAGGGTTCTCGAACCTTTTGGTCTGGTTGAGGAAG | | HCDSTWLGDRVI |
| | | GTGCTAAG*ACG*GCTCCTGGAAAGAAACGTCCGGTA | | TTSTRTWALPTY |
| | | GAGCAGTCGCCACAAGAGCCAGACTCCTCCTGGG | | NNHLYKQISSAS |
| | | CATTGGCAAGACAGGCCAGCAGCCCGCTAAAAAGA | | TGASNDNHYFGY |
| | | GACTCAATTTTGGTCAGACTGGCGACTCAGAGTCA | | STPWGYFDFNRF |
| | | GTCCCCGACCCACAACCTCTCGGAGAACCTCCAGC | | HCHFSPRDWQRL |
| | | AACCCCCGCTGTGTGGGACCTACTACAATGGCTT | | INNNWGFRPKRL |
| | | CAGGCGGTGGCGCACCAATGGCAGACAATAACGAA | | NFKLFNIQVKEV |
| | | GGCGCCGACGGAGTGGGTAATGCCTCAGGAAATTG | | TTNDGVTTIANN |
| | | GCATTGCGATTCCACATGGCTGGGCGACAGAGTCA | | LTSTVQVFSDSE |
| | | TCACCACCAGCACCCGAACATGGGCCTTGCCCACC | | YQLPYVLGSAHQ |
| | | TATAACAACCACCTCTACAAGCAAATCTCCAGTGC | | GCLPPFPADVFM |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Mutation | Nucleic acid sequence of the synthesised fragment to clone into the AAV6 Rep Cap vector using restriction sites HindIII and AgeI | SEQ ID NO | Capsid protein sequence |
|---|---|---|---|---|
| | | TTCAACGGGGCCAGCAACGACAACCACTACTTCG<br>GCTACAGCACCCCTGGGGGTATTTTGATTTCAAC<br>AGATTCCACTGCCATTTCTCACCACGTGACTGGCA<br>GCGACTCATCAACAACAATTGGGGATTCCGGCCCA<br>AGAGACTCAACTTCAAGCTCTTCAACATCCAAGTC<br>AAGGAGGTCACGACGAATGATGGCGTCACGACCAT<br>CGCTAATAACCTTACCAGCACGGTTCAAGTCTTCT<br>CGGACTCGGAGTACCAGTTGCCGTACGTCCTCGGC<br>TCTGCGCACCAGGGCTGCCTCCCTCCGTTCCCGGC<br>GGACGTGTTCATGATTCCGCAGTACGGCTACCTAA<br>CGCTCAACAATGGCAGCCAGGCAGTGGGACGGTCA<br>TCCTTTTACTGCCTGGAATATTTCCCATCGCAGAT<br>GCTGAGAACGGGCAATAACTTTACCTTCAGCTACA<br>CCTTCGAGGACGTGCCTTTCCACAGCAGCTACGCG<br>CACAGCCAGAGCCTGGACCGGCTGATGAATCCTCT<br>CATCGACCAGTACCTGTATTACCTGAACAGAACTC<br>AGAATCAGTCCGGAAGTGCCCAAAACAAGGACTTG<br>CTGTTTAGCCGGGGGTCTCCAGCTGGCATGTCTGT<br>TCAGCCCAAAAACTGGCTACCTGGACCCTGTTACC<br>GGCAGCAGCGCGTTTCTAAAACAAAAACAGACAAC<br>AACAACAGCAACTTTACCTGGACTGGTGCTTCAAA<br>ATATAACCTTAATGGGCGTGAATCTATAATCAACC<br>CTGGCACTGCTATGGCCTCACACAAAGACGACAAA<br>GACAAGTTCTTTCCCATGAGCGGTGTCATGATTTT<br>TGGAAAGGAGAGCGCCGGAGCTTCAAACACTGCAT<br>TGGACAATGTCATGATCACAGACGAAGAGGAAATC<br>AAAGCCACTAACCCCGTGGCCACCGAAAGATTTGG<br>GACTGTGGCAGTCAATCACCAGAGCAGCAGCACAG<br>ACCCTGCGACCGGAGATGTGCATGTTATGGGAGCC<br>TTACCTGGAATGGTGTGGCAAGACAGAGACGTATA<br>CCTGCAGGGTCCTATTTGGGCCAAAATTCCTCACA<br>CGGATGGACACTTTCACCCGTCTCCTCTCATGGGC<br>GGCTTTGGACTTAAGCACCCGCCTCCTCAGATCCT<br>CATCAAAAACACGCCTGTTCCTGCGAATCCTCCGG<br>CAGAGTTTTCGGCTACAAAGTTTGCTTCATTCATC<br>ACCCAGTATTCCACAGGACAAGTGAGCGTGGAGAT<br>TGAATGGGAGCTGCAGAAAGAAAACAGCAAACGCT<br>GGAATCCCGAAGTGCAGTATACATCTAACTATGCA<br>AAATCTGCCAACGTTGATTTCACTGTGGACAACAA<br>TGGACTTTATACTGAGCCTCGCCCCATTGGCACCC<br>GTTACCTCACCCGTCCCCTGTAAttgtgtgttaat<br>caataa<span style="border:1px solid">accggt</span> | | IPQYGYLTLNNG<br>SQAVGRSSFYCL<br>EYFPSQMLRTGN<br>NFTFSYTFEDVP<br>FHSSYAHSQSLD<br>RLMNPLIDQYLY<br>YLNRTQNQSGSA<br>QNKDLLFSRGSP<br>AGMSVQPKNWLP<br>GPCYRQQRVSKT<br>KTDNNNSNFTWT<br>GASKYNLNGRES<br>IINPGTAMASHK<br>DDKDKFFPMSGV<br>MIFGKESAGASN<br>TALDNVMITDEE<br>EIKATNPVATER<br>FGTVAVNHQSSS<br>TDPATGDVHVMG<br>ALPGMVWQDRDV<br>YLQGPIWAKIPH<br>TDGHFHPSPLMG<br>GFGLKHPPPQIL<br>IKNTPVPANPPA<br>EFSATKFASFIT<br>QYSTGQVSVEIE<br>WELQKENSKRWN<br>PEVQYTSNYAKS<br>ANVDFTVDNNGL<br>YTEPRPIGTRYL<br>TRPL |
| 6 | L584D | ggtaccaaaacaaatgttctcgtcacgtgggcatg<br>aatctgatgctgtttccctgcagacaatgcgagag<br>aatgaatcagaattcaaatatctgcttcactcacg<br>gacagaaagactgtttagagtgctttcccgtgtca<br>gaatctcaacccgtttctgtcgtcaaaaaggcgta<br>tcagaaactgtgctacattcatcatatcatgggaa<br>aggtgccagacgcttgcactgcctgcgatctggtc<br>aatgtggatttggatgactgcatctttgaacaata<br>a*atgatttaaatcaggt*<u>ATG</u>GCTGCCGATGGTTAT<br>CTTCCAGATTGGCTCGAGGACAACCTCTCTGAGGG<br>CATTCGCGAGTGGTGGGACTTGAAACCTGGAGCCC<br>CGAAACCCAAAGCCAACCAGCAAAAGCAGGACGAC<br>GGCCGGGGTCTGGTGCTTCCTGGCTACAAGTACCT<br>CGGACCCTTCAACGGACTCGACAAGGGGGAGCCCG<br>TCAACGCGGCGGATGCAGCGGCCCTCGAGCACGAC<br>AAGGCCTACGACCAGCAGCTCAAAGCGGGTGACAA<br>TCCGTACCTGCGGTATAACCACGCCGACGCCGAGT<br>TTCAGGAGCGTCTGCAAGAAGATACGTCTTTTGGG<br>GGCAACCTCGGGCGAGCAGTCTTCCAGGCCAAGAA<br>GAGGGTTCTCGAACCTTTTGGTCTGGTTGAGGAAG<br>GTGCTAAG_ACG_GCTCCTGGAAAGAAACGTCCGGTA<br>GAGCAGTCGCCACAAGAGCCAGACTCCTCCTCGGG<br>CATTGGCAAGACAGGCCAGCAGCCCGCTAAAAAGA<br>GACTCAATTTTGGTCAGACTGGCGACTCAGAGTCA | 272 | <u>M</u>AADGYLPDWLE<br>DNLSEGIREWWD<br>LKPGAPKPKANQ<br>QKQDDGRGLVLP<br>GYKYLGPFNGLD<br>KGEPVNAADAAA<br>LEHDKAYDQQLK<br>AGDNPYLRYNHA<br>DAEFQERLQEDT<br>SFGGNLGRAVFQ<br>AKKRVLEPFGLV<br>EEGAK_T_APGKKR<br>PVEQSPQEPDSS<br>SGIGKTGQQPAK<br>KRLNFGQTGDSE<br>SVPDPQPLGEPP<br>ATPAAVGPTTMA<br>SGGGAPMADNNE<br>GADGVGNASGNW<br>HCDSTWLGDRVI<br>TTSTRTWALPTY<br>NNHLYKQISSAS<br>TGASNDNHYFGY<br>STPWGYFDFNRF |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Muta-tion | Nucleic acid sequence of the synthesised fragment to clone into the AAV6 Rep Cap vector using restriction sites HindIII and AgeI | SEQ ID NO | Capsid protein sequence |
|---|---|---|---|---|
| | | GTCCCCGACCCACAACCTCTCGGAGAACCTCCAGC | | HCHFSPRDWQRL |
| | | AACCCCCGCTGCTGTGGGACCTACTACAATGGCTT | | INNNWGFRPKRL |
| | | CAGGCGGTGGCGCACCAATGGCAGACAATAACGAA | | NFKLFNIQVKEV |
| | | GGCGCCGACGGAGTGGGTAATGCCCTCAGGAAATTG | | TTNDGVTTIANN |
| | | GCATTGCGATTCCACATGGCTGGGCGACAGAGTCA | | LTSTVQVFSDSE |
| | | TCACCACCAGCACCCGAACATGGGCCTTGCCCACC | | YQLPYVLGSAHQ |
| | | TATAACAACCACCTCTACAAGCAAATCTCCAGTGC | | GCLPPFPADVFM |
| | | TTCAACGGGGGCCAGCAACGACAACCACTACTTCG | | IPQYGYLTLNNG |
| | | GCTACAGCACCCCCTGGGGGTATTTTGATTTCAAC | | SQAVGRSSFYCL |
| | | AGATTCCACTGCCATTTCTCACCACGTGACTGGCA | | EYFPSQMLRTGN |
| | | GCGACTCATCAACAACAATTGGGGATTCCGGCCCA | | NFTFSYTFEDVP |
| | | AGAGACTCAACTTCAAGCTCTTCAACATCCAAGTC | | FHSSYAHSQSLD |
| | | AAGGAGGTCACGACGAATGATGGCGTCACGACCAT | | RLMNPLIDQYLY |
| | | CGCTAATAACCTTACCAGCACGGTTCAAGTCTTCT | | YLNRTQNQSGSA |
| | | CGGACTCGGAGTACCAGTTGCCGTACGTCCTCGGC | | QNKDLLFSRGSP |
| | | TCTGCGCACCAGGGCTGCCTCCCTCCGTTCCCGGC | | AGMSVQPKNWLP |
| | | GGACGTGTTCATGATTCCGCAGTACGGCTACCTAA | | GPCYRQQRVSKT |
| | | CGCTCAACAATGGCAGCCAGGCAGTGGGACGGTCA | | KTDNNNSNFTWT |
| | | TCCTTTTACTGCCTGGAATATTTCCCATCGCAGAT | | GASKYNLNGRES |
| | | GCTGAGAACGGGCAATAACTTTACCTTCAGCTACA | | IINPGTAMASHK |
| | | CCTTCGAGGACGTGCCTTTCCACAGCAGCTACGCG | | DDKDKFFPMSGV |
| | | CACAGCCAGAGCCTGGACCGGCTGATGAATCCTCT | | MIFGKESAGASN |
| | | CATCGACCAGTACCTGTATTACCTGAACAGAACTC | | TALDNVMITDEE |
| | | AGAATCAGTCCGGAAGTGCCCAAAACAAGGACTTG | | EIKATNPVATER |
| | | CTGTTTAGCCGGGGGTCTCCAGCTGGCATGTCTGT | | FGTVAVNDQSSS |
| | | TCAGCCCAAAAACTGGCTACCTGGACCCTGTTACC | | TDPATGDVHVMG |
| | | GGCAGCAGCGCGTTTCTAAAACAAAAACAGACAAC | | ALPGMVWQDRDV |
| | | AACAACAGCAACTTTACCTGGACTGGTGCTTCAAA | | YLQGPIWAKIPH |
| | | ATATAACCTTAATGGGCGTGAATCTATAATCAACC | | TDGHFHPSPLMG |
| | | CTGGCACTGCTATGGCCTCACACAAAGACGACAAA | | GFGLKHPPPQIL |
| | | GACAAGTTCTTTCCCATGAGCGGTGTCATGATTTT | | IKNTPVPANPPA |
| | | TGGAAAGGAGAGCGCCGGAGCTTCAAACACTGCAT | | EFSATKFASFIT |
| | | TGGACAATGTCATGATCACAGACGAAGAGGAAATC | | QYSTGQVSVEIE |
| | | AAAGCCACTAACCCCGTGGCCACCGAAAGATTTGG | | WELQKENSKRWN |
| | | GACTGTGGCAGTCAATGACCAGAGCAGCAGCACAG | | PEVQYTSNYAKS |
| | | ACCCTGCGACCGGAGATGTGCATGTTATGGGAGCC | | ANVDFTVDNNGL |
| | | TTACCTGGAATGGTGTGGCAAGACAGAGACGTATA | | YTEPRPIGTRYL |
| | | CCTGCAGGGTCCTATTTGGGCCAAAATTCCTCACA | | TRPL |
| | | CGGATGGACACTTTCACCCGTCTCCTCTCATGGGC | | |
| | | GGCTTTGGACTTAAGCACCCGCCTCCTCAGATCCT | | |
| | | CATCAAAAACACGCCTGTTCCTGCGAATCCTCCGG | | |
| | | CAGAGTTTTCGGCTACAAAGTTTGCTTCATTCATC | | |
| | | ACCCAGTATTCCACAGGACAAGTGAGCGTGGAGAT | | |
| | | TGAATGGGAGCTGCAGAAAGAAAACAGCAAACGCT | | |
| | | GGAATCCCGAAGTGCAGTATACATCTAACTATGCA | | |
| | | AAATCTGCCAACGTTGATTTCACTGTGGACAACAA | | |
| | | TGGACTTTATACTGAGCCTCGCCCCATTGGCACCC | | |
| | | GTTACCTCACCCGTCCCCTGTAATTGTGTGTTAAT | | |
| | | CAATAA<u>ACCGGT</u> | | |
| 7 | V598L | ggtaccaaaacaaatgttctcgtcacgtgggcatg | 273 | <u>M</u>AADGYLPDWLE |
| | | aatctgatgctgtttccctgcagacaatgcgagag | | DNLSEGIREWWD |
| | | aatgaatcagaattcaaatatctgcttcactcacg | | LKPGAPKPKANQ |
| | | gacagaaagactgtttagagtgctttccgtgtca | | QKQDDGRGLVLP |
| | | gaatctcaacccgtttctgtcgtcaaaaaggcgta | | GYKYLGPFNGLD |
| | | tcagaaactgtgctacattcatcatatcatgggaa | | KGEPVNAADAAA |
| | | aggtgccagacgcttgcactgcctgcgatctggtc | | LEHDKAYDQQLK |
| | | aatgtggatttggatgactgcatctttgaacaata | | AGDNPYLRYNHA |
| | | a*atgatttaaatcaggt*<u>ATG</u>GCTGCCGATGGTTAT | | DAEFQERLQEDT |
| | | CTTCCAGATTGGCTCGAGGACAACCTCTCTGAGGG | | SFGGNLGRAVFQ |
| | | CATTCGCGAGTGGTGGGACTTGAAACCTGGAGCCC | | AKKRVLEPFGLV |
| | | CGAAACCCAAAGCCAACCAGCAAAAGCAGGACGAC | | EEGAK*T*APGKKR |
| | | GGCCGGGGTCTGGTGCTTCCTGGCTACAAGTACCT | | PVEQSPQEPDSS |
| | | CGGACCCTTCAACGGACTCGACAAGGGGGAGCCCG | | SGIGKTGQQPAK |
| | | TCAACGCGGCGGATGCAGCGGCCCTCGAGCACGAC | | KRLNFGQTGDSE |
| | | AAGGCCTACGACCAGCAGCTCAAAGCGGGTGACAA | | SVPDPQPLGEPP |
| | | TCCGTACCTGCGGTATAACCACGCCGACGCCGAGT | | ATPAAVGPTT<u>M</u>A |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Mutation | Nucleic acid sequence of the synthesised fragment to clone into the AAV6 Rep Cap vector using restriction sites HindIII and AgeI | SEQ ID NO | Capsid protein sequence |
|---|---|---|---|---|
| | | TTCAGGAGCGTCTGCAAGAAGATACGTCTTTTGGG<br>GGCAACCTCGGGCGAGCAGTCTTCCAGGCCAAGAA<br>GAGGGTTCTCGAACCTTTTGGTCTGGTTGAGGAAG<br>GTGCTAAG*ACG*GCTCCTGGAAAGAAACGTCCGGTA<br>GAGCAGTCGCCACAAGAGCCAGACTCCTCCTCGGG<br>CATTGGCAAGACAGGCCAGCAGCCCGCTAAAAAGA<br>GACTCAATTTTGGTCAGACTGGCGACTCAGAGTCA<br>GTCCCCGACCCACAACCTCTCGGAGAACCTCCAGC<br>AACCCCGCTGCTGTGGGACCTACTACATGGCTT<br>CAGGCGGTGGCGCACCAATGGCAGACAATAACGAA<br>GGCGCCGACGGAGTGGGTAATGCCTCAGGAAATTG<br>GCATTGCGATTCCACATGGCTGGGCGACAGAGTCA<br>TCACCACCAGCACCCGAACATGGGCCTTGCCCACC<br>TATAACAACCACCTCTACAAGCAAATCTCCAGTGC<br>TTCAACGGGGGCCAGCAACGACAACCACTACTTCG<br>GCTACAGCACCCCCTGGGGGTATTTTGATTTCAAC<br>AGATTCCACTGCCATTTCTCACCACGTGACTGGCA<br>GCGACTCATCAACAACAATTGGGGATTCCGGCCCA<br>AGAGACTCAACTTCAAGCTCTTCAACATCCAAGTC<br>AAGGAGGTCACGACGAATGATGGCGTCACGACCAT<br>CGCTAATAACCTTACCAGCACGGTTCAAGTCTTCT<br>CGGACTCGGAGTACCAGTTGCCGTACGTCCTCGGC<br>TCTGCGCACCAGGGCTGCCTCCCTCCGTTCCCGGC<br>GGACGTGTTCATGATTCCGCAGTACGGCTACCTAA<br>CGCTCAACAATGGCAGCCAGGCAGTGGGACGGTCA<br>TCCTTTTACTGCCTGGAATATTTCCCATCGCAGAT<br>GCTGAGAACGGGCAATAACTTTACCTTCAGCTACA<br>CCTTCGAGGACGTGCCTTTCCACAGCAGCTACGCG<br>CACAGCCAGAGCCTGGACCGGCTGATGAATCCTCT<br>CATCGACCAGTACCTGTATTACCTGAACAGAACTC<br>AGAATCAGTCCGGAAGTGCCCAAAACAAGGACTTG<br>CTGTTTAGCCGGGGGTCTCCAGCTGGCATGTCTGT<br>TCAGCCCAAAAACTGGCTACCTGGACCCTGTTACC<br>GGCAGCAGCGCGTTTCTAAAACAAAAACAGACAAC<br>AACAACAGCAACTTTACCTGGACTGGTGCTTCAAA<br>ATATAACCTTAATGGGCGTGAATCTATAATCAACC<br>CTGGCACTGCTATGGCCTCACACAAAGACGACAAA<br>GACAAGTTCTTTCCCATGAGCGGTGTCATGATTTT<br>TGGAAAGGAGAGCGCCGGAGCTTCAAACACTGCAT<br>TGGACAATGTCATGATCACAGACGAAGAGGAAATC<br>AAAGCCACTAACCCCGTGGCCACCGAAAGATTTGG<br>GACTGTGGCAGTCAATCTCCAGAGCAGCAGCACAG<br>ACCCTGCGACCGGAGATGTGCATCTTATGGGAGCC<br>TTACCTGGAATGGTGTGGCAAGACAGAGACGTATA<br>CCTGCAGGGTCCTATTTGGGCCAAAATTCCTCACA<br>CGGATGGACACTTTCACCCGTCTCCTCTCATGGGC<br>GGCTTTGGACTTAAGCACCCGCCTCCTCAGATCCT<br>CATCAAAAACACGCCTGTTCCTGCGAATCCTCCGG<br>CAGAGTTTTCGGCTACAAAGTTTGCTTCATTCATC<br>ACCCAGTATTCCACAGGACAAGTGAGCGTGGAGAT<br>TGAATGGGAGCTGCAGAAAGAAAACAGCAAACGCT<br>GGAATCCCGAAGTGCAGTATACATCTAACTATGCA<br>AAATCTGCCAACGTTGATTTCACTGTGGACAACAA<br>TGGACTTTATACTGAGCCTCGCCCCATTGGCACCC<br>GTTACCTCACCCGTCCCCTGTAAttgtgtgttaat<br>caataa accggt | | SGGGAPMADNNE<br>GADGVGNASGNW<br>HCDSTWLGDRVI<br>TTSTRTWALPTY<br>NNHLYKQISSAS<br>TGASNDNHYFGY<br>STPWGYFDFNRF<br>HCHFSPRDWQRL<br>INNNWGFRPKRL<br>NFKLFNIQVKEV<br>TTNDGVTTIANN<br>LTSTVQVFSDSE<br>YQLPYVLGSAHQ<br>GCLPPFPADVFM<br>IPQYGYLTLNNG<br>SQAVGRSSFYCL<br>EYFPSQMLRTGN<br>NFTFSYTFEDVP<br>FHSSYAHSQSLD<br>RLMNPLIDQYLY<br>YLNRTQNQSGSA<br>QNKDLLFSRGSP<br>AGMSVQPKNWLP<br>GPCYRQQRVSKT<br>KTDNNNSNFTWT<br>GASKYNLNGRES<br>IINPGTAMASHK<br>DDKDKFFPMSGV<br>MIFGKESAGASN<br>TALDNVMITDEE<br>EIKATNPVATER<br>FGTVAVNLQSSS<br>TDPATGDVHLMG<br>ALPGMVWQDRDV<br>YLQGPIWAKIPH<br>TDGHFHPSPLMG<br>GFGLKHPPPQIL<br>IKNTPVPANPPA<br>EFSATKFASFIT<br>QYSTGQVSVEIE<br>WELQKENSKRWN<br>PEVQYTSNYAKS<br>ANVDFTVDNNGL<br>YTEPRPIGTRYL<br>TRPL |
| 8 | V598I | ggtaccaaaacaaatgttctcgtcacgtgggcatg<br>aatctgatgctgtttccctgcagacaatgcgagag<br>aatgaatcagaattcaaatatctgcttcactcacg<br>gacagaaagactgtttagagtgctttcccgtgtca<br>gaatctcaacccgtttctgtcgtcaaaaaggcgta<br>tcagaaactgtgctacattcatatatcatgggaa<br>aggtgccagacgcttgcactgcctgcgatctggtc<br>aatgtggatttggatgactgcatctttgaacaata<br>a*atgatttaaatcaggt*<u>ATG</u>GCTGCCGATGGTTAT<br>CTTCCAGATTGGCTCGAGGACAACCTCTCTGAGGG | 274 | <u>M</u>AADGYLPDWLE<br>DNLSEGIREWWD<br>LKPGAPKPKANQ<br>QKQDDGRGLVLP<br>GYKYLGPFNGLD<br>KGEPVNAADAAA<br>LEHDKAYDQQLK<br>AGDNPYLRYNHA<br>DAEFQERLQEDT<br>SFGGNLGRAVFQ |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Muta- tion | Nucleic acid sequence of the synthesised fragment to clone into the AAV6 Rep Cap vector using restriction sites HindIII and AgeI | SEQ ID NO | Capsid protein sequence |
|---|---|---|---|---|
| | | CATTCGCGAGTGGTGGGACTTGAAACCTGGAGCCC<br>CGAAACCCAAAGCCAACCAGCAAAAGCAGGACGAC<br>GGCCGGGGTCTGGTGCTTCCTGGCTACAAGTACCT<br>CGGACCCTTCAACGGACTCGACAAGGGGGAGCCCG<br>TCAACGCGGCGGATGCAGCGGCCCTCGAGCACGAC<br>AAGGCCTACGACCAGCAGCTCAAAGCGGGTGACAA<br>TCCGTACCTGCGGTATAACCACGCCGACGCCGAGT<br>TTCAGGAGCGTCTGCAAGAAGATACGTCTTTTGGG<br>GGCAACCTCGGGCGAGCAGTCTTCCAGGCCAAGAA<br>GAGGGTTCTCGAACCTTTTGGTCTGGTTGAGGAAG<br>GTGCTAAG*ACG*GCTCCTGGAAAGAAACGTCCGGTA<br>GAGCAGTCGCCACAAGAGCCAGACTCCTCCTCGGG<br>CATTGGCAAGACAGGCCAGCAGCCCGCTAAAAAGA<br>GACTCAATTTTGGTCAGACTGGCGACTCAGAGTCA<br>GTCCCCGACCCACAACCTCTCGGAGAACCTCCAGC<br>AACCCCCGCTGCTGTGGGACCTACTAC<u>AATG</u>GCTT<br>CAGGCGGTGGCGCACCAATGGCAGACAATAACGAA<br>GGCGCCGACGGAGTGGGTAATGCCTCAGGAAATTG<br>GCATTGCGATTCCACATGGCTGGGCGACAGAGTCA<br>TCACCACCAGCACCCGAACATGGGCCTTGCCCACC<br>TATAACAACCACCTCTACAAGCAAATCTCCAGTGC<br>TTCAACGGGGGCCAGCAACGACAACCACTACTTCG<br>GCTACAGCACCCCCTGGGGGTATTTTGATTTCAAC<br>AGATTCCACTGCCATTTCTCACCACGTGACTGGCA<br>GCGACTCATCAACAACAATTGGGGATTCCGGCCCA<br>AGAGACTCAACTTCAAGCTCTTCAACATCCAAGTC<br>AAGGAGGTCACGACGAATGATGGCGTCACGACCAT<br>CGCTAATAACCTTACCAGCACGGTTCAAGTCTTCT<br>CGGACTCGGAGTACCAGTTGCCGTACGTCCTCGGC<br>TCTGCGCACCAGGGCTGCCTCCCTCCGTTCCCGGC<br>GGACGTGTTCATGATTCCGCAGTACGGCTACCTAA<br>CGCTCAACAATGGCAGCCAGGCAGTGGGACGGTCA<br>TCCTTTTACTGCCTGGAATATTTCCCATCGCAGAT<br>GCTGAGAACGGGCAATAACTTTACCTTCAGCTACA<br>CCTTCGAGGACGTGCCTTTCCACAGCAGCTACGCG<br>CACAGCCAGAGCCTGGACCGGCTGATGAATCCTCT<br>CATCGACCAGTACCTGTATTACCTGAACAGAACTC<br>AGAATCAGTCCGGAAGTGCCCAAAACAAGGACTTG<br>CTGTTTAGCCGGGGGTCTCCAGCTGGCATGTCTGT<br>TCAGCCCAAAAACTGGCTACCTGGACCCTGTTACC<br>GGCAGCAGCGCGTTTCTAAAACAAAAACAGACAAC<br>AACAACAGCAACTTTACCTGGACTGGTGCTTCAAA<br>ATATAACCTTAATGGGCGTGAATCTATAATCAACC<br>CTGGCACTGCTATGGCCTCACACAAAGACGACAAA<br>GACAAGTTCTTTCCCATGAGCGGTGTCATGATTTT<br>TGGAAAGGAGAGCGCCGGAGCTTCAAACACTGCAT<br>TGGACAATGTCATGATCACAGACGAAGAGGAAATC<br>AAAGCCACTAACCCCGTGGCCACCGAAAGATTTGG<br>GACTGTGGCAGTCAATCTCCAGAGCAGCAGCACAG<br>ACCCTGCGACCGGAGATGTGCATATTATGGGAGCC<br>TTACCTGGAATGGTGTGGCAAGACAGAGACGTATA<br>CCTGCAGGGTCCTATTTGGGCCAAAATTCCTCACA<br>CGGATGGACACTTTCACCCGTCTCCTCTCATGGGC<br>GGCTTTGGACTTAAGCACCCGCCTCCTCAGATCCT<br>CATCAAAAACACGCCTGTTCCTGCGAATCCTCCGG<br>CAGAGTTTTCGGCTACAAAGTTTGCTTCATTCATC<br>ACCCAGTATTCCACAGGACAAGTGAGCGTGGAGAT<br>TGAATGGGAGCTGCAGAAAGAAAACAGCAAACGCT<br>GGAATCCCGAAGTGCAGTATACATCTAACTATGCA<br>AAATCTGCCAACGTTGATTTCACTGTGGACAACAA<br>TGGACTTTATACTGAGCCTCGCCCCATTGGCACCC<br>GTTACCTCACCCGTCCCCTGTAAttgtgtgttaat<br>caataa<u>accggt</u> | | AKKRVLEPFGLV<br>EEGAK*T*APGKKR<br>PVEQSPQEPDSS<br>SGIGKTGQQPAK<br>KRLNFGQTGDSE<br>SVPDPQPLGEPP<br>ATPAAVGPTTMA<br>SGGGAPMADNNE<br>GADGVGNASGNW<br>HCDSTWLGDRVI<br>TTSTRTWALPTY<br>NNHLYKQISSAS<br>TGASNDNHYFGY<br>STPWGYFDFNRF<br>HCHFSPRDWQRL<br>INNNWGFRPKRL<br>NFKLFNIQVKEV<br>TTNDGVTTIANN<br>LTSTVQVFSDSE<br>YQLPYVLGSAHQ<br>GCLPPFPADVFM<br>IPQYGYLTLNNG<br>SQAVGRSSFYCL<br>EYFPSQMLRTGN<br>NFTFSYTFEDVP<br>FHSSYAHSQSLD<br>RLMNPLIDQYLY<br>YLNRTQNQSGSA<br>QNKDLLFSRGSP<br>AGMSVQPKNWLP<br>GPCYRQQRVSKT<br>KTDNNNSNFTWT<br>GASKYNLNGRES<br>IINPGTAMASHK<br>DDKDKFFPMSGV<br>MIFGKESAGASN<br>TALDNVMITDEE<br>EIKATNPVATER<br>FGTVAVNLQSSS<br>TDPATGDVHIMG<br>ALPGMVWQDRDV<br>YLQGPIWAKIPH<br>TDGHFHPSPLMG<br>GFGLKHPPPQIL<br>IKNTPVPANPPA<br>EFSATKFASFIT<br>QYSTGQVSVEIE<br>WELQKENSKRWN<br>PEVQYTSNYAKS<br>ANVDFTVDNNGL<br>YTEPRPIGTRYL<br>TRPL |
| 9 | H642N | ggtaccaaaacaaatgttctcgtcacgtgggcatg<br>aatctgatgctgtttccctgcagacaatgcgagag<br>aatgaatcagaattcaaatatctgcttcactcacg | 275 | MAADGYLPDWLE<br>DNLSEGIREWWD<br>LKPGAPKPKANQ |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Muta- tion | Nucleic acid sequence of the synthesised fragment to clone into the AAV6 Rep Cap vector using restriction sites HindIII and AgeI | SEQ ID NO | Capsid protein sequence |
|---|---|---|---|---|
| | | gacagaaagactgtttagagtgctttcccgtgtca | | QKQDDGRGLVLP |
| | | gaatctcaacccgtttctgtcgtcaaaaaggcgta | | GYKYLGPFNGLD |
| | | tcagaaactgtgctacattcatcatatcatgggaa | | KGEPVNAADAAA |
| | | aggtgccagacgcttgcactgcctgcgatctggtc | | LEHDKAYDQQLK |
| | | aatgtggatttggatgactgcatctttgaacaata | | AGDNPYLRYNHA |
| | | a*atgatttaaatcaggt*<u>ATG</u>GCTGCCGATGGTTAT | | DAEFQERLQEDT |
| | | CTTCCAGATTGGCTCGAGGACAACCTCTCTGAGGG | | SFGGNLGRAVFQ |
| | | CATTCGCGAGTGGTGGGACTTGAAACCTGGAGCCC | | AKKRVLEPFGLV |
| | | CGAAACCCAAAGCCAACCAGCAAAAGCAGGACGAC | | EEGAK*T*APGKKR |
| | | GGCCGGGGTCTGGTGCTTCCTGGCTACAAGTACCT | | PVEQSPQEPDSS |
| | | CGGACCCTTCAACGGACTCGACAAGGGGGAGCCCG | | SGIGKTGQQPAK |
| | | TCAACGCGGCGGATGCAGCGGCCCTGAGCACGAC | | KRLNFGQTGDSE |
| | | AAGGCCTACGACCAGCAGCTCAAAGCGGGTGACAA | | SVPDPQPLGEPP |
| | | TCCGTACCTGCGGTATAACCACGCCGACGCCGAGT | | ATPAAVGPTTMA |
| | | TCAGGAGCGTCTGCAAGAAGATACGTCTTTTGGG | | SGGGAPMADNNE |
| | | GGCAACCTCGGGCGAGCAGTCTTCCAGGCCAAGAA | | GADGVGNASGNW |
| | | GAGGGTTCTCGAACCTTTTGGTCTGGTTGAGGAAG | | HCDSTWLGDRVI |
| | | GTGCTAAG*ACG*GCTCCTGGAAAGAAACGTCCGGTA | | TTSTRTWALPTY |
| | | GAGCAGTCGCCACAAGAGCCAGACTCCTCCTCGGG | | NNHLYKQISSAS |
| | | CATTGGCAAGACAGGCCAGCAGCCCGCTAAAAAGA | | TGASNDNHYFGY |
| | | GACTCAATTTTGGTCAGACTGGCGACTCAGAGTCA | | STPWGYFDPNRF |
| | | GTCCCCGACCCACAACCTCTCGGAGAACCTCCAGC | | HCHFSPRDWQRL |
| | | AACCCCCGCTGCTGTGGGACCTACTAC<u>ATG</u>GCTT | | INNNWGFRPKRL |
| | | CAGGCGGTGGCGCACCAATGGCAGACAATAACGAA | | NFKLFNIQVKEV |
| | | GGCGCCGACGGAGTGGGTAATGCCTCAGGAAATTG | | TTNDGVTTIANN |
| | | GCATTGCGATTCCACATGGCTGGGCGACAGAGTCA | | LTSTVQVFSDSE |
| | | TCACCACCAGCACCCGAACATGGGCCTTGCCCACC | | YQLPYVLGSAHQ |
| | | TATAACAACCACCTCTACAAGCAAATCTCCAGTGC | | GCLPPFPADVFM |
| | | TTCAACGGGGGCCAGCAACGACAACCACTACTTCG | | IPQYGYLTLNNG |
| | | GCTACAGCACCCCCTGGGGGTATTTTGATTTCAAC | | SQAVGRSSFYCL |
| | | AGATTCCACTGCCATTTCTCACCACGTGACTGGCA | | EYFPSQMLRTGN |
| | | GCGACTCATCAACAACAATTGGGGATTCCGGCCCA | | NFTFSYTFEDVP |
| | | AGAGACTCAACTTCAAGCTCTTCAACATCCAAGTC | | FHSSYAHSQSLD |
| | | AAGGAGGTCACGACGAATGATGGCGTCACGACCAT | | RLMNPLIDQYLY |
| | | CGCTAATAACCTTACCAGCACGGTTCAAGTCTTCT | | YLNRTQNQSGSA |
| | | CGGACTCGGAGTACCAGTTGCCGTACGTCCTCGGC | | QNKDLLFSRGSP |
| | | TCTGCGCACCAGGGCTGCCTCCCTCCGTTCCCGGC | | AGMSVQPKNWLP |
| | | GGACGTGTTCATGATTCCGCAGTACGGCTACCTAA | | GPCYRQQRVSKT |
| | | CGCTCAACAATGGCAGCCAGGCAGTGGGACGGTCA | | KTDNNNSNFTWT |
| | | TCCTTTTACTGCCTGGAATATTTCCCATCGCAGAT | | GASKYNLNGRES |
| | | GCTGAGAACGGGCAATAACTTTACCTTCAGCTACA | | IINPGTAMASHK |
| | | CCTTCGAGGACGTGCCTTTCCACAGCAGCTACGCG | | DDKDKFFPMSGV |
| | | CACAGCCAGAGCCTGGACCGGCTGATGAATCCTCT | | MIFGKESAGASN |
| | | CATCGACCAGTACCTGTATTACCTGAACAGAACTC | | TALDNVMITDEE |
| | | AGAATCAGTCCGGAAGTGCCCAAAACAAGGACTTG | | EIKATNPVATER |
| | | CTGTTTAGCCGGGGGTCTCCAGCTGGCATGTCTGT | | FGTVAVNLQSSS |
| | | TCAGCCCAAAAACTGGCTACCTGGACCCTGTTACC | | TDPATGDVHVMG |
| | | GGCAGCAGCGCGTTTCTAAAACAAAAACAGACAAC | | ALPGMVWQDRDV |
| | | AACAACAGCAACTTTACCTGGACTGGTGCTTCAAA | | YLQGPIWAKIPH |
| | | ATATAACCTTAATGGGCGTGAATCTATAATCAACC | | TDGHFHPSPLMG |
| | | CTGGCACTGCTATGGCCTCACACAAAGACGACAAA | | GFGLKNPPPQIL |
| | | GACAAGTTCTTTCCCATGAGCGGTGTCATGATTTT | | IKNTPVPANPPA |
| | | TGGAAAGGAGAGCGCCGGAGCTTCAAACACTGCAT | | EFSATKFASFIT |
| | | TGGACAATGTCATGATCACAGACGAAGAGGAAATC | | QYSTGQVSVEIE |
| | | AAAGCCACTAACCCCGTGGCCACCGAAAGATTTGG | | WELQKENSKRWN |
| | | GACTGTGGCAGTCAATCTCCAGAGCAGCAGCACAG | | PEVQYTSNYAKS |
| | | ACCCTGCGACCGGAGATGTGCATGTTATGGGAGCC | | ANVDFTVDNNGL |
| | | TTACCTGGAATGGTGTGGCAAGACAGAGACGTATA | | YTEPRPIGTRYL |
| | | CCTGCAGGGTCCTATTTGGGCCAAAATTCCTCACA | | TRPL |
| | | CGGATGGACACTTTCACCCGTCTCCTCTCATGGGC | | |
| | | GGCTTTGGACTTAAGAACCCGCCTCCTCAGATCCT | | |
| | | CATCAAAAACACGCCTGTTCCTGCGAATCCTCCGG | | |
| | | CAGAGTTTTCGGCTACAAAGTTTGCTTCATTCATC | | |
| | | ACCCAGTATTCCACAGGACAAGTGAGCGTGGAGAT | | |
| | | TGAATGGGAGCTGCAGAAAGAAAACAGCAAACGCT | | |
| | | GGAATCCCGAAGTGCAGTATACATCTAACTATGCA | | |
| | | AAATCTGCCAACGTTGATTTCACTGTGGACAACAA | | |
| | | TGGACTTTATACTGAGCCTCGCCCCATTGGCACCC | | |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Mutation | Nucleic acid sequence of the synthesised fragment to clone into the AAV6 Rep Cap vector using restriction sites HindIII and AgeI | SEQ ID NO | Capsid protein sequence |
|---|---|---|---|---|
| | | GTTACCTCACCCGTCCCCTGTAAttgtgtgttaat caataa`accggt` | | |
| 10 | F129L and H642N | ggtaccaaaacaaatgttctcgtcacgtgggcatg aatctgatgctgtttccctgcagacaatgcgagag aatgaatcagaattcaaatatctgcttcactcacg gacagaaagactgtttagagtgctttcccgtgtca gaatctcaacccgtttctgtcgtcaaaaaggcgta tcagaaactgtgctacattcatatatcatgggaa aggtgccagacgcttgcactgcctgcgatctggtc aatgtggatttggatgactgcatctttgaacaata a_tgatttaaatcaggt_<u>ATG</u>GCTGCCGATGGTTAT CTTCCAGATTGGCTCGAGGACAACCTCTCTGAGGG CATTCGCGAGTGGTGGGACTTGAAACCTGGAGCCC CGAAACCCAAAGCCAACCAGCAAAGCAGGACGAC GGCCGGGGTCTGGTGCTTCCTGGCTACAAGTACCT CGGACCCTTCAACGGACTCGACAAGGGGGAGCCCG TCAACGCGGCGGATGCAGCGGCCCTCGAGCACGAC AAGGCCTACGACCAGCAGCTCAAAGCGGGTGACAA TCCGTACCTGCGGTATAACCACGCCGACGCCGAGT TCAGGAGCGTCTGCAAGAAGATACGTCTTTTGGG GGCAACCTCGGGCGAGCAGTCTTCCAGGCCAAGAA GAGGGTTCTCGAACCTTTAGGTCTGGTTGAGGAAG GTGCTAAGACGGCTCCTGGAAAGAAACGTCCGGTA GAGCAGTCGCCACAAGAGCCAGACTCCTCCTCGGG CATTGGCAAGACAGGCCAGCAGCCCGCTAAAAAGA GACTCAATTTTGGTCAGACTGGCGACTCAGAGTCA GTCCCCGACCCACAACCTCTCGGAGAACCTCCAGC AACCCCCGCTGCTGTGGGACCTACTAC<u>ATG</u>GCTT CAGGCGGTGGCGCACCAATGGCAGACAATAACGAA GGCGCCGACGGAGTGGGTAATGCCCTCAGGAAATTG GCATTGCGATTCCACATGGCTGGGCGACAGAGTCA TCACCACCAGCACCCGAACATGGGCCTTGCCCACC TATAACAACCACCTCTACAAGCAAATCTCCAGTGC TTCAACGGGGCCAGCAACGACAACCACTACTTCG GCTACAGCACCCCCTGGGGGTATTTTGATTTCAAC AGATTCCACTGCCATTTCTCACCACGTGACTGGCA GCGACTCATCAACAACAATTGGGGATTCCGGCCCA AGAGACTCAACTTCAAGCTCTTCAACATCCAAGTC AAGGAGGTCACGACGAATGATGGCGTCACGACCAT CGCTAATAACCTTACCAGCACGGTTCAAGTCTTCT CGGACTCGGAGTACCAGTTGCCGTACGTCCTCGGC TCTGCGCACCAGGGCTGCCTCCCTCCGTTCCCGGC GGACGTGTTCATGATTCCGCAGTACGGCTACCTAA CGCTCAACAATGGCAGCCAGGCAGTGGGACGGTCA TCCTTTTACTGCCTGGAATATTTCCCATCGCAGAT GCTGAGAACGGGCAATAACTTTACCTTCAGCTACA CCTTCGAGGACGTGCCTTTCCACAGCAGCTACGCG CACAGCCAGAGCCTGGACCGGCTGATGAATCCTCT CATCGACCAGTACCTGTATTACCTGAACAGAACTC AGAATCAGTCCGGAAGTGCCCAAAACAAGGACTTG CTGTTTAGCCGGGGGTCTCCAGCTGGCATGTCTGT TCAGCCCAAAAACTGGCTACCTGGACCCTGTTACC GGCAGCAGCGCGTTTCTAAAACAAAAACAGACAAC AACAACAGCAACTTTACCTGGACTGGTGCTTCAAA ATATAACCTTAATGGGCGTGAATCTATAATCAACC CTGGCACTGCTATGGCCTCACACAAAGACGACAAA GACAAGTTCTTTCCCATGAGCGGTGTCATGATTTT TGGAAAGGAGAGCGCCGGAGCTTCAAACACTGCAT TGGACAATGTCATGATCACAGACGAAGAGGAAATC AAAGCCACTAACCCCGTGGCCACCGAAAGATTTGG GACTGTGGCAGTCAATCTCCAGAGCAGCAGCACAG ACCCTGCGACCGGAGATGTGCATGTTATGGGAGCC TTACCTGGAATGGTGTGGCAAGACAGAGACGTATA CCTGCAGGGTCCTATTTGGGCCAAAATTCCTCACA CGGATGGACACTTTCACCCGTCTCCTCTCATGGGC GGCTTTGGACTTAAGAACCCGCCTCCTCAGATCCT | 276 | <u>M</u>AADGYLPDWLE DNLSEGIREWWD LKPGAPKPKANQ QKQDDGRGLVLP GYKYLGPFNGLD KGEPVNAADAAA LEHDKAYDQQLK AGDNPYLRYNHA DAEFQERLQEDT SFGGNLGRAVFQ AKKRVLEPLGLV EEGAKTAPGKKR PVEQSPQEPDSS SGIGKTGQQPAK KRLNFGQTGDSE SVPDPQPLGEPP ATPAAVGPTT_M__A_ _SGGGAPMADNNE_ _GADGVGNASGNW_ _HCDSTWLGDRVI_ _TTSTRTWALPTY_ _NNHLYKQISSAS_ _TGASNDNHYFGY_ _STPWGYFDFNRF_ _HCHFSPRDWQRL_ _INNNWGFRPKRL_ <u>N</u>FKLFNIQVKEV TTNDGVTTIANN LTSTVQVFSDSE YQLPYVLGSAHQ GCLPPFPADVFM IPQYGYLTLNNG SQAVGRSSFYCL EYFPSQMLRTGN NFTFSYTFEDVP FHSSYAHSQSLD RLMNPLIDQYLY YLNRTQNQSGSA QNKDLLFSRGSP AGMSVQPKNWLP GPCYRQQRVSKT KTDNNNSNFTWT GASKYNLNGRES IINPGTAMASHK DDKDKFFPMSGV MIFGKESAGASN TALDNVMITDEE EIKATNPVATER FGTVAVNLQSSS TDPATGDVHVMG ALPGMVWQDRDV YLQGPIWAKIPH TDGHFHPSPLMG GFGLKNPPPQIL IKNTPVPANPPA EFSATKFASFIT QYSTGQVSVEIE WELQKENSKRWN PEVQYTSNYAKS ANVDFTVDNNGL YTEPRPIGTRYL TRPL |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Mutation | Nucleic acid sequence of the synthesised fragment to clone into the AAV6 Rep Cap vector using restriction sites HindIII and AgeI | SEQ ID NO | Capsid protein sequence |
|---|---|---|---|---|
| | | CATCAAAAACACGCCTGTTCCTGCGAATCCTCCGG CAGAGTTTTCGGCTACAAAGTTTGCTTCATTCATC ACCCAGTATTCCACAGGACAAGTGAGCGTGGAGAT TGAATGGGAGCTGCAGAAAGAAAACAGCAAACGCT GGAATCCCGAAGTGCAGTATACATCTAACTATGCA AAATCTGCCAACGTTGATTTCACTGTGGACAACAA TGGACTTTATACTGAGCCTCGCCCCATTGGCACCC GTTACCTCACCCGTCCCCTGTAA*ttgtgtgttaat caataa*<span style="border:1px solid">accggt</span> | | |
| 11 | F129L and L584D | *ggtaccaaaacaaatgttctcgtcacgtgggcatg aatctgatgctgtttccctgcagacaatgcgagag aatgaatcagaattcaaatatctgcttcactcacg gacagaaagactgtttagagtgctttcccgtgtca gaatctcaacccgtttctgtcgtcaaaaaggcgta tcagaaactgtgctacattcatcatatcatgggaa aggtgccagacgcttgcactgcctgcgatctggtc aatgtggatttggatgactgcatctttgaacaata aatgatttaaatcaggt*<u>ATG</u>GCTGCCGATGGTTAT CTTCCAGATTGGCTCGAGGACAACCTCTCTGAGGG CATTCGCGAGTGGTGGGACTTGAAACCTGGAGCCC CGAAACCCAAAGCCAACCAGCAAAAGCAGGACGAC GGCCGGGGTCTGGTGCTTCCTGGCTACAAGTACCT CGGACCCTTCAACGGACTCGACAAGGGGGAGCCCG TCAACGCGGCGGATGCAGCGGCCCTCGAGCACGAC AAGGCCTACGACCAGCAGCTCAAAGCGGGTGACAA TCCGTACCTGCGGTATAACCACGCCGACGCCGAGT TTCAGGAGCGTCTGCAAGAAGATACGTCTTTTGGG GGCAACCTCGGGCGAGCAGTCTTCCAGGCCAAGAA GAGGGTTCTCGAACCTTTAGGTCTGGTTGAGGAAG GTGCTAAG*ACG*GCTCCTGGAAAGAAACGTCCGGTA GAGCAGTCGCCACAAGAGCCAGACTCCTCCTCGGG CATTGGCAAGACAGGCCAGCAGCCCGCTAAAAAGA GACTCAATTTTGGTCAGACTGGCGACTCAGAGTCA GTCCCCGACCCACAACCTCTCGGAGAACCTCCAGC AACCCCCGCTGCTGTGGGACCTACTAC<u>ATG</u>GCTT CAGGCGGTGGCGCCACCAATGGCAGACAATAACGAA GGCGCCGACGGAGTGGGTAATGCCTCAGGAAATTG GCATTGCGATTCCACATGGCTGGGCGACAGAGTCA TCACCACCAGCACCCGAACATGGGCCTTGCCCACC TATAACAACCACCTCTACAAGCAAATCTCCAGTGC TTCAACGGGGGCCAGCAACGACAACCACTACTTCG GCTACAGCACCCCCTGGGGGTATTTTGATTTCAAC AGATTCCACTGCCATTTCTCACCACGTGACTGGCA GCGACTCATCAACAACAATTGGGGATTCGGCCCA AGAGACTCAACTTCAAGCTCTTCAACATCCAAGTC AAGGAGGTCACGACGAATGATGGCGTCACGACCAT CGCTAATAACCTTACCAGCACGGTTCAAGTCTTCT CGGACTCGGAGTACCAGTTGCCGTACGTCCTCGGC TCTGCGCACCAGGGCTGCCTCCCTCCGTTCCCGGC GGACGTGTTCATGATTCCGCAGTACGGCTACCTAA CGCTCAACAATGGCAGCCAGGCAGTGGGACGGTCA TCCTTTTACTGCCTGGAATATTTCCCATCGCAGAT GCTGAGAACGGGCAATAACTTTACCTTCAGCTACA CCTTCGAGGACGTGCCTTTCCACAGCAGCTACGCG CACAGCCAGAGCCTGGACCGGCTGATGAATCCTCT CATCGACCAGTACCTGTATTACCTGAACAGAACTC AGAATCAGTCCGGAAGTGCCCAAAACAAGGACTTG CTGTTTAGCCGGGGGTCTCCAGCTGGCATGTCTGT TCAGCCCAAAAACTGGCTACCTGGACCCTGTTACC GGCAGCAGCGCGTTTCTAAAACAAAAACAGACAAC AACAGCAACTTTACCTGGACTGGTGCTTCAAA ATATAACCTTAATGGGCGTGAATCTATAATCAACC CTGGCACTGCTATGGCCTCACACAAAGACGACAAA GACAAGTTCTTTCCCATGAGCGGTGTCATGATTTT TGGAAAGGAGAGCGCCGGAGCTTCAAACACTGCAT TGGACAATGTCATGATCACAGACGAAGAGGAAATC | 277 | <u>M</u>AADGYLPDWLE DNLSEGIREWWD LKPGAPKPKANQ QKQDDGRGLVLP GYKYLGPFNGLD KGEPVNAADAAA LEHDKAYDQQLK AGDNPYLRYNHA DAEFQERLQEDT SFGGNLGRAVFQ AKKRVLEPLGLV EEGAKTAPGKKR PVEQSPQEPDSS SGIGKTGQQPAK KRLNFGQTGDSE SVPDPQPLGEPP ATPAAVGPTTMA SGGGAPMADNNE GADGVGNASGNW HCDSTWLGDRVI TTSTRTWALPTY NNHLYKQISSAS TGASNDNHYFGY STPWGYFDFNRF HCHFSPRDWQRL INNNWGFRPKRL NFKLFNIQVKEV TTNDGVTTIANN LTSTVQVFSDSE YQLPYVLGSAHQ GCLPPFPADVFM IPQYGYLTLNNG SQAVGRSSFYCL EYFPSQMLRTGN NFTFSYTFEDVP FHSSYAHSQSLD RLMNPLIDQYLY YLNRTQNQSGSA QNKDLLFSRGSP AGMSVQPKNWLP GPCYRQQRVSKT KTDNNNSNFTWT GASKYNLNGRES IINPGTAMASHK DDKDKFFPMSGV MIFGKESAGASN TALDNVMITDEE EIKATNPVATER FGTVAVNDQSSS TDPATGDVHVMG ALPGMVWQDRDV YLQGPIWAKIPH TDGHFHPSPLMG GFGLKHPPPQIL IKNTPVPANPPA EFSATKFASFIT QYSTGQVSVEIE |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Mutation | Nucleic acid sequence of the synthesised fragment to clone into the AAV6 Rep Cap vector using restriction sites HindIII and AgeI | SEQ ID NO | Capsid protein sequence |
|---|---|---|---|---|
| | | AAAGCCACTAACCCCGTGGCCACCGAAAGATTTGG GACTGTGGCAGTCAATGACCAGAGCAGCAGCACAG ACCCTGCGACCGGAGATGTGCATGTTATGGGAGCC TTACCTGGAATGGTGTGGCAAGACAGAGACGTATA CCTGCAGGGTCCTATTTGGGCCAAAATTCCTCACA CGGATGGACACTTTCACCCGTCTCCTCTCATGGGC GGCTTTGGACTTAAGCACCCGCCTCCTCAGATCCT CATCAAAAACACGCCTGTTCCTGCGAATCCTCCGG CAGAGTTTTCGGCTACAAAGTTTGCTTCATTCATC ACCCAGTATTCCACAGGACAAGTGAGCGTGGAGAT TGAATGGGAGCTGCAGAAAGAAAACAGCAAACGCT GGAATCCCGAAGTGCAGTATACATCTAACTATGCA AAATCTGCCAACGTTGATTTCACTGTGGACAACAA TGGACTTTATACTGAGCCTCGCCCCATTGGCACCC GTTACCTCACCCGTCCCCTGTAAttgtgttaat cataaaccggt | | WELQKENSKRWN PEVQYTSNYAKS ANVDFTVDNNGL YTEPRPIGTRYL TRPL |
| 12 | F129L and D418N | ggtaccaaaacaaatgttctcgtcacgtgggcatg aatctgatgctgtttccctgcagacaatgcgagag aatgaatcagaattcaaatatctgcttcactcacg gacagaaagactgtttagagtgctttcccgtgtca gaatctcaacccgtttctgtcgtcaaaaaggcgta tcagaaactgtgctacattcatcatatcatgggaa aggtgccagacgcttgcactgcctgcgatctggtc aatgtggatttggatgactgcatctttgaacaata atgatttaaatcaggtATGGCTGCCGATGGTTAT CTTCCAGATTGGCTCGAGGACAACCTCTCTGAGGG CATTCGCGAGTGGTGGGACTTGAAACCTGGAGCCC CGAAACCCAAAGCCAACCAGCAAAAGCAGGACGAC GGCCGGGGTCTGGTGCTTCCTGGCTACAAGTACCT CGGACCCTTCAACGGACTCGACAAGGGGGAGCCCG TCAACGCGGCGGATGCAGCGGCCCTCGAGCACGAC AAGGCCTACGACCAGCAGCTCAAAGCGGGTGACAA TCCGTACCTGCGGTATAACCACGCCGACGCCGAGT TTCAGGAGCGTCTGCAAGAAGATACGTCTTTTGGG GGCAACCTCGGGCGAGCAGTCTTCCAGGCCAAGAA GAGGGTTCTCGAACCTTTAGGTCTGGTTGAGGAAG GTGCTAAG*ACG*GCTCCTGGAAAGAAACGTCCGGTA GAGCAGTCGCCACAAGAGCCAGACTCCTCCTCGGG CATTGGCAAGACAGGCCAGCAGCCCGCTAAAAAGA GACTCAATTTTGGTCAGACTGGCGACTCAGAGTCA GTCCCCGACCCACAACCTCTCGGAGAACCTCCAGC AACCCCCGCTGCTGTGGGACCTACTACAATGGCTT CAGGCGGTGGCGCACCAATGGCAGACAATAACGAA GGCGCCGACGGAGTGGGTAATGCCTCAGGAAATTG GCATTGCGATTCCACATGGCTGGGCGACAGAGTCA TCACCACCAGCACCCGAACATGGGCCTTGCCCACC TATAACAACCACCTCTACAAGCAAATCTCCAGTGC TTCAACGGGGGCCAGCAACGACAACCACTACTTCG GCTACAGCACCCCCTGGGGGTATTTTGATTTCAAC AGATTCCACTGCCATTTCTCACCACGTGACTGGCA GCGACTCATCAACAACAATTGGGGATTCCGGCCCA AGAGACTCAACTTCAAGCTCTTCAACATCCAAGTC AAGGAGGTCACGACGAATGATGGCGTCACGACCAT CGCTAATAACCTTACCAGCACGGTTCAAGTCTTCT CGGACTCGGAGTACCAGTTGCCGTACGTCCTCGGC TCTGCGCACCAGGGCTGCCTCCCTCCGTTCCCGGC GGACGTGTTCATGATTCCGCAGTACGGCTACCTAA CGCTCAACAATGGCAGCCAGGCAGTGGGACGGTCA TCCTTTTACTGCCTGGAATATTTCCCATCGCAGAT GCTGAGAACGGGCAATAACTTTACCTTCAGCTACA CCTTCGAGAACGTGCCTTTCCACAGCTACGCG CACAGCCAGAGCCTGGACCGGCTGATGAATCCTCT CATCGACCAGTACCTGTATTACCTGAACAGAACTC AGAATCAGTCCGGAAGTGCCCAAAACAAGGACTTG CTGTTTAGCCGGGGGTCTCCAGCTGGCATGTCTGT TCAGCCCAAAAACTGGCTACCTGGACCCTGTTACC | 278 | MAADGYLPDWLE DNLSEGIREWWD LKPGAPKPKANQ QKQDDGRGLVLP GYKYLGPFNGLD KGEPVNAADAAA LEHDKAYDQQLK AGDNPYLRYNHA DAEFQERLQEDT SFGGNLGRAVFQ AKKRVLEPLGLV EEGAK*T*APGKKR PVEQSPQEPDSS SGIGKTGQQPAK KRLNFGQTGDSE SVPDPQPLGEPP ATPAAVGPTTMA SGGGAPMADNNE GADGVGNASGNW HCDSTWLGDRVI TTSTRTWALPTY NNHLYKQISSAS TGASNDNHYFGY STPWGYFDFNRF HCHFSPRDWQRL INNNWGFRPKRL NFKLFNIQVKEV TTNDGVTTIANN LTSTVQVFSDSE YQLPYVLGSAHQ GCLPPFPADVFM IPQYGYLTLNNG SQAVGRSSFYCL EYFPSQMLRTGN NFTFSYTFENVP FHSSYAHSQSLD RLMNPLIDQYLY YLNRTQNQSGSA QNKDLLFSRGSP AGMSVQPKNWLP GPCYRQQRVSKT KTDNNNSNFTWT GASKYNLNGRES IINPGTAMASHK DDKDKFFPMSGV MIFGKESAGASN TALDNVMITDEE EIKATNPVATER FGTVAVNLQSSS TDPATGDVHVMG |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Mutation | Nucleic acid sequence of the synthesised fragment to clone into the AAV6 Rep Cap vector using restriction sites HindIII and AgeI | SEQ ID NO | Capsid protein sequence |
|---|---|---|---|---|
| | | GGCAGCAGCGCGTTTCTAAAACAAAAACAGACAAC AACAACAGCAACTTTACCTGGACTGGTGCTTCAAA ATATAACCTTAATGGGCGTGAATCTATAATCAACC CTGGCACTGCTATGGCCTCACACAAAGACGACAAA GACAAGTTCTTTCCCATGAGCGGTGTCATGATTTT TGGAAAGGAGAGCGCCGGAGCTTCAAACACTGCAT TGGACAATGTCATGATCACAGACGAAGAGGAAATC AAAGCCACTAACCCCGTGGCCACCGAAAGATTTGG GACTGTGGCAGTCAATCTCCAGAGCAGCAGCACAG ACCCTGCGACCGGAGATGTGCATGTTATGGGAGCC TTACCTGGAATGGTGTGGCAAGCAGAGACGTATA CCTGCAGGGTCCTATTTGGGCCAAAATTCCTCACA CGGATGGACACTTTCACCCGTCTCCTCTCATGGGC GGCTTTGGACTTAAGCACCCGCCTCCTCAGATCCT CATCAAAAACACGCCTGTTCCTGCGAATCCTCCGG CAGAGTTTTCGGCTACAAAGTTTGCTTCATTCATC ACCCAGTATTCCACAGGACAAGTGAGCGTGGAGAT TGAATGGGAGCTGCAGAAAGAAAACAGCAAACGCT GGAATCCCGAAGTGCAGTATACATCTAACTATGCA AAATCTGCCAACGTTGATTTCACTGTGGACAACAA TGGACTTTATACTGAGCCTCGCCCCATTGGCACCC GTTACCTCACCCGTCCCCTGTAAttgtgtgttaat caataa\[accggt\] | | ALPGMVWQDRDV YLQGPIWAKIPH TDGHFHPSPLMG GFGLKHPPPQIL IKNTPVPANPPA EFSATKFASFIT QYSTGQVSVEIE WELQKENSKRWN PEVQYTSNYAKS ANVDFTVDNNGL YTEPRPIGTRYL TRPL |
| 13 | F129L and L584H | *ggtaccaaaacaaatgttctcgtcacgtgggcatg aatctgatgctgtttccctgcagacaatgcgagag aatgaatcagaattcaaatatctgcttcactcacg gacagaaagactgtttagagtgctttcccgtgtca gaatctcaacccgtttctgtcgtcaaaaaggcgta tcagaaactgtgctacattcatatatcatgggaa aggtgccagacgcttgcactgcctgcgatctggtc aatgtggatttggatgactgcatctttgaacaata a*tgatttaaatcaggtATGGCTGCCGATGGTTAT CTTCCAGATTGGCTCGAGGACAACCTCTCTGAGGG CATTCGCGAGTGGTGGGACTTGAAACCTGGAGCCC CGAAACCCAAAGCCAACCAGCAAAAGCAGGACGAC GGCCGGGGTCTGGTGCTTCCTGGCTACAAGTACCT CGGACCCTTCAACGGACTCGACAAGGGGGAGCCCG TCAACGCGGCGGATGCAGCGGCCCTCGAGCACGAC AAGGCCTACGACCAGCAGCTCAAAGCGGGTGACAA TCCGTACCTGCGGTATAACCACGCCGACGCCGAGT TTCAGGAGCGTCTGCAAGAAGATACGTCTTTTGGG GGCAACCTCGGGCGAGCAGTCTTCCAGGCCAAGAA GAGGGTTCTCGAACCTTTAGGTCTGGTTGAGGAAG GTGCTAAG*ACG*GCTCCTGGAAAGAAACGTCCGGTA GAGCAGTCGCCACAAGAGCCAGACTCCTCCTCGGG CATTGGCAAGACAGGCCAGCAGCCCGCTAAAAAGA GACTCAATTTTGGTCAGACTGGCGACTCAGAGTCA GTCCCCGACCCACAACCTCTCGGAGAACCTCCAGC AACCCCCGCTGCTGTGGGACCTACTACAATGGCTT CAGGCGGTGGCGCACCAATGGCAGACAATAACGAA GGCGCCGACGGAGTGGGTAATGCCTCAGGAAATTG GCATTGCGATTCCACATGGCTGGGCGACAGAGTCA TCACCACCAGCACCCGAACATGGGCCTTGCCCACC TATAACAACCACCTCTACAAGCAAATCTCCAGTGC TTCAACGGGGCCAGCAACGACAACCACTACTTCG GCTACAGCACCCCCTGGGGGTATTTTGATTTCAAC AGATTCCACTGCCATTTCTCACCACGTGACTGGCA GCGACTCATCAACAACAATTGGGGATTCCGGCCCA AGAGACTCAACTTCAAGCTCTTCAACATCCAAGTC AAGGAGGTCACGACGAATGATGGCGTCACGACCAT CGCTAATAACCTTACCAGCACGGTTCAAGTCTTCT CGGACTCGGAGTACCAGTTGCCGTACGTCCTCGGC TCTGCGCACCAGGGCTGCCTCCCTCCGTTCCCGGC GGACGTGTTCATGATTCCGCAGTACGGCTACCTAA CGCTCAACAATGGCAGCCAGGCAGTGGGACGGTCA TCCTTTTACTGCCTGGAATATTTCCCATCGCAGAT | 279 | MAADGYLPDWLE DNLSEGIREWWD LKPGAPKPKANQ QKQDDGRGLVLP GYKYLGPFNGLD KGEPVNAADAAA LEHDKAYDQQLK AGDNPYLRYNHA DAEFQERLQEDT SFGGNLGRAVFQ AKKRVLEPLGLV EEGAK*T*APGKKR PVEQSPQEPDSS SGIGKTGQQPAK KRLNFGQTGDSE SVPDPQPLGEPP ATPAAVGPTTMA SGGGAPMADNNE GADGVGNASGNW HCDSTWLGDRVI TTSTRTWALPTY NNHLYKQISSAS TGASNDNHYFGY STPWGYFDFNRF HCHFSPRDWQRL INNNWGFRPKRL NFKLFNIQVKEV TTNDGVTTIANN LTSTVQVFSDSE YQLPYVLGSAHQ GCLPPFPADVFM IPQYGYLTLNNG SQAVGRSSFYCL EYFPSQMLRTGN NFTFSYTFEDVP FHSSYAHSQSLD RLMNPLIDQYLY YLNRTQNQSGSA QNKDLLFSRGSP AGMSVQPKNWLP GPCYRQQRVSKT KTDNNSNFTWT GASKYNLNGRES |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Muta-tion | Nucleic acid sequence of the synthesised fragment to clone into the AAV6 Rep Cap vector using restriction sites HindIII and AgeI | SEQ ID NO | Capsid protein sequence |
|---|---|---|---|---|
| | | GCTGAGAACGGGCAATAACTTTACCTTCAGCTACA CCTTCGAGGACGTGCCTTTCCACAGCAGCTACGCG CACAGCCAGAGCCTGGACCGGCTGATGAATCCTCT CATCGACCAGTACCTGTATTACCTGAACAGAACTC AGAATCAGTCCGGAAGTGCCCAAAACAAGGACTTG CTGTTTAGCCGGGGGTCTCCAGCTGGCATGTCTGT TCAGCCCAAAAACTGGCTACCTGGACCCTGTTACC GGCAGCAGCGCGTTTCTAAAACAAAAACAGACAAC AACAACAGCAACTTTACCTGGACTGGTGCTTCAAA ATATAACCTTAATGGGCGTGAATCTATAATCAACC CTGGCACTGCTATGGCCTCACACAAAGACGACAAA GACAAGTTCTTTCCCATGAGCGGTGTCATGATTTT TGGAAAGGAGAGCGCCGGAGCTTCAAACACTGCAT TGGACAATGTCATGATCACAGACGAAGAGGAAATC AAAGCCACTAACCCCGTGGCCACCGAAAGATTTGG GACTGTGGCAGTCAATCACCAGAGCAGCAGCACAG ACCCTGCGACCGGAGATGTGCATGTTATGGGAGCC TTACCTGGAATGGTGTGGCAAGACAGAGACGTATA CCTGCAGGGTCCTATTTGGGCCAAAATTCCTCACA CGGATGGACACTTTCACCCGTCTCCTCTCATGGGC GGCTTTGGACTTAAGCACCCGCCTCCTCAGATCCT CATCAAAAACACGCCTGTTCCTGCGAATCCTCCGG CAGAGTTTTCGGCTACAAAGTTTGCTTCATTCATC ACCCAGTATTCCACAGGACAAGTGAGCGTGGAGAT TGAATGGGAGCTGCAGAAAGAAAACAGCAAACGCT GGAATCCCGAAGTGCAGTATACATCTAACTATGCA AAATCTGCCAACGTTGATTTCACTGTGGACAACAA TGGACTTTATACTGAGCCTCGCCCCATTGGCACCC GTTACCTCACCCGTCCCCTGTAAttgtgtgttaat caataa[accggt] | | IINPGTAMASHK DDKDKFFPMSGV MIFGKESAGASN TALDNVMITDEE EIKATNPVATER FGTVAVNHQSSS TDPATGDVHVMG ALPGMVWQDRDV YLQGPIWAKIPH TDGHFHPSPLMG GFGLKHPPPQIL IKNTPVPANPPA EFSATKFASFIT QYSTGQVSVEIE WELQKENSKRWN PEVQYTSNYAKS ANVDFTVDNNGL YTEPRPIGTRYL TRPL |
| 14 | F129L, H642N, and D418N | ggtaccaaaacaaatgttctcgtcacgtgggcatg aatctgatgctgtttcctgcagacaatgcgagag aatgaatcagaattcaaatatctgcttcactcacg gacagaaagactgtttagagtgctttccgtgtca gaatctcaacccgtttctgtcgtcaaaaaggcgta tcagaaactgtgctacattcatcatatcatgggaa aggtgccagacgcttgcactgcctgcgatctggtc aatgtggatttggatgactgcatctttgaacaata aatgatttaaatcaggtATGGCTGCCGATGGTTAT CTTCCAGATTGGCTCGAGGACAACCTCTCTGAGGG CATTCGCGAGTGGTGGGACTTGAAACCTGGAGCCC CGAAACCCAAAGCCAACCAGCAAAAGCAGGACGAC GGCCGGGGTCTGGTGCTTCCTGGCTACAAGTACCT CGGACCCTTCAACGGACTCGACAAGGGGGAGCCCG TCAACGCGGCGGATGCAGCGGCCCTCGAGCACGAC AAGGCCTACGACCAGCAGCTCAAAGCGGGTGACAA TCCGTACCTGCGGTATAACCACGCCGACGCCGAGT TCAGGAGCGTCTGCAAGAAGATACGTCTTTTTGGG GGCAACCTCGGGCGAGCAGTCTTCCAGGCCAAGAA GAGGGTTCTCGAACCTTTAGGTCTGGTTGAGGAAG GTGCTAAG*ACG*GCTCCTGGAAAGAAACGTCCGGTA GAGCAGTCGCCACAAGAGCCAGACTCCTCCTCGGG CATTGGCAAGACAGGCCAGCAGCCCGCTAAAAAGA GACTCAATTTTGGTCAGACTGGCGACTCAGAGTCA GTCCCCGACCCACAACCTCTCGGAGAACCTCCAGC AACCCCCGCTGCTGTGGGACCTACTACATGGCTT CAGGCGGTGGCGCACCAATGGCAGACAATAACGAA GGCGCCGACGGAGTGGGTAATGCCTCAGGAAATTG GCATTGCGATTCCACATGGCTGGGCGACAGAGTCA TCACCACCAGCACCCGAACATGGGCCTTGCCCACC TATAACAACCACCTCTACAAGCAAATCTCCAGTGC TTCAACGGGGGCCAGCAACGACAACCACTACTTCG GCTACAGCACCCCCTGGGGGTATTTTGATTTCAAC AGATTCCACTGCCATTTCTCACCACGTGACTGGCA GCGACTCATCAACAACAATTGGGGATTCCGGCCCA AGAGACTCAACTTCAAGCTCTTCAACATCCAAGTC | 280 | MAADGYLPDWLE DNLSEGIREWWD LKPGAPKPKANQ QKQDDGRGLVLP GYKYLGPFNGLD KGEPVNAADAAA LEHDKAYDQQLK AGDNPYLRYNHA DAEFQERLQEDT SFGGNLGRAVFQ AKKRVLEPLGLV EEGAK*T*APGKKR PVEQSPQEPDSS SGIGKTGQQPAK KRLNFGQTGDSE SVPDPQPLGEPP ATPAAVGPTTMA SGGGAPMADNNE GADGVGNASGNW HCDSTWLGDRVI TTSTRTWALPTY NNHLYKQISSAS TGASNDNHYFGY STPWGYFDFNRF HCHFSPRDWQRL INNNWGFRPKRL NFKLFNIQVKEV TTNDGVTTIANN LTSTVQVFSDSE YQLPYVLGSAHQ GCLPPFPADVFM IPQYGYLTLNNG SQAVGRSSFYCL EYFPSQMLRTGN NFTFSYTFENVP FHSSYAHSQSLD |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Mutation | Nucleic acid sequence of the synthesised fragment to clone into the AAV6 Rep Cap vector using restriction sites HindIII and AgeI | SEQ ID NO | Capsid protein sequence |
|---|---|---|---|---|
| | | AAGGAGGTCACGACGAATGATGGCGTCACGACCAT CGCTAATAACCTTACCAGCACGGTTCAAGTCTTCT CGGACTCGGAGTACCAGTTGCCGTACGTCCTCGGC TCTGCGCACCAGGGCTGCCTCCCTCCGTTCCCGGC GGACGTGTTCATGATTCCGCAGTACGCTACCTAA CGCTCAACAATGGCAGCCAGGCAGTGGGACGGTCA TCCTTTTACTGCCTGGAATATTTCCCATCGCAGAT GCTGAGAACGGGCAATAACTTTACCTTCAGCTACA CCTTCGAGAACGTGCCTTTCCACAGCAGCTACGCG CACAGCCAGAGCCTGGACCGGCTGATGAATCCTCT CATCGACCAGTACCTGTATTACCTGAACAGAACTC AGAATCAGTCCGGAAGTGCCCAAAACAAGGACTTG CTGTTTAGCCGGGGGTCTCCAGCTGGCATGTCTGT TCAGCCCAAAAACTGGCTACCTGGACCCTGTTACC GGCAGCAGCGCGTTTCTAAAACAAAACAGACAAC AACAACAGCAACTTTACCTGGACTGGTGCTTCAAA ATATAACCTTAATGGGCGTGAATCTATAATCAACC CTGGCACTGCTATGGCCTCACACAAAGACGACAAA GACAAGTTCTTTCCCATGAGCGGTGTCATGATTTT TGGAAAGGAGAGCGCCGGAGCTTCAAACACTGCAT TGGACAATGTCATGATCACAGACGAAGAGGAAATC AAAGCCACTAACCCCGTGGCCACCGAAAGATTTGG GACTGTGGCAGTCAATCTCCAGAGCAGCAGCACAG ACCCTGCGACCGGAGATGTGCATGTTATGGGAGCC TTACCTGGAATGGTGTGGCAAGACAGAGACGTATA CCTGCAGGGTCCTATTTGGGCCAAAATTCCTCACA CGGATGGACACTTTCACCCGTCTCCTCTCATGGGC GGCTTTGGACTTAAGAACCCGCCTCCTCAGATCCT CATCAAAAACACGCCTGTTCCTGCGAATCCTCCGG CAGAGTTTTCGGCTACAAAGTTTGCTTCATTCATC ACCCAGTATTCCACAGGACAAGTGAGCGTGGAGAT TGAATGGGAGCTGCAGAAAGAAAACAGCAAACGCT GGAATCCCGAAGTGCAGTATACATCTAACTATGCA AAATCTGCCAACGTTGATTTCACTGTGGACAACAA TGGACTTTATACTGAGCCTCGCCCCATTGGCACCC GTTACCTCACCCGTCCCCTGTAAttgtgtgttaat caataa<u>accggt</u> | | RLMNPLIDQYLY YLNRTQNQSGSA QNKDLLFSRGSP AGMSVQPKNWLP GPCYRQQRVSKT KTDNNNSNFTWT GASKYNLNGRES IINPGTAMASHK DDKDKFFPMSGV MIFGKESAGASN TALDNVMITDEE EIKATNPVATER FGTVAVNLQSSS TDPATGDVHVMG ALPGMVWQDRDV YLQGPIWAKIPH TDGHFHPSPLMG GFGLKNPPPQIL IKNTPVPANPPA EFSATKFASFIT QYSTGQVSVEIE WELQKENSKRWN PEVQYTSNYAKS ANVDFTVDNNGL YTEPRPIGTRYL TRPL |
| 15 | F129L, H642N, and L584D | *ggtaccaaaacaaatgttctcgtcacgtgggcatg aatctgatgctgtttccctgcagacaatgcgagag aatgaatcagaattcaaatatctgcttcactcacg gacagaaagactgtttagagtgctttcccgtgtca gaatctcaaccgtttctgtcgtcaaaaaggcgta tcagaaactgtgctacattcatcatatcatgggaa aggtgccagacgcttgcactgcctgcgatctggtc aatgtggatttggatgactgcatctttgaacaata a*atgatttaaatcaggt<u>ATG</u>GCTGCCGATGGTTAT CTTCCAGATTGGCTCGAGGACAACCTCTCTGAGGG CATTCGCGAGTGGTGGGACTTGAAACCTGGAGCCC CGAAACCCAAAGCCAACCAGCAAAAGCAGGACGAC GGCCGGGGTCTGGTGCTTCCTGGCTACAAGTACCT CGGACCCTTCAACGGACTCGACAAGGGGGAGCCCG TCAACGCGGCGGATGCAGCGGCCCTCGAGCACGAC AAGGCCTACGACCAGCAGCTCAAAGCGGGTGACAA TCCGTACCTGCGGTATAACCACGCCGACGCCGAGT TTCAGGAGCGTCTGCAAGAAGATACGTCTTTTGGG GGCAACCTCGGGCGAGCAGTCTTCCAGGCCAAGAA GAGGGTTCTCGAACCCTTTAGGTCTGGTTGAGGAAG GTGCTAAG*ACG*GCTCCTGGAAAGAAACGTCCGGTA GAGCAGTCGCCACAAGAGCCAGACTCCTCCTCGGG CATTGGCAAGACAGGCCAGCCCGCTAAAAAGAGA GACTCAATTTTGGTTCAGACTGGCGACTCAGAGTCA GTCCCCGACCCACAACCTCTCGGAGAACCTCCAGC AACCCCCGCTGCTGTGGGACCTACTACA<u>ATG</u>GCTT CAGGCGGTGGCGCACCAATGGCAGACAATAACGAA GGCGCCGACGGAGTGGGTAATGCCTCAGGAAATTG GCATTGCGATTCCACATGGCTGGGCGACAGAGTCA | 281 | MAADGYLPDWLE DNLSEGIREWWD LKPGAPKPKANQ QKQDDGRGLVLP GYKYLGPFNGLD KGEPVNAADAAA LEHDKAYDQQLK AGDNPYLRYNHA DAEFQERLQEDT SFGGNLGRAVFQ AKKRVLEPLGLV EEGAK*T*APGKKR PVEQSPQEPDSS SGIGKTGQPAK KRLNFGQTGDSE SVPDPQPLGEPP ATPAAVGPTTMA SGGGAPMADNNE GADGVGNASGNW HCDSTWLGDRVI TTSTRTWALPTY NNHLYKQISSAS TGASNDNHYFGY STPWGYFDFNRF HCHFSPRDWQRL INNNWGFRPKRL NFKLFNIQVKEV TTNDGVTTIANN LTSTVQVFSDSE |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Muta- tion | Nucleic acid sequence of the synthesised fragment to clone into the AAV6 Rep Cap vector using restriction sites HindIII and AgeI | SEQ ID NO | Capsid protein sequence |
|---|---|---|---|---|
| | | TCACCACCAGCACCCGAACATGGGCCTTGCCCACC | | YQLPYVLGSAHQ |
| | | TATAACAACCACCTCTACAAGCAAATCTCCAGTGC | | GCLPPFPADVFM |
| | | TTCAACGGGGGCCAGCAACGACAACCACTACTTCG | | IPQYGYLTLNNG |
| | | GCTACAGCACCCCCTGGGGGTATTTTGATTTCAAC | | SQAVGRSSFYCL |
| | | AGATTCCACTGCCATTTCTCACCACGTGACTGGCA | | EYFPSQMLRTGN |
| | | GCGACTCATCAACAACAATTGGGGATTCCGGCCCA | | NFTFSYTFEDVP |
| | | AGAGACTCAACTTCAAGCTCTTCAACATCCAAGTC | | FHSSYAHSQSLD |
| | | AAGGAGGTCACGACGAATGATGGCGTCACGACCAT | | RLMNPLIDQYLY |
| | | CGCTAATAACCTTACCAGCACGGTTCAAGTCTTCT | | YLNRTQNQSGSA |
| | | CGGACTCGGAGTACCAGTTGCCGTACGTCCTCGGC | | QNKDLLFSRGSP |
| | | TCTGCGCACCAGGGCTGCCTCCCTCCGTTCCCGGC | | AGMSVQPKNWLP |
| | | GGACGTGTTCATGATTCCGCAGTACGGCTACCTAA | | GPCYRQQRVSKT |
| | | CGCTCAACAATGGCAGCCAGGCAGTGGGACGGTCA | | KTDNNNSNFTWT |
| | | TCCTTTTACTGCCTGGAATATTTCCCATCGCAGAT | | GASKYNLNGRES |
| | | GCTGAGAACGGGCAATAACTTTACCTTCAGCTACA | | IINPGTAMASHK |
| | | CCTTCGAGGACGTGCCTTTCCACAGCAGCTACGCG | | DDKDKFFPMSGV |
| | | CACAGCCAGAGCCTGGACCGGCTGATGAATCCTCT | | MIFGKESAGASN |
| | | CATCGACCAGTACCTGTATTACCTGAACAGAACTC | | TALDNVMITDEE |
| | | AGAATCAGTCCGGAAGTGCCCAAAACAAGGACTTG | | EIKATNPVATER |
| | | CTGTTTAGCCGGGGGTCTCCAGCTGGCATGTCTGT | | FGTVAVNDQSSS |
| | | TCAGCCCAAAAACTGGCTACCTGGACCCGTGTTACC | | TDPATGDVHVMG |
| | | GGCAGCAGCGCGTTTCTAAAACAAAAACAGACAAC | | ALPGMVWQDRDV |
| | | AACAACAGCAACTTTACCTGGACTGGTGCTTCAAA | | YLQGPIWAKIPH |
| | | ATATAACCTTAATGGGCGTGAATCTATAATCAACC | | TDGHFHPSPLMG |
| | | CTGGCACTGCTATGGCCTCACACAAAGACGACAAA | | GFGLKNPPPQIL |
| | | GACAAGTTCTTTCCCATGAGCGGTGTCATGATTTT | | IKNTPVPANPPA |
| | | TGGAAAGGAGAGCGCCGGAGCTTCAAACACTGCAT | | EFSATKFASFIT |
| | | TGGACAATGTCATGATCACAGACGAAGAGGAAATC | | QYSTGQVSVEIE |
| | | AAAGCCACTAACCCCGTGGCCACCGAAAGATTTGG | | WELQKENSKRWN |
| | | GACTGTGGCAGTCAATGACCAGAGCAGCAGCACAG | | PEVQYTSNYAKS |
| | | ACCCTGCGACCGGAGATGTGCATGTTATGGGAGCC | | ANVDFTVDNNGL |
| | | TTACCTGGAATGGTGTGGCAAGACAGAGACGTATA | | YTEPRPIGTRYL |
| | | CCTGCAGGGTCCTATTTGGGCCAAAATTCCTCACA | | TRPL |
| | | CGGATGGACACTTTCACCCGTCTCCTCTCATGGGC | | |
| | | GGCTTTGGACTTAAGAACCCGCCTCCTCAGATCCT | | |
| | | CATCAAAAACACGCCTGTTCCTGCGAATCCTCCGG | | |
| | | CAGAGTTTTCGGCTACAAAGTTTGCTTCATTCATC | | |
| | | ACCCAGTATTCCACAGGACAAGTGAGCGTGGAGAT | | |
| | | TGAATGGGAGCTGCAGAAAGAAAACAGCAAACGCT | | |
| | | GGAATCCCGAAGTGCAGTATACATCTAACTATGCA | | |
| | | AAATCTGCCAACGTTGATTTCACTGTGGACAACAA | | |
| | | TGGACTTTATACTGAGCCTCGCCCCATTGGCACCC | | |
| | | GTTACCTCACCCGTCCCCTGTAAttgtgtgttaat | | |
| | | caataa[accggt] | | |
| 16 | F129L, H642N, and L584N | ggtaccaaaacaaatgttctcgtcacgtgggcatg aatctgatgctgtttccctgcagacaatgcgagag aatgaatcagaattcaaatatctgcttcactcacg gacagaaagactgtttagagtgctttcccgtgtca gaatctcaacccgtttctgtcgtcaaaaaggcgta tcagaaactgtgctacattcatcatatcatgggaa aggtgccagacgcttgcactgcctgcgatctggtc aatgtggatttggatgactgcatctttgaacaata a_tgatttaaatcaggt_ATGGCTGCCGATGGTTAT CTTCCAGATTGGCTCGAGGACAACCTCTCTGAGGG CATTCGCGAGTGGTGGGACTTGAAACCTGGAGCCC CGAAACCCAAACCAACCAGCAAAGCAGGACGAC GGCCGGGGTCTGGTGCTTCCTGGCTACAAGTACCT CGGACCCTTCAACGGACTCGACAAGGGGGAGCCCG TCAACGCGGCGGATGCAGCGGCCCTCGAGCACGAC AAGGCCTACGACCAGCAGCTCAAAGCGGGTGACAA TCCGTACCTGCGGTATAACCACGCCGACGCCGAGT TTCAGGAGCGTCTGCAAGAAGATACGTCTTTTGGG GGCAACCTCGGGCGAGCAGTCTTCCAGGCCAAGAA GAGGGTTCTCGAACCTTTAGGTCTGGTTGAGGAAG GTGCTAAG_ACG_GCTCCTGGAAAGAAACGTCCGGTA GAGCAGTCGCCACAAGAGCCAGACTCCTCCTCGGG | 282 | <u>M</u>AADGYLPDWLE DNLSEGIREWWD LKPGAPKPKANQ QKQDDGRGLVLP GYKYLGPFNGLD KGEPVNAADAAA LEHDKAYDQQLK AGDNPYLRYNHA DAEFQERLQEDT SFGNLGRAVFQ AKKRVLEPLGLV EEGAK*T*APGKKR PVEQSPQEPDSS SGIGKTGQQPAK KRLNFGQTGDSE SVPDPQPLGEPP ATPAAVGPTTMA SGGGAPMADNNE GADGVGNASGNW HCDSTWLGDRVI TTSTRTWALPTY NNHLYKQISSAS |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Mutation | Nucleic acid sequence of the synthesised fragment to clone into the AAV6 Rep Cap vector using restriction sites HindIII and AgeI | SEQ ID NO | Capsid protein sequence |
|---|---|---|---|---|
| | | CATTGGCAAGACAGGCCAGCAGCCCGCTAAAAGA | | TGASNDNHYFGY |
| | | GACTCAATTTTGGTCAGACTGGCGACTCAGAGTCA | | STPWGYFDFNRF |
| | | GTCCCCGACCCACAACCTCTCGGAGAACCTCCAGC | | HCHFSPRDWQRL |
| | | AACCCCCGCTGCTGTGGGACCTACTACAATGGCTT | | INNNWGFRPKRL |
| | | CAGGCGGTGGCGCACCAATGGCAGACAATAACGAA | | NFKLFNIQVKEV |
| | | GGCGCCGACGGAGTGGGTAATGCCTCAGGAAATTG | | TTNDGVTTIANN |
| | | GCATTGCGATTCCACATGGCTGGGCGACAGAGTCA | | LTSTVQVFSDSE |
| | | TCACCACCAGCACCCGAACATGGGCCTTGCCCACC | | YQLPYVLGSAHQ |
| | | TATAACAACCACCTCTACAAGCAAATCTCCAGTGC | | GCLPPFPADVFM |
| | | TTCAACGGGGGCCAGCAACGACAACCACTACTTCG | | IPQYGYLTLNNG |
| | | GCTACAGCACCCCCTGGGGGTATTTTGATTTCAAC | | SQAVGRSSFYCL |
| | | AGATTCCACTGCCATTTCTCACCACGTGACTGGCA | | EYFPSQMLRTGN |
| | | GCGACTCATCAACAACAATTGGGGATTCGGCCCA | | NFTFSYTFEDVP |
| | | AGAGACTCAACTTCAAGCTCTTCAACATCCAAGTC | | FHSSYAHSQSLD |
| | | AAGGAGGTCACGACGAATGATGGCGTCACGACCAT | | RLMNPLIDQYLY |
| | | CGCTAATAACCTTACCAGCACGGTTCAAGTCTTCT | | YLNRTQNQSGSA |
| | | CGGACTCGGAGTACCAGTTGCCGTACGTCCTCGGC | | QNKDLLFSRGSP |
| | | TCTGCGCACCAGGGCTGCCTCCCTCCGTTCCCGGC | | AGMSVQPKNWLP |
| | | GGACGTGTTCATGATTCCGCAGTACGGCTACCTAA | | GPCYRQQRVSKT |
| | | CGCTCAACAATGGCAGCCAGGCAGTGGGACGGTCA | | KTDNNNSNFTWT |
| | | TCCTTTTACTGCCTGGAATATTTCCCATCGCAGAT | | GASKYNLNGRES |
| | | GCTGAGAACGGGCAATAACTTTACCTTCAGCTACA | | IINPGTAMASHK |
| | | CCTTCGAGGACGTGCCTTTCCACAGCAGCTACGCG | | DDKDKFFPMSGV |
| | | CACAGCCAGAGCCTGGACCGGCTGATGAATCCTCT | | MIFGKESAGASN |
| | | CATCGACCAGTACCTGTATTACCTGAACAGAACTC | | TALDNVMITDEE |
| | | AGAATCAGTCCGGAAGTGCCCAAAACAAGGACTTG | | EIKATNPVATER |
| | | CTGTTTAGCCGGGGGTCTCCAGCTGGCATGTCTGT | | FGTVAVNNQSSS |
| | | TCAGCCCAAAAACTGGCTACCTGGACCCGTTACC | | TDPATGDVHVMG |
| | | GGCAGCAGCGCGTTTCTAAAACAAAAACAGACAAC | | ALPGMVWQDRDV |
| | | AACAACAGCAACTTTACCTGGACTGGTGCTTCAAA | | YLQGPIWAKIPH |
| | | ATATAACCTTAATGGGCGTGAATCTATAATCAACC | | TDGHFHPSPLMG |
| | | CTGGCACTGCTATGGCCTCACACAAAGACGACAAA | | GFGLKNPPPQIL |
| | | GACAAGTTCTTTCCCATGAGCGGTGTCATGATTTT | | IKNTPVPANPPA |
| | | TGGAAAGGAGAGCGCCGGAGCTTCAAACACTGCAT | | EFSATKFASFIT |
| | | TGGACAATGTCATGATCACAGACGAAGAGGAAATC | | QYSTGQVSVEIE |
| | | AAAGCCACTAACCCCGTGGCCACCGAAAGATTTGG | | WELQKENSKRWN |
| | | GACTGTGGCAGTCAATAACCAGAGCAGCAGCACAG | | PEVQYTSNYAKS |
| | | ACCCTGCGACCGGAGATGTGCATGTTATGGGAGCC | | ANVDFTVDNNGL |
| | | TTACCTGGAATGGTGTGGCAAGACAGAGACGTATA | | YTEPRPIGTRYL |
| | | CCTGCAGGGTCCTATTTGGGCCAAAATTCCTCACA | | TRPL |
| | | CGGATGGACACTTTCACCCGTCTCCTCTCATGGGC | | |
| | | GGCTTTGGACTTAAGAACCCGCCTCCTCAGATCCT | | |
| | | CATCAAAAACACGCCTGTTCCTGCGAATCCTCCGG | | |
| | | CAGAGTTTTCGGCTACAAAGTTTGCTTCATTCATC | | |
| | | ACCCAGTATTCCACAGGACAAGTGAGCGTGGAGAT | | |
| | | TGAATGGGAGCTGCAGAAAGAAAACAGCAAACGCT | | |
| | | GGAATCCCGAAGTGCAGTATACATCTAACTATGCA | | |
| | | AAATCTGCCAACGTTGATTTCACTGTGGACAACAA | | |
| | | TGGACTTTATACTGAGCCTCGCCCCATTGGCACCC | | |
| | | GTTACCTCACCCGTCCCCTGTAAttgtgtgttaat | | |
| | | caataa[accggt] | | |
| 17 | F129L, H642N and L584H | ggtaccaaaacaaatgttctcgtcacgtgggcatg aatctgatgctgtttccctgcagacaatgcgagag aatgaatcagaattcaaatatctgcttcactcacg gacagaaagactgtttagagtgctttcccgtgtca gaatctcaacccgtttctgtcgtcaaaaaggcgta tcagaaactgtgctacattcatcatatcatgggaa aggtgccagacgcttgcactgcctgcgatctggtc aatgtggatttggatgactgcatctttgaacaata a*atgatttaaatcaggt*<u>ATG</u>GCTGCCGATGGTTAT CTTCCAGATTGGCTCGAGGACAACCTCTCTGAGGG CATTCGCGAGTGGTGGGACTTGAAACCTGGAGCCC CGAAACCCAAAGCCAACCAGCAAAAGCAGGACGAC GGCCGGGGTCTGGTGCTTCCTGGCTACAAGTACCT CGGACCCTTCAACGGACTCGACAAGGGGGAGCCCG TCAACGCGGCGGATGCAGCGGCCCTCGAGCACGAC | 283 | <u>MAADGYLPDWLE DNLSEGIREWWD LKPGAPKPKANQ QKQDDGRGLVLP GYKYLGPFNGLD KGEPVNAADAAA LEHDKAYDQQLK AGDNPYLRYNHA DAEFQERLQEDT SFGGNLGRAVFQ AKKRVLEPLGLV EECAK$T$APGKKR PVEQSPQEPDSS SGIGKTGQQPAK KRLNFGQTGDSE</u> |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Mutation | Nucleic acid sequence of the synthesised fragment to clone into the AAV6 Rep Cap vector using restriction sites HindIII and AgeI | SEQ ID NO | Capsid protein sequence |
|---|---|---|---|---|
| | | AAGGCCTACGACCAGCAGCTCAAAGCGGGTGACAA TCCGTACCTGCGGTATAACCACGCCGACGCCGAGT TTCAGGAGCGTCTGCAAGAAGATACGTCTTTTGGG GGCAACCTCGGGCGAGCAGTCTTCCAGGCCAAGAA GAGGGTTCTCGAACCTTTAGGTCTGGTTGAGGAAG GTGCTAAG*ACG*GCTCCTGGAAAGAAACGTCCGGTA GAGCAGTCGCCACAAGAGCCAGACTCCTCCTCGGG CATTGGCAAGACAGGCCAGCAGCCCGCTAAAAAGA GACTCAATTTTGGTCAGACTGGCGACTCAGAGTCA GTCCCCGACCCACAACCTCTCGGAGAACCTCCAGC AACCCCCGCTGCTGTGGGACCTACTACATGGCTT CAGGCGGTGGCGCACCAATGGCAGACAATAACGAA GGCGCCGACGGAGTGGGTAATGCCTCAGGAAATTG GCATTGCGATTCCACATGGCTGGGCGACAGAGTCA TCACCACCAGCACCCGAACATGGGCCTTGCCCACC TATAACAACCACCTCTACAAGCAAATCTCCAGTGC TTCAACGGGGGCCAGCAACGACAACCACTACTTCG GCTACAGCACCCCCTGGGGGTATTTTGATTTCAAC AGATTCCACTGCCATTTCTCACCACGTGACTGGCA GCGACTCATCAACAACAATTGGGGATTCCGGCCCA AGAGACTCAACTTCAAGCTCTTCAACATCCAAGTC AAGGAGGTCACGACGAATGATGGCGTCACGACCAT CGCTAATAACCTTACCAGCACGGTTCAAGTCTTCT CGGACTCGGAGTACCAGTTGCCGTACGTCCTCGGC TCTGCGCACCAGGGCTGCCTCCCTCCGTTCCCGGC GGACGTGTTCATGATTCCGCAGTACGGCTACCTAA CGCTCAACAATGGCAGCCAGGCAGTGGGACGGTCA TCCTTTTACTGCCTGGAATATTTCCCATCGCAGAT GCTGAGAACGGGCAATAACTTTACCTTCAGCTACA CCTTCGAGGACGTGCCTTTCCACAGCAGCTACGCG CACAGCCAGAGCCTGGACCGGCTGATGAATCCTCT CATCGACCAGTACCTGTATTACCTGAACAGAACTC AGAATCAGTCCGGAAGTGCCCAAAACAAGGACTTG CTGTTTAGCCGGGGGTCTCCAGCTGGCATGTCTGT TCAGCCCAAAAACTGGCTACCTGGACCCTGTTACC GGCAGCAGCGCGTTTCTAAAACAAAAACAGACAAC AACAACAGCAACTTTACCTGGACTGGTGCTTCAAA ATATAACCTTAATGGGCGTGAATCTATAATCAACC CTGGCACTGCTATGGCCTCACACAAAGACGACAAA GACAAGTTCTTTCCCATGAGCGGTGTCATGATTTT TGGAAAGGAGAGCGCCGGAGCTTCAAACACTGCAT TGGACAATGTCATGATCACAGACGAAGAGGAAATC AAAGCCACTAACCCCGTGGCCACCGAAAGATTTGG GACTGTGGCAGTCAATCACCAGAGCAGCAGCACAG ACCCTGCGACCGGAGATGTGCATGTTATGGGAGCC TTACCTGGAATGGTGTGGCAAGACAGAGACGTATA CCTGCAGGGTCCTATTTGGGCAAAATTCCTCACA CGGATGGACACTTTCACCCGTCTCCTCTCATGGGC GGCTTTGGACTTAAGAACCCGCCTCCTCAGATCCT CATCAAAAACACGCCTGTTCCTGCGAATCCTCCGG CAGAGTTTTCGGCTACAAAGTTTGCTTCATTCATC ACCCAGTATTCCACAGGACAAGTGAGCGTGGAGAT TGAATGGGAGCTGCAGAAAGAAAACAGCAAACGCT GGAATCCCGAAGTGCAGTATACATCTAACTATGCA AAATCTGCCAACGTTGATTTCACTGTGGACAACAA TGGACTTTATACTGAGCCTCGCCCCATTGGCACCC GTTACCTCACCCGTCCCCTGTAA*tgtgtgttaat caataa*accggt | | SVPDPQPLGEPP ATPAAVGPTTMA SGGGAPMADNNE GADGVGNASGNW HCDSTWLGDRVI TTSTRTWALPTY NNHLYKQISSAS TGASNDNHYFGY STPWGYFDFNRF HCHFSPRDWQRL INNNWGFRPKRL NFKLFNIQVKEV TTNDGVTTIANN LTSTVQVFSDSE YQLPYVLGSAHQ GCLPPFPADVFM IPQYGYLTLNNG SQAVGRSSFYCL EYFPSQMLRTGN NFTFSYTFEDVP FHSSYAHSQSLD RLMNPLIDQYLY YLNRTQNQSGSA QNKDLLFSRGSP AGMSVQPKNWLP GPCYRQQRVSKT KTDNNNSNFTWT GASKYNLNGRES IINPGTAMASHK DDKDKFFPMSGV MIFGKESAGASN TALDNVMITDEE EIKATNPVATER FGTVAVNHQSSS TDPATGDVHVMG ALPGMVWQDRDV YLQGPIWAKIPH TDGHFHPSPLMG GFGLKNPPPQIL IKNTPVPANPPA EFSATKFASFIT QYSTGQVSVEIE WELQKENSKRWN PEVQYTSNYAKS ANVDFTVDNNGL YTEPRPIGTRYL TRPL |
| 18 | F129L, H642N, and V598L | ggtaccaaaacaaatgttctcgtcacgtgggcatg aatctgatgctgtttccctgcagacaatgcgagag aatgaatcagaattcaaatatctgcttcactcacg gacagaaagactgtttagagtgctttccgtgtca gaatctcaacccgtttctgtcgtcaaaaaggcgta tcagaaactgtgctacattcatcatatcatgggaa aggtgccagacgcttgcactgcctgcgatctggtc aatgtggatttggatgactgcatctttgaacaata | 284 | <u>M</u>AADGYLPDWLE DNLSEGIREWWD LKPGAPKPKANQ QKQDDGRGLVLP GYKYLGPFNGLD KGEPVNAADAAA LEHDKAYDQQLK AGDNPYLRYNHA |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Mutation | Nucleic acid sequence of the synthesised fragment to clone into the AAV6 Rep Cap vector using restriction sites HindIII and AgeI | SEQ ID NO | Capsid protein sequence |
|---|---|---|---|---|
| | | a*atgatttaaatcaggt*<u>ATG</u>GCTGCCGATGGTTAT CTTCCAGATTGGCTCGAGGACAACCTCTCTGAGGG CATTCGCGAGTGGTGGGACTTGAAACCTGGAGCCC CGAAACCCAAAGCCAACCAGCAAAAGCAGGACGAC GGCCGGGGTCTGGTGCTTCCTGGCTACAAGTACCT CGGACCCTTCAACGGACTCGACAAGGGGGAGCCCG TCAACGCGGCGGATGCAGCGGCCCTCGAGCACGAC AAGGCCTACGACCAGCAGCTCAAAGCGGGTGACAA TCCGTACCTGCGGTATAACCACGCCGACGCCGAGT TTCAGGAGCGTCTGCAAGAAGATACGTCTTTTGGG GGCAACCTCGGGCGAGCAGTCTTCCAGGCCAAGAA GAGGGTTCTCGAACCTTTAGGTCTGGTTGAGGAAG GTGCTAAG*ACG*GCTCCTGGAAAGAAACGTCCGGTA GAGCAGTCGCCACAAGAGCCAGACTCCTCCTCGGG CATTGGCAAGACAGGCCAGCAGCCCGCTAAAAAGA GACTCAATTTTGGTCAGACTGGCGACTCAGAGTCA GTCCCCGACCCACAACCTCTCGGAGAACCTCCAGC AACCCCCGCTGCTGTGGGACCTACTACA<u>ATG</u>GCTT CAGGCGGTGGCGCACCAATGGCAGACAATAACGAA GGCGCCGACGGAGTGGGTAATGCCCTCAGGAAATTG GCATTGCGATTCCACATGGCTGGGCGACAGAGTCA TCACCACCAGCACCCGAACATGGGCCTTGCCCACC TATAACAACCACCTCTACAAGCAAATCTCCAGTGC TTCAACGGGGCCAGCAACGACAACCACTACTTCG GCTACAGCACCCCCTGGGGGTATTTTGATTTCAAC AGATTCCACTGCCATTTCTCACCACGTGACTGGCA GCGACTCATCAACAACAATTGGGGATTCCGGCCCA AGAGACTCAACTTCAAGCTCTTCAACATCCAAGTC AAGGAGGTCACGACGAATGATGGCGTCACGACCAT CGCTAATAACCTTACCAGCACGGTTCAAGTCTTCT CGGACTCGGAGTACCAGTTGCCGTACGTCCTCGGC TCTGCGCACCAGGGCTGCCTCCCTCCGTTCCCGGC GGACGTGTTCATGATTCCGCAGTACGGCTACCTAA CGCTCAACAATGGCAGCCAGGCAGTGGGACGGTCA TCCTTTTACTGCCTGGAATATTTCCCATCGCAGAT GCTGAGAACGGGCAATAACTTTACCTTCAGCTACA CCTTCGAGGACGTGCCTTTCCACAGCAGCTACGCG CACAGCCAGAGCCTGGACCGGCTGATGAATCCTCT CATCGACCAGTACCTGTATTACCTGAACAGAACTC AGAATCAGTCCGGAAGTGCCCAAAACAAGGACTTG CTGTTTAGCCGGGGGTCTCCAGCTGGCATGTCTGT TCAGCCCAAAAACTGGCTACCTGGACCCGTTACC GGCAGCAGCGCGTTTCTAAAACAAAAACAGACAAC AACAACAGCAACTTTACCTGGACTGGTGCTTCAAA ATATAACCTTAATGGGCGTGAATCTATAATCAACC CTGGCACTGCTATGGCCTCACACAAAGACGACAAA GACAAGTTCTTTCCCATGAGCGGTGTCATGATTTT TGGAAAGGAGAGCGCCGGAGCTTCAAACACTGCAT TGGACAATGTCATGATCACAGACGAAGAGGAAATC AAAGCCACTAACCCCGTGGCCACCGAAAGATTTGG GACTGTGGCAGTCAATCTCCAGAGCAGCAGCACAG ACCCTGCGACCGGAGATGTGCATCTTATGGGAGCC TTACCTGGAATGGTGTGGCAAGACAGAGACGTATA CCTGCAGGGTCCTATTTGGGCCAAAATTCCTCACA CGGATGGACACTTTCACCCGTCTCCTCTCATGGGC GGCTTTGGACTTAAGAACCCGCCTCCTCAGATCCT CATCAAAAACACGCCTGTTCCTGCGAATCCTCCGG CAGAGTTTTCGGCTACAAAGTTTGCTTCATTCATC ACCCAGTATTCCACAGGACAAGTGAGCGTGGAGAT TGAATGGGAGCTGCAGAAAGAAAACAGCAAACGCT GGAATCCCGAAGTGCAGTATACATCTAACTATGCA AAATCTGCCAACGTTGATTTCACTGTGGACAACAA TGGACTTTATACTGAGCCTCGCCCCATTGGCACCC GTTACCTCACCCGTCCCCTGTAATTGTGTGTTAAT CAATAA[ACCGGT] | | DAEFQERLQEDT SFGGNLGRAVFQ AKKRVLEPLGLV EEGAK*T*APGKKR PVEQSPQEPDSS SGIGKTGQQPAK KRLNFGQTGDSE SVPDPQPLGEPP ATPAAVGPTT<u>M</u>A SGGGAPMADNNE GADGVGNASGNW HCDSTWLGDRVI TTSTRTWALPTY NNHLYKQISSAS TGASNDNHYFGY STPWGYFDFNRF HCHFSPRDWQRL INNNWGFRPKRL NFKLFNIQVKEV TTNDGVTTIANN LTSTVQVFSDSE YQLPYVLGSAHQ GCLPPFPADVFM IPQYGYLTLNNG SQAVGRSSFYCL EYFPSQMLRTGN NFTFSYTFEDVP FHSSYAHSQSLD RLMNPLIDQYLY YLNRTQNQSGSA QNKDLLFSRGSP AGMSVQPKNWLP GPCYRQQRVSKT KTDNNNSNFTWT GASKYNLNGRES IINPGTAMASHK DDKDKFFPMSGV MIFGKESAGASN TALDNVMITDEE EIKATNPVATER FGTVAVNLQSSS TDPATGDVHLMG ALPGMVWQDRDV YLQGPIWAKIPH TDGHFHPSPLMG GFGLKNPPPQIL IKNTPVPANPPA EFSATKFASFIT QYSTGQVSVEIE WELQKENSKRWN PEVQYTSNYAKS ANVDFTVDNNGL YTEPRPIGTRYL TRPL |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Mutation | Nucleic acid sequence of the synthesised fragment to clone into the AAV6 Rep Cap vector using restriction sites HindIII and AgeI | SEQ ID NO | Capsid protein sequence |
|---|---|---|---|---|
| 19 | F129L, H642N, and V598I | ggtaccaaaacaaatgttctcgtcacgtgggcatg aatctgatgctgtttccctgcagacaatgcgagag aatgaatcagaattcaaatatctgcttcactcacg gacagaaagactgtttagagtgctttcccgtgtca gaatctcaacccgtttctgtcgtcaaaaaggcgta tcagaaactgtgctacattcatatatcatgggaa aggtgccagacgcttgcactgcctgcgatctggtc aatgtggatttggatgactgcatctttgaacaata a*atgatttaaatcaggt*<u>ATG</u>GCTGCCGATGGTTAT CTTCCAGATTGGCTCGAGGACAACCTCTCTGAGGG CATTCGCGAGTGGTGGGACTTGAAACCTGGAGCCC CGAAACCCAAAGCCAACCAGCAAAAGCAGGACGAC GGCCGGGGTCTGGTGCTTCCTGGCTACAAGTACCT CGGACCCTTCAACGGACTCGACAAGGGGGAGCCCG TCAACGCGGCGGATGCAGCGGCCCTCGAGCACGAC AAGGCCTACGACCAGCAGCTCAAAGCGGGTGACAA TCCGTACCTGCGGTATAACCACGCCGACGCCGAGT TCAGGAGCGTCTGCAAGAAGATACGTCTTTTGGG GGCAACCTCGGGCGAGCAGTCTTCCAGGCCAAGAA GAGGGTTCTCGAACCTTTAGGTCTGGTTGAGGAAG GTGCTAAG*ACG*GCTCCTGGAAAGAAACGTCCGGTA GAGCAGTCGCCACAAGAGCCAGACTCCTCCTCGGG CATTGGCAAGACAGGCCAGCAGCCCGCTAAAAAGA GACTCAATTTTGGTCAGACTGGCGACTCAGAGTCA GTCCCCGACCCACAACCTCTCGGAGAACCTCCAGC AACCCCCGCTGCTGTGGGACCTACTACATGGCTT CAGGCGGTGGCGCACCAATGGCAGACAATAACGAA GGCGCCGACGGAGTGGGTAATGCCTCAGGAAATTG GCATTGCGATTCCACATGGCTGGGCGACAGAGTCA TCACCACCAGCACCCGAACATGGCCTTGCCCACC TATAACAACCACCTCTACAAGCAAATCTCCAGTGC TTCAACGGGGCCAGCAACGACAACCACTACTTCG GCTACAGCACCCCCTGGGGGTATTTTGATTTCAAC AGATTCCACTGCCATTTCTCACCACGTGACTGGCA GCGACTCATCAACAACAATTGGGGATTCCGGCCCA AGAGACTCAACTTCAAGCTCTTCAACATCCAAGTC AAGGAGGTCACGACGAATGATGGCGTCACGACCAT CGCTAATAACCTTACCAGCACGGTTCAAGTCTTCT CGGACTCGGAGTACCAGTTGCCGTACGTCCTCGGC TCTGCGCACCAGGGCTGCCTCCCTCCGTTCCCGGC GGACGTGTTCATGATTCCGCAGTACGGCTACCTAA CGCTCAACAATGGCAGCCAGGCAGTGGGACGGTCA TCCTTTTACTGCCTGGAATATTTCCCATCGCAGAT GCTGAGAACGGGCAATAACTTTACCTTCAGCTACA CCTTCGAGGACGTGCCTTTCCACAGCAGCTACGCG CACAGCCAGAGCCTGGACCGGCTGATGAATCCTCT CATCGACCAGTACCTGTATTACCTGAACAGAACTC AGAATCAGTCCGGAAGTGCCCAAAACAAGGACTTG CTGTTTAGCCGGGGGTCTCCAGCTGGCATGTCTGT TCAGCCCAAAAACTGGCTACCTGGACCCTGTTACC GGCAGCAGCGCGTTTCTAAAACAAAAACAGACAAC AACAACAGCAACTTTACCTGGACTGGTGCTTCAAA ATATAACCTTAATGGGCGTGAATCTATAATCAACC CTGGCACTGCTATGGCCTCACACAAAGACGACAAA GACAAGTTCTTTCCCATGAGCGGTGTCATGATTTT TGGAAAGGAGAGCGCCGGAGCTTCAAACACTGCAT TGGACAATGTCATGATCACAGACGAAGAGGAAATC AAAGCCACTAACCCCGTGGCCACCGAAAGATTTGG GACTGTGGCAGTCAATCTCCAGAGCAGCAGCACAG ACCCTGCGACCGGAGATGTGCATATTATGGGAGCC TTACCTGGAATGGTGTGGCAAGACAGAGACGTATA CCTGCAGGGTCCTATTTGGGCCAAAATTCCTCACA CGGATGGACACTTTCACCCGTCTCCTCTCATGGGC GGCTTTGGACTTAAGAACCCGCCTCCTCAGATCCT CATCAAAAACACGCCTGTTCCTGCGAATCCTCCGG CAGAGTTTTCGGCTACAAAGTTTGCTTCATTCATC ACCCAGTATTCCAGGACAAGTGAGCGTGGAGAT TGAATGGGAGCTGCAGAAAGAAAACAGCAAACGCT | 285 | <u>M</u>AADGYLPDWLE DNLSEGIREWWD LKPGAPKPKANQ QKQDDGRGLVLP GYKYLGPFNGLD KGEPVNAADAAA LEHDKAYDQQLK AGDNPYLRYNHA DAEFQERLQEDT SFGGNLGRAVFQ AKKRVLEPLGLV EEGAK*T*APGKKR PVEQSPQEPDSS SGIGKTGQQPAK KRLNFGQTGDSE SVPDPQPLGEPP ATPAAVGPTTMA SGGGAPMADNNE GADGVGNASGNW HCDSTWLGDRVI TTSTRTWALPTY NNHLYKQISSAS TGASNDNHYFGY STPWGYFDFNRF HCHFSPRDWQRL INNNWGFRPKRL NFKLFNIQVKEV TTNDGVTTIANN LTSTVQVFSDSE YQLPYVLGSAHQ GCLPPFPADVFM IPQYGYLTLNNG SQAVGRSSFYCL EYFPSQMLRTGN NFTFSYTFEDVP FHSSYAHSQSLD RLMNPLIDQYLY YLNRTQNQSGSA QNKDLLFSRGSP AGMSVQPKNWLP GPCYRQQRVSKT KTDNNNSNFTWT GASKYNLNGRES IINPGTAMASHK DDKDKFFPMSGV MIFGKESAGASN TALDNVMITDEE EIKATNPVATER FGTVAVNLQSSS TDPATGDVHIMG ALPGMVWQDRDV YLQGPIWAKIPH TDGHFHPSPLMG GFGLKNPPPQIL IKNTPVPANPPA EFSATKFASFIT QYSTGQVSVEIE WELQKENSKRWN PEVQYTSNYAKS ANVDFTVDNNGL YTEPRPIGTRYL TRPL |

TABLE 1-continued

Modified capsid AAV6 constructs. In bold is the AAV6 rep sequence. In italics is a spacer sequence. The nucleic acid capsid sequence is in uppercase. Boxed sequences refer to an AgeI restriction site. Underlined sequences refer to the VP1 start. Bold and italisized sequences refer to the VP2 start site. Bold and underlined sequences refer to the VP3 start site.

| SEQ ID NO | Mutation | Nucleic acid sequence of the synthesised fragment to clone into the AAV6 Rep Cap vector using restriction sites HindIII and AgeI | SEQ ID NO | Capsid protein sequence |
|---|---|---|---|---|
| | | GGAATCCCGAAGTGCAGTATACATCTAACTATGCA AAATCTGCCAACGTTGATTTCACTGTGGACAACAA TGGACTTTATACTGAGCCTCGCCCCATTGGCACCC GTTACCTCACCCGTCCCCTGTAA*ttgtgtgttaat caataa*accggt | | |

In some cases, a modification can be of an AAV serotype 6 capsid. In some cases an AAV capsid protein can be mutated or otherwise modified. AAV capsid proteins that can be mutated can be any one of the viral serotypes of Table 2. A modified AAV capsid can comprise homology to any one of the protein sequences of SEQ ID NO: 20 to SEQ ID NO: 24 or nucleic acid sequences of SEQ ID NO: 286 to SEQ ID NO: 290 from about 10%, 15%, 20%, 25%, 30%, 35%, 40%, 45%, 50%, 55%, 60%, 65%, 70%, 75%, 80%, 85% 90%, 91%, 92%, 93%, 94%, 95%, 96%, 97%, 98%, 99% or up to 100%. In some cases, a WT AAV, or control AAV, can comprise homology to any one of the protein sequences of SEQ ID NO: 20 to SEQ ID NO: 24 or nucleic acid sequences of SEQ ID NO: 286 to SEQ ID NO: 290 from about 10%, 15%, 20%, 25%, 30%, 35%, 40%, 45%, 50%, 55%, 60%, 65%, 70%, 75%, 80%, 85% 90%, 91%, 92%, 93%, 94%, 95%, 96%, 97%, 98%, 99% or up to 100%. In some cases a subject mutated or modified vector can comprise homology to any one of the sequences disclosed in Table 13, SEQ ID NO: 214 to SEQ ID NO: 220 from about 10%, 15%, 20%, 25%, 30%, 35%, 40%, 45%, 50%, 55%, 60%, 65%, 70%, 75%, 80%, 85% 90%, 91%, 92%, 93%, 94%, 95%, 96%, 97%, 98%, 99% or up to 100%.

TABLE 2

WT AAV capsid sequences

| SEQ ID NO | Virus Serotype | Protein sequence | SEQ ID NO | Nucleic acid sequence |
|---|---|---|---|---|
| 20 | AAV6 | MAADGYLPDWLEDNLSEGIREW WDLKPGAPKPKANQQKQDDGRG LVLPGYKYLGPFNGLDKGEPVN AADAAALEHDKAYDQQLKAGDN PYLRYNHADAEFQERLQEDTSF GGNLGRAVFQAKKRVLEPFGLV EEGAKTAPGKKRPVEQSPQEPD SSSGIGKTGQQPAKKRLNFGQT GDSESVPDPQPLGEPPATPAAV GPTTMASGGGAPMADNNEGADG VGNASGNWHCDSTWLGDRVITT STRTWALPTYNNHLYKQISSAS TGASNDNHYFGYSTPWGYFDFN RFHCHFSPRDWQRLINNNWGFR PKRLNFKLFNIQVKEVTTNDGV TTIANNLTSTVQVFSDSEYQLP YVLGSAHQGCLPPFPADVFMIP QYGYLTLNNGSQAVGRSSFYCL EYFPSQMLRTGNNFTFSYTFED VPFHSSYAHSQSLDRLMNPLID QYLYYLNRTQNQSGSAQNKDLL FSRGSPAGMSVQPKNWLPGPCY RQQRVSKTKTDNNNSNFTWTGA SKYNLNGRESIINPGTAMASHK DDKDKFFPMSGVMIFGKESAGA SNTALDNVMITDEEEIKATNPV ATERFGTVAVNLQSSSTDPATG DVHVMGALPGMVWQDRDVYLQG PIWAKIPHTDGHFHPSPLMGGF GLKHPPPQILIKNTPVPANPPA EFSATKFASFITQYSTGQVSVE IEWELQKENSKRWNPEVQYTSN YAKSANVDFTVDNNGLYTEPRP IGTRYLTRPL | 286 | atggctgccgatggttatct tccagattggctcgaggaca acctctctgagggcattcgc gagtggtgggacttgaaacc tggagccccgaaacccaaag ccaaccagcaaaagcaggac gacggccggggtctggtgct tcctggctacaagtacctcg gacccttcaacggactcgac aaggggagcccgtcaacgc ggcggatgcagcggccctcg agcacgacaaggcctacgac cagcagctcaaagcgggtga caatccgtacctgcggtata accacgccgacgccgagttt caggagcgtctgcaagaaga tacgtctctttgggggcaacc tcgggcgagcagtcttccag gccaagaagagggttctcga acctttggtctggttgagg aaggtgctaagacggctcct ggaaagaaacgtccggtaga gcagtcgccacaagagccag actcctcctcgggcattggc aagacaggccagcagcccgc taaaaagagactcaattttg gtcagactggcgactcagag tcagtccccgacccacaacc tctcggagaacctccagcaa ccccccgctgctgtgggacct actacaatggcttcaggcgg tggcgcaccaatggcagaca ataacgaaggcgccgacgga gtgggtaatgcctcaggaaa ttggcattgcgattccacat ggctgggcgacagagtcatc |

TABLE 2-continued

WT AAV capsid sequences

| SEQ ID NO | Virus Serotype | Protein sequence | SEQ ID NO | Nucleic acid sequence |
|---|---|---|---|---|
| | | | | accaccagcacccgaacatg ggccttgcccacctataaca accacctctacaagcaaatc tccagtgcttcaacgggggc cagcaacgacaaccactact tcggctacagcacccctgg gggtattttgatttcaacag attccactgccatttctcac cacgtgactggcagcgactc atcaacaacaattggggatt ccggcccaagagactcaact tcaagctcttcaacatccaa gtcaaggaggtcacgacgaa tgatggcgtcacgaccatcg ctaataaccttaccagcacg gttcaagtcttctcggactc ggagtaccagttgccgtacg tcctcggctctgcgcaccag ggctgcctcctccgttccc ggcggacgtgttcatgattc cgcagtacggctacctaacg ctcaacaatggcagccaggc agtgggacggtcatccttt actgcctggaatatttccca tcgcagatgctgagaacggg caataactttaccttcagct acaccttcgaggacgtgcct ttccacagcagctacgcgca cagccagagcctggaccggc tgatgaatcctctcatcgac cagtacctgtattacctgaa cagaactcagaatcagtccg gaagtgcccaaaacaaggac ttgctgtttagccgggggtc tccagctggcatgtctgttc agcccaaaaactggctacct ggaccctgttaccggcagca gcgcgtttctaaaacaaaaa cagacaacaacaacagcaac tttacctggactggtgcttc aaaatataaccttaatgggc gtgaatctataatcaaccct ggcactgctatggcctcaca caaagacgacaaagacaagt tctttcccatgagcggtgtc atgattttggaaaggagag cgccggagcttcaaacactg cattggacaatgtcatgatc acagacgaagaggaaatcaa agccactaaccccgtggcca ccgaaagatttgggactgtg gcagtcaatctccagagcag cagcacagaccctgcgaccg gagatgtgcatgttatggga gccttacctggaatggtgtg gcaagacagagacgtatacc tgcagggtcctatttgggcc aaaattcctcacacggatgg acactttcacccgtctcctc tcatgggcggctttggactt aagcacccgcctcctcagat cctcatcaaaaacacgcctg ttcctgcgaatcctccggca gagttttcggctacaaagtt tgcttcattcatcacccagt attccacaggacaagtgagc gtggagattgaatgggagct gcagaaagaaaacagcaaac gctggaatcccgaagtgcag tatacatctaactatgcaaa atctgccaacgttgatttca ctgtggacaacaatggactt tatactgagcctcgcccat tggcacccgttacctcaccc gtcccctgtaa |

TABLE 2-continued

WT AAV capsid sequences

| SEQ ID NO | Virus Serotype | Protein sequence | SEQ ID NO | Nucleic acid sequence |
|---|---|---|---|---|
| 21 | AAV4 | MTDGYLPDWLEDNLSEGVREWW ALQPGAPKPKANQQHQDNARGL VLPGYKYLGPGNGLDKGEPVNA ADAAALEHDKAYDQQLKAGDNP YLKYNHADAEFQQRLQGDTSFG GNLGRAVFQAKKRVLEPLGLVE QAGETAPGKKRPLIESPQQPDS STGIGKKGKQPAKKKLVFEDET GAGDGPPEGSTSGAMSDDSEMR AAAGGAAVEGGQGADGVGNASG DWHCDSTWSEGHVTTTSRTWV LPTYNNHLYKRLGESLQSNTYN GFSTPWGYFDFNRFHCHFSPRD WQRLINNNWGMRPKAMRVKIFN IQVKEVTTSNGETTVANNLTST VQIFADSSYELPYVMDAGQEGS LPPFPNDVFMVPQYGYCGLVTG NTSQQQTDRNAFYCLEYFPSQM LRTGNNFEITYSFEKVPFHSMY AHSQSLDRLMNPLIDQYLWGLQ STTTGTTLNAGTATTNFTKLRP TNFSNFKKNWLPGPSIKQQGFS KTANQNYKIPATGSDSLIKYET HSTLDGRWSALTPGPPMATAGP ADSKFSNSQLIFAGPKQNGNTA TVPGTLIFTSEEELAATNATDT DMWGNLPGGDQSNSNLPTVDRL TALGAVPGMVWQNRDIYYQGPI WAKIPHTDGHFHPSPLIGGFGL KHPPPQIFIKNTPVPANPATTF SSTPVNSFITQYSTGQVSVQID WEIQKERSKRWNPEVQFTSNYG QQNSLLWAPDAAGKYTEPRAIG TRYLTHHL | 287 | atgactgacggttaccttcc agattggctagaggacaacc tctctgaaggcgttcgagag tggtgggcgctgcaacctgg agcccctaaacccaaggcaa atcaacaacatcaggacaac gctcggggtcttgtgcttcc gggttacaaatacctcggac ccggcaacggactcgacaag ggggaacccgtcaacgcagc ggacgcggcagccctcgagc acgacaaggcctacgaccag cagctcaaggccggtgacaa ccccctacctcaagtacaac cacgccgacgcgggagttcca cagcggcttcaggcgacac atcgtttgggggcaacctcg gcagagcagtcttccaggcc aaaaagagggttcttgaacc tcttggtctggttgagcaag cgggtgagacggctcctgga aagaagagaccgttgattga atcccccagcagcccgact cctccacgggtatcggcaaa aaaggcaagcagccggctaa aaagaagctcgtttcgaag acgaaactggagcaggcgac ggaccccctgagggatcaac ttccggagccatgtctgatg acagtgagatgcgtgcagca gctggcggagctgcagtcga gggcggacaaggtgccgatg gagtgggtaatgcctcgggt gattggcattgcgattccac ctggtctgagggccacgtca cgaccaccagcaccagaacc tgggtcttgcccacctacaa caaccacctctacaagcgac tcggagagagcctgcagtcc aacacctacaacggattctc cacccctggggatactttg acttcaaccgcttccactgc cacttctcaccacgtgactg gcagcgactcatcaacaaca actggggcatgcgacccaaa gccatgcgggtcaaaatctt caacatccaggtcaaggagg tcacgacgtcgaacggcgag acaacggtggctaataacct taccagcacggttcagatct ttgcggactcgtcgtacgaa ctgccgtacgtgatggatgc gggtcaagagggcagcctgc ctccttttcccaacgacgtc tttatggtgccccagtacgg ctactgtggactggtgaccg gcaacacttcgcagcaacag actgacagaaatgccttcta ctgcctggagtactttcctt cgcagatgctgcggactggc aacaactttgaaattacgta cagttttgagaaggtgcctt tccactcgatgtacgcgcac agccagagcctggaccggct gatgaaccctctcatcgacc agtacctgtggggactgcaa tcgaccaccaccggaaccac cctgaatgccgggactgcca ccaccaactttaccaagctg cggcctaccaacttttccaa ctttaaaaagaactggctgc ccgggccttcaatcaagcag cagggcttctcaaagactgc caatcaaaactacaagatcc |

TABLE 2-continued

WT AAV capsid sequences

| SEQ ID NO | Virus Serotype | Protein sequence | SEQ ID NO | Nucleic acid sequence |
|---|---|---|---|---|
| | | | | ctgccaccgggtcagacagt
ctcatcaaatacgagacgca
cagcactctggacggaagat
ggagtgccctgaccccgga
cctccaatggccacggctgg
acctgcggacagcaagttca
gcaacagccagctcatcttt
gcggggcctaaacagaacgg
caacacggccaccgtacccg
ggactctgatcttcacctct
gaggaggagctggcagccac
caacgccaccgatacggaca
tgtggggcaacctacctggc
ggtgaccagagcaacagcaa
cctgccgaccgtggacagac
tgacagccttgggagccgtg
cctggaatggtctggcaaaa
cagagacatttactaccagg
gtcccatttgggccaagatt
cctcataccgatggacactt
tcacccctcaccgctgattg
gtgggtttgggctgaaacac
ccgcctcctcaaatttttat
caagaacaccccggtacctg
cgaatcctgcaacgaccttc
agctctactccggtaaactc
cttcattactcagtacagca
ctggccaggtgtcggtgcag
attgactgggagatccagaa
ggagcggtccaaacgctgga
accccgaggtccagtttacc
tccaactacggacagcaaaa
ctctctgttgtgggctcccg
atgcggctgggaaatacact
gagcctagggctatcggtac
ccgctacctcacccaccacc
tgtaa |
| 22 | AAV5 | MSFVDHPPDWLEEVGEGLREFL
GLEAGPPKPKPNQQHQDQARGL
VLPGYNYLGPGNGLDRGEPVNR
ADEVAREHDISYNEQLEAGDNP
YLKYNHADAEFQEKLADDTSFG
GNLGKAVFQAKKRVLEPFGLVE
EGAKTAPTGKRIDDHFPKRKKA
RTEEDSKPSTSSDAEAGPSGSQ
QLQIPAQPASSLGADTMSAGGG
GPLGDNNQGADGVGNASGDWHC
DSTWMGDRVVTKSTRTWVLPSY
NNHQYREIKSGSVDGSNANAYF
GYSTPWGYFDFNRFHSHWSPRD
WQRLINNYWGFRPRSLRVKIFN
IQVKEVTVQDSTTTIANNLTST
VQVFTDDDYQLPYVVGNGTEGC
LPAFPPQVFTLPQYGYATLNRD
NTENPTERSSFFCLEYFPSKML
RTGNNFEFTYNFEEVPFHSSFA
PSQNLFKLANPLVDQYLYRFVS
TNNTGGVQFNKNLAGRYANTYK
NWFPGPMGRTQGWNLGSGVNRA
SVSAFATTNRMELEGASYQVPP
QPNGMTNNLQGSNTYALENTMI
FNSQPANPGTTATYLEGNMLIT
SESETQPVNRVAYNVGGQMATN
NQSSTTAPATGTYNLQEIVPGS
VWMERDVYLQGPIWAKIPETGA
HFHPSPAMGGFGLKHPPPMMLI
KNTPVPGNITSFSDVPVSSFIT
QYSTGQVTVEMEWELKKENSKR
WNPEIQYTNNYNDPQFVDFAPD
STGEYRTTRPIGTRYLTRPL | 288 | atgtcttttgttgatcaccc
tccagattggttggaagaag
ttggtgaaggtcttcgcgag
tttttgggccttgaagcggg
cccaccgaaaccaaaaccca
atcagcagcatcaagatcaa
gcccgtggtcttgtgctgcc
tggttataactatctcggac
ccggaaacggtctcgatcga
ggagagcctgtcaacagggc
agacgaggtcgcgcgagagc
acgacatctcgtacaacgag
cagcttgaggcgggagacaa
cccctacctcaagtacaacc
acgcggacgccgagtttcag
gagaagctcgccgacgacac
atccttcggggggaaacctcg
gaaaggcagtctttcaggcc
aagaaaagggttctcgaacc
ttttggcctggttgaagagg
gtgctaagacggcccctacc
ggaaagcggatagacgacca
ctttccaaaaagaaagaagg
ctcggaccgagaggactcc
aagccttccacctcgtcaga
cgccgaagctggacccagcg
gatcccagcagctgcaaatc
ccagcccaaccagcctcaag
tttgggagctgatacaatgt
ctgcgggaggtggcggccca
ttgggcgacaataaccaagg
tgccgatggagtgggcaatg
cctcgggagattggcattgc
gattccacgtggatggggga
cagagtcgtcaccaagtcca
cccgaacctgggtgctgccc
agctacaacaaccaccagta |

TABLE 2-continued

WT AAV capsid sequences

| SEQ ID NO | Virus Serotype | Protein sequence | SEQ ID NO | Nucleic acid sequence |
|---|---|---|---|---|
| | | | | ccgagagatcaaaagcggct |
| | | | | ccgtcgacggaagcaacgcc |
| | | | | aacgcctactttggatacag |
| | | | | cacccctgggggtactttg |
| | | | | actttaaccgcttccacagc |
| | | | | cactggagcccccgagactg |
| | | | | gcaaagactcatcaacaact |
| | | | | actggggcttcagaccccgg |
| | | | | tccctcagagtcaaaatctt |
| | | | | caacattcaagtcaaagagg |
| | | | | tcacggtgcaggactccacc |
| | | | | accaccatcgccaacaacct |
| | | | | cacctccaccgtccaagtgt |
| | | | | ttacggacgacgactaccag |
| | | | | ctgccctacgtcgtcggcaa |
| | | | | cgggaccgagggatgcctgc |
| | | | | cggccttccctccgcaggtc |
| | | | | tttacgctgccgcagtacgg |
| | | | | ttacgcgacgctgaaccgcg |
| | | | | acaacacagaaaatcccacc |
| | | | | gagaggagcagcttcttctg |
| | | | | cctagagtactttcccagca |
| | | | | agatgctgagaacgggcaac |
| | | | | aactttgagtttacctacaa |
| | | | | ctttgaggaggtgcccttcc |
| | | | | actccagcttcgctcccagt |
| | | | | cagaacctgttcaagctggc |
| | | | | caacccgctggtggaccagt |
| | | | | acttgtaccgcttcgtgagc |
| | | | | acaaataacactggcggagt |
| | | | | ccagttcaacaagaacctgg |
| | | | | ccgggagatacgccaacacc |
| | | | | tacaaaaactggttcccggg |
| | | | | gcccatgggccgaacccagg |
| | | | | gctggaacctgggctccggg |
| | | | | gtcaaccgcgccagtgtcag |
| | | | | cgccttcgccacgaccaata |
| | | | | ggatggagctcgagggcgcg |
| | | | | agttaccaggtgccccgca |
| | | | | gccgaacggcatgaccaaca |
| | | | | acctccagggcagcaacacc |
| | | | | tatgccctggagaacactat |
| | | | | gatcttcaacagccagccgg |
| | | | | cgaacccgggcaccaccgcc |
| | | | | acgtacctcgagggcaacat |
| | | | | gctcatcaccagcgagagcg |
| | | | | agacgcagccggtgaaccgc |
| | | | | gtggcgtacaacgtcggcgg |
| | | | | gcagatggccaccaacaacc |
| | | | | agagctccaccactgccccc |
| | | | | gcgaccggcacgtacaacct |
| | | | | ccaggaaatcgtgcccggca |
| | | | | gcgtgtggatggagagggac |
| | | | | gtgtacctccaaggacccat |
| | | | | ctgggccaagatcccagaga |
| | | | | cgggggcgcactttcacccc |
| | | | | tctccggccatgggcggatt |
| | | | | cggactcaaacacccaccgc |
| | | | | ccatgatgctcatcaagaac |
| | | | | acgcctgtgcccgaaatat |
| | | | | caccagcttctcggacgtgc |
| | | | | ccgtcagcagcttcatcacc |
| | | | | cagtacagcaccgggcaggt |
| | | | | caccgtggagatggagtggg |
| | | | | agctcaagaaggaaaactcc |
| | | | | aagaggtggaacccagagat |
| | | | | ccagtacacaaacaactaca |
| | | | | acgaccccagtttgtggac |
| | | | | tttgccccggacagcaccgg |
| | | | | ggaatacagaaccaccagac |
| | | | | ctatcggaacccgatacctt |
| | | | | acccgaccccttttaa |
| 23 | AAV11 | MAADGYLPDWLEDNLSEGIREW WDLKPGAPKPKANQQKQDDGRG | 289 | atggctgctgacggttatct tccagattggctcgaggaca |

TABLE 2-continued

WT AAV capsid sequences

| SEQ ID NO | Virus Serotype | Protein sequence | SEQ ID NO | Nucleic acid sequence |
|---|---|---|---|---|
| | | LVLPGYKYLGPFNGLDKGEPVN AADAAALEHDKAYDQQLKAGDN PYLRYNHADAEFQERLQEDTSF GGNLGRAVFQAKKRVLEPLGLV EEGAKTAPGKKRPLESPQEPDS SSGIGKKGKQPARKRLNFEEDT GAGDGPPEGSDTSAMSSDIEMR AAPGGNAVDAGQGSDGVGNASG DWHCDSTWSEGKVTTTSTRTWV LPTYNNHLYLRLGTTSSSNTYN GFSTPWGYFDFNRFHCHFSPRD WQRLINNNWGLRPKAMRVKIFN IQVKEVTTSNGETTVANNLTST VQIFADSSYELPYVMDAGQEGS LPPFPNDVFMVPQYGYCGIVTG ENQNQTDRNAFYCLEYFPSQML RTGNNFECANNFEKVPFHSMYA HSQSLDRLMNPLLDQYLWHLQS TTSGETLNQGNAATTFGKIRSG DFAFYRKNWLPGPCVKQQRFSK TASQNYKIPASGGNALLKYDTH YTLNNRWSNIAPGPPMATAGPS DGDFSNAQLIFPGPSVTGNTTT SANNLLFTSEEEIAATNPRDTD MFGQIADNNQNATTAPITGNVT AMGVLPGMVWQNRDIYYQGPIW AKIPHADGHFHPSPLIGGFGLK HPPPQIFIKNTPVPANPATTFT AARVDSFITQYSTGQVAVQIEW EIEKERSKRWNPEVQFTSNYGN QSSMLWAPDTTGKYTEPRVIGS RYLTNHL | | acctctctgagggcattcgc gagtggtgggacctgaaacc tggagccccgaagcccaagg ccaaccagcagaagcaggac gacggccggggtctggtgct tcctggctacaagtacctcg gacccttcaacggactcgac aaggggagcccgtcaacgc ggcggacgcagcggccctcg agcacgacaaggcctacgac cagcagctcaaagcgggtga caatccgtacctgcggtata accacgccgacgccgagttt caggagcgtctgcaagaaga tacgtcttttgggggcaacc tcgggcgagcagtcttccag gccaagaagagggtactcga acctctgggcctggttgaag aaggtgctaaaacggctcct ggaaagaagagaccgttaga gtcaccacaagagcccgact cctcctcgggcatcggcaaa aaaggcaaacaaccagccag aaagaggctcaactttgaag aggacactggagccggagac ggaccccctgaaggatcaga taccagcgccatgtcttcag acattgaaatgcgtgcagca ccggggcggaaatgctgtcga tgcgggacaaggttccgatg gagtgggtaatgcctcgggt gattggcattgcgattccac ctggtctgagggcaaggtca caacaacctcgaccagaacc tgggtcttgcccacctacaa caaccacttgtacctgcgtc tcggaacaacatcaagcagc aacacctacaacggattctc cacccctggggatatttttg acttcaacagattccactgt cacttctcaccacgtgactg gcaaagactcatcaacaaca actggggactacgaccaaaa gccatgcgcgttaaaatctt caatatccaagttaaggagg tcacaacgtcgaacggcgag actacggtcgctaataacct taccagcacggttcagatat ttgcggactcgtcgtatgag ctcccgtacgtgatggacgc tggacaagaggggagcctgc ctcctttccccaatgacgtg ttcatggtgcctcaatatgg ctactgtggcatcgtgactg gcgagaatcagaaccaaacg gacagaaacgctttctactg cctggagtattttccttcgc aaatgttgagaactggcaac aactttgaaatggcttacaa ctttgagaaggtgccgttcc actcaatgtatgctcacagc cagagcctggacagactgat gaatcccctcctggaccagt acctgtggcacttacagtcg actacctctggagagactct gaatcaaggcaatgcagcaa ccacatttggaaaaatcagg agtggagactttgcctttta cagaaagaactggctgcctg ggccttgtgttaaacagcag agattctcaaaaactgccag tcaaaattacaagattcctg ccagcggggcaacgctctg ttaaagtatgacacccacta taccttaaacaaccgctgga |

TABLE 2-continued

WT AAV capsid sequences

| SEQ ID NO | Virus Serotype | Protein sequence | SEQ ID NO | Nucleic acid sequence |
|---|---|---|---|---|
| | | | | gcaacatcgcgcccggacct ccaatggccacagccggacc ttcggatggggacttcagta acgcccagcttatattccct ggaccatctgttaccggaaa tacaacaacttcagccaaca atctgtgtttacatcagaa gaagaaattgctgccaccaa cccaagagacacggacatgt ttggccagattgctgacaat aatcagaatgctacaactgc tcccataaccggcaacgtga ctgctatgggagtgctgcct ggcatggtgtggcaaaacag agacatttactaccaagggc caatttgggccaagatccca cacgcggacggacattttca tccttcaccgctgattggtg ggtttggactgaaacacccg cctccccagatattcatcaa gaacactcccgtacctgcca atcctgcgacaaccttcact gcagccagagtggactcttt catcacacaatacagcaccg gccaggtcgctgttcagatt gaatgggaaattgaaaagga acgctccaaacgctggaatc ctgaagtgcagtttacttca aactatgggaaccagtcttc tatgttgtgggctcctgata caactgggaagtatacagag ccgcgggttattggctctcg ttatttgactaatcatttgt aa |
| 24 | AAV12 | MAADGYLPDWLEDNLSEGIREW WALKPGAPQPKANQQHQDNGRG LVLPGYKYLGPFNGLDKGEPVN EADAAALEHDKAYDKQLEQGDN PYLKYNHADAEFQQRLATDTSF GGNLGRAVFQAKKRILEPLGLV EEGVKTAPGKKRPLEKTPNRPT NPDSGKAPAKKKQKDGEPADSA RRTLDFEDSGAGDGPPEGSSSG EMSHDAEMRAAPGGNAVEAGQG ADGVGNASGDWHCDSTWSEGRV TTTSTRTWVLPTYNNHLYLRIG TTANSNTYNGFSTPWGYFDFNR FHCHFSPRDWQRLINNNWGLRP KSMRVKIFNIQVKEVTTSNGET TVANNLTSTVQIFADSTYELPY VMDAGQEGSFPPFPNDVFMVPQ YGYCGVVTGKNQNQTDRNAFYC LEYFPSQMLRTGNNFEVSYQFE KVPFHSMYAHSQSLDRMMNPLL DQYLWHLQSTTTGNSLNQGTAT TTYGKITTGDFAYYRKNWLPGA CIKQQKFSKNANQNYKIPASGG DALLKYDTHTTLNGRWSNMAPG PPMATAGAGDSDFSNSQLIFAG PNPSGNTTTSSNNLLFTSEEEI ATTNPRDTDMFGQIADNNQNAT TAPHIANLDAMGIVPGMVWQNR DIYYQGPIWAKVPHTDGHFHPS PLMGGFGLKHPPPQIFIKNTPV PANPNTTFSAARINSFLTQYST GQVAVQIDWEIQKEHSKRWNPE VQFTSNYGTQNSMLWAPDNAGN YHELRAIGSRFLTHHL | 290 | atgctgctgacggttatct tccagattggctcgaggaca acctctctgaaggcattcgc gagtggtgggcgctgaaacc tggagctccacaacccaagg ccaaccaacagcatcaggac aacggcaggggtcttgtgct tcctgggtacaagtacctcg gacccttcaacggactcgac aagggagagccggtcaacga ggcagacgccgcggccctcg agcacgacaaggcctacgac aagcagctcgagcagggga caacccgtatctcaagtaca accacgccgacgccgagttc cagcagcgcttggcgaccga cacctcttttgggggcaacc tcgggcgagcagtcttccag gccaaaaagaggattctcga gcctctgggtctggttgaag agggcgttaaaacggctcct ggaaagaaacgcccattaga aaagactccaaatcggccga ccaacccggactctgggaag gccccggccaagaaaaagca aaaagacggcgaaccagccg actctgctagaaggacactc gactttgaagactctggagc aggagacgaccccctgagg gatcatcttccggagaaatg tctcatgatgctgagatgcg tgcggcgccaggcggaaatg ctgtcgaggcgggacaaggt gccgatggagtgggtaatgc ctccggtgattgcattgcg attccacctggtcagagggc cgagtcaccaccaccagcac ccgaacctgggtcctaccca cgtacaacaaccacctgtac ctgcgaatcggaacaacgc |

TABLE 2-continued

WT AAV capsid sequences

| SEQ ID NO | Virus Serotype | Protein sequence | SEQ ID NO | Nucleic acid sequence |
|---|---|---|---|---|
| | | | | caacagcaacacctacaacg gattctccaccccctgggga tactttgactttaaccgctt ccactgccacttttccccac gcgactggcagcgactcatc aacaacaactggggactcag gccgaaatcgatgcgtgtta aaatcttcaacatacaggtc aaggaggtcacgacgtcaaa cggcgagactacggtcgcta ataaccttaccagcacggtt cagatctttgcggattcgac gtatgaactcccatacgtga tggacgccggtcaggagggg agctttcctccgtttcccaa cgacgtctttatggttcccc aatacggatactgcggagtt gtcactggaaaaaaccagaa ccagacagacagaaatgcct tttactgcctggaatacttt ccatcccaaatgctaagaac tggcaacaatttgaagtca gttaccaatttgaaaaagtt cctttccattcaatgtacgc gcacagccagagcctggaca gaatgatgaatcctttactg gatcagtacctgtggcatct gcaatcgaccactaccggaa attcccttaatcaaggaaca gctaccaccacgtacgggaa aattaccactggagactttg cctactacaggaaaaactgg ttgcctggagcctgcattaa acaacaaaattttcaaaga atgccaatcaaaactacaag attcccgccagcggggaga cgccctttaaagtatgaca cgcataccactctaaatggg cgatggagtaacatggctcc tggacctccaatggcaaccg caggtgccggggactcggat tttagcaacagccagctgat ctttgccggacccaatccga gcggtaacacgaccacatct tcaaacaatttgttgtttac ctcagaagaggagattgcca caacaaaccacgagacacg gacatgtttggacagattgc agataataatcaaaatgcca ccaccgcccctcacatcgct aacctggacgctatgggaat tgttcccggaatggtctggc aaaacagagacatctactac cagggccctatttgggccaa ggtccctcacacggacggac actttcacccttcgccgctg atgggaggatttggactgaa acacccgcctccacagattt tcatcaaaaacaccccgta cccgccaatcccaatactac ctttagcgctgcaaggatta attctttctgacgcagtac agcaccggacaagttgccgt tcagatcgactgggaaattc agaaggagcattccaaacgc tggaatcccgaagttcaatt tacttcaaactacggcactc aaaattctatgctgtgggct cccgacaatgctggcaacta ccacgaactccgggctattg ggtcccgtttcctcacccac cacttgtaa |

In some cases, a modification can be of an AAV serotype 6 capsid. In some cases a subject variant AAV capsid protein (or the variant AAV capsid protein encoded by a subject nucleic acid) can comprise homology to any one of the protein, SEQ ID NO: 25 to SEQ ID NO: 32, or nucleic acid sequences, SEQ ID NO: 291 to SEQ ID NO: 297, in Table 3 from about 10%, 15%, 20%, 25%, 30%, 35%, 40%, 45%, 50%, 55%, 60%, 65%, 70%, 75%, 80%, 85% 90%, 91%, 92%, 93%, 94%, 95%, 96%, 97%, 98%, 99% or up to 100%.

TABLE 3

Main reading frame of AAV capsid chimeras

| SEQ ID NO | Name | Protein sequence | SEQ ID NO | Nucleic acid sequence |
|---|---|---|---|---|
| 25 | AAV4VP1u-AAV6VP2/3 Chimera 7 | MTDGYLPDWLEDNLSEGVREWW ALQPGAPKPKANQQHQDNARGL VLPGYKYLGPGNGLDKGEPVNA ADAAALEHDKAYDQQLKAGDNP YLKYNHADAEFQQRLQGDTSFG GNLGRAVFQAKKRVLEPLGLVE QAGETAPGKKRPVEQSPQEPDS SSGIGKTGQQPAKKRLNFGQTG DSESVPDPQPLGEPPATPAAVG PTTMASGGGAPMADNNEGADGV GNASGNWHCDSTWLGDRVITTS TRTWALPTYNNHLYKQISSAST GASNDNHYFGYSTPWGYFDFNR FHCHFSPRDWQRLINNNWGFRP KRLNFKLFNIQVKEVTTNDGVT TIANNLTSTVQVFSDSEYQLPY VLGSAHQGCLPPFPADVFMIPQ YGYLTLNNGSQAVGRSSFYCLE YFPSQMLRTGNNFTFSYTFEDV PFHSSYAHSQSLDRLMNPLIDQ YLYYLNRTQNQSGSAQNKDLLF SRGSPAGMSVQPKNWLPGPCYR QQRVSKTKTDNNNSNFTWTGAS KYNLNGRESIINPGTAMASHKD DKDKFFPMSGVMIFGKESAGAS NTALDNVMITDEEEIKATNPVA TERFGTVAVNLQSSSTDPATGD VHVMGALPGMVWQDRDVYLQGP IWAKIPHTDGHFHPSPLMGGFG LKHPPPQILIKNTPVPANPPAE FSATKFASFITQYSTGQVSVEI EWELQKENSKRWNPEVQYTSNY AKSANVDFTVDNNGLYTEPRPI GTRYLTRPL | 291 | atgactgacggttaccttcc agattggctagaggacaacc tctctgaaggcgttcgagag tggtgggcgctgcaacctgg agccctaaacccaaggcaa atcaacaacatcaggacaac gctcggggtcttgtgcttcc gggttacaaatacctcggac ccggcaacggactcgacaag ggggaacccgtcaacgcagc ggacgcggcagccctcgagc acgacaaggcctacgaccag cagctcaaggccggtgacaa ccctacctcaagtacaacc acgccgacgcggagttccag cagcggcttcagggcgacac atcgtttgggggcaacctcg gcagagcagtcttccaggcc aaaaagagggttcttgaacc tcttggtctggttgagcaag cgggtgagacggctcctgga aagaaacgtccggtagagca gtcgccacaagagccagact cctcctcgggcattggcaag acaggccagcagcccgctaa aaagagactcaattttggtc agactggcgactcagagtca gtccccgacccacaacctct cggagaacctccagcaaccc ccgctgctgtgggacctact acaatggcttcaggcggtgg cgcaccaatggcagacaata acgaaggcgccgacggagtg ggtaatgcctcaggaaattg gcattgcgattccacatggc tgggcgacagagtcatcacc accagcacccgaacatgggc cttgcccacctataacaacc acctctacaagcaaatctcc agtgcttcaacgggggccag caacgacaaccactacttcg gctacagcacccctgggggg tatttttgatttcaacagatt ccactgccatttctcaccac gtgactggcagcgactcatc aacaacaattggggattccg gcccaagagactcaacttca agctcttcaacatccaagtc aaggaggtcacgacgaatga tggcgtcacgaccatcgcta ataaccttaccagcacggtt caagtcttctcggactcgga gtaccagttgccgtacgtcc tcggctctgcgcaccagggc tgcctccctccgttcccggc ggacgtgttcatgattccgc agtacggctacctaacgctc aacaatggcagccaggcagt gggacggtcatccttttact gcctggaatatttcccatcg cagatgctgagaacgggcaa taactttaccttcagctaca ccttcgaggacgtgcctttc cacagcagctacgcgcacag ccagagcctggaccggctga tgaatcctctcatcgaccag tacctgtattacctgaacag aactcagaatcagtccggaa |

TABLE 3-continued

Main reading frame of AAV capsid chimeras

| SEQ ID NO | Name | Protein sequence | SEQ ID NO | Nucleic acid sequence |
|---|---|---|---|---|
| | | | | gtgcccaaaacaaggacttg<br>ctgtttagccgggggtctcc<br>agctggcatgtctgttcagc<br>ccaaaaactggctacctgga<br>ccctgttaccggcagcagcg<br>cgtttctaaaacaaaaacag<br>acaacaacaacagcaacttt<br>acctggactggtgcttcaaa<br>atataaccttaatgggcgtg<br>aatctataatcaaccctggc<br>actgctatggcctcacacaa<br>agacgacaaagacaagttct<br>ttcccatgagcggtgtcatg<br>atttttggaaaggagagcgc<br>cggagcttcaaacactgcat<br>tggacaatgtcatgatcaca<br>gacgaagaggaaatcaaagc<br>cactaaccccgtggccaccg<br>aaagatttggactgtggca<br>gtcaatctccagagcagcag<br>cacagaccctgcgaccggag<br>atgtgcatgttatgggagcc<br>ttacctggaatggtgtggca<br>agacagagacgtatacctgc<br>agggtcctatttgggccaaa<br>attcctcacacggatggaca<br>ctttcacccgtctcctctca<br>tgggcggctttggacttaag<br>cacccgcctcctcagatcct<br>catcaaaaacacgcctgttc<br>ctgcgaatcctccggcagag<br>ttttcggctacaaagtttgc<br>ttcattcatcacccagtatt<br>ccacaggacaagtgagcgtg<br>gagattgaatgggagctgca<br>gaaagaaaacagcaaacgct<br>ggaatcccgaagtgcagtat<br>acatctaactatgcaaaatc<br>tgccaacgttgatttcactg<br>tggacaacaatggactttat<br>actgagcctcgccccattgg<br>cacccgttacctcacccgtc<br>ccctgtaa |
| 26 | AAV5VP1u-<br>AAV6VP2/3<br>Chimera 2 | MSFVDHPPDWLEEVGEGLREFL<br>GLEAGPPKPKPNQQHQDQARGL<br>VLPGYNYLGPGNGLDRGEPVNR<br>ADEVAREHDISYNEQLEAGDNP<br>YLKYNHADAEFQEKLADDTSFG<br>GNLGKAVFQAKKRVLEPFGLVE<br>EGAKTAPGKKRPVEQSPQEPDS<br>SSGIGKTGQQPAKKRLNFGQTG<br>DSESVPDPQPLGEPPATPAAVG<br>PTTMASGGGAPMADNNEGADGV<br>GNASGNWHCDSTWLGDRVITTS<br>TRTWALPTYNNHLYKQISSAST<br>GASNDNHYFGYSTPWGYFDFNR<br>FHCHFSPRDWQRLINNNWGFRP<br>KRLNFKLFNIQVKEVTTNDGVT<br>TIANNLTSTVQVFSDSEYQLPY<br>VLGSAHQGCLPPFPADVFMIPQ<br>YGYLTLNNGSQAVGRSSFYCLE<br>YFPSQMLRTGNNFTFSYTFEDV<br>PFHSSYAHSQSLDRLMNPLIDQ<br>YLYYLNRTQNQSGSAQNKDLLF<br>SRGSPAGMSVQPKNWLPGPCYR<br>QQRVSKTKTDNNNSNFTWTGAS<br>KYNLNGRESIINPGTAMASHKD<br>DKDKFFPMSGVMIFGKESAGAS<br>NTALDNVMITDEEEIKATNPVA<br>TERFGTVAVNLQSSSTDPATGD<br>VHVMGALPGMVWQDRDVYLQGP<br>IWAKIPHTDGHFHPSPLMGGFG<br>LKHPPPQILIKNTPVPANPPAE<br>FSATKFASFITQYSTGQVSVEI | 292 | atgtcttttgttgatcaccc<br>tccagattggttggaagaag<br>ttggtgaaggtcttcgcgag<br>ttttgggccttgaagcggg<br>cccaccgaaaccaaaaccca<br>atcagcagcatcaagatcaa<br>gcccgtggtcttgtgctgcc<br>tggttataactatctcggac<br>ccggaaacggtctcgatcga<br>ggagagcctgtcaacagggc<br>agacgaggtcgcgcgagagc<br>acgacatctcgtacaacgag<br>cagcttgaggcgggagacaa<br>cccctacctcaagtacaacc<br>acgcggacgccgagtttcag<br>gagaagctcgccgacgacac<br>atccttcggggaaacctcg<br>gaaaggcagtcttttcaggcc<br>aagaaaagggttctcgaacc<br>ttttggcctggttgaagagg<br>gtgctaagacggctcctgga<br>aagaaacgtccggtagagca<br>gtcgccacaagagccagact<br>cctcctcgggcattggcaag<br>acaggccagcagcccgctaa<br>aaaagactcaattttggtc<br>agactggcgactcagagtca<br>gtccccgacccacaacctct<br>cggagaacctccagcaaccc<br>ccgctgctgtgggacctact<br>acaatggcttcaggcggtgg |

TABLE 3-continued

Main reading frame of AAV capsid chimeras

| SEQ ID NO | Name | Protein sequence | SEQ ID NO | Nucleic acid sequence |
|---|---|---|---|---|
| | | EWELQKENSKRWNPEVQYTSNY AKSANVDFTVDNNGLYTEPRPI GTRYLTRPL | | cgcaccaatggcagacaata acgaaggcgccgacggagtg ggtaatgcctcaggaaattg gcattgcgattccacatggc tgggcgacagagtcatcacc accagcacccgaacatgggc cttgcccacctataacaacc acctctacaagcaaatctcc agtgcttcaacggggccag caacgacaaccactacttcg gctacagcaccccctggggg tattttgatttcaacagatt ccactgccatttctcaccac gtgactggcagcgactcatc aacaacaattggggattccg gcccaagagactcaacttca agctcttcaacatccaagtc aaggaggtcacgacgaatga tggcgtcacgaccatcgcta ataaccttaccagcacggtt caagtcttctcggactcgga gtaccagttgccgtacgtcc tcggctctgcgcaccagggc tgcctccctccgttcccggc ggacgtgttcatgattccgc agtacggctacctaacgctc aacaatggcagccaggcagt gggacggtcatccttttact gcctggaatatttcccatcg cagatgctgagaacgggcaa taactttaccttcagctaca ccttcgaggacgtgcctttc cacagcagctacgcgcacag ccagagcctggaccggctga tgaatcctctcatcgaccag tacctgtattacctgaacag aactcagaatcagtccggaa gtgcccaaaacaaggacttg ctgtttagccgggggtctcc agctggcatgtctgttcagc ccaaaaactggctacctgga ccctgttaccggcagcagcg cgtttctaaaacaaaaacag acaacaacaacagcaacttt acctggactggtgcttcaaa atataaccttaatgggcgtg aatctataatcaaccctggc actgctatggcctcacacaa agacgacaaagacaagttct ttcccatgagcggtgtcatg attttggaaaggagagcgc cggagcttcaaacactgcat tggacaatgtcatgatcaca gacgaagaggaaatcaaagc cactaaccccgtggccaccg aaagatttgggactgtggca gtcaatctccagagcagcag cacagaccctgcgaccggag atgtgcatgttatgggagcc ttacctggaatggtgtggca agacagagacgtatacctgc agggtcctatttgggccaaa attcctcacacggatggaca ctttcacccgtctcctctca tgggcggctttggacttaag caccgcctcctcagatcct catcaaaaacacgcctgttc ctgcgaatcctccggcagag ttttcggctacaaagtttgc ttcattcatcacccagtatt ccacaggacaagtgagcgtg gagattgaatgggagctgca gaaagaaaacagcaaacgct ggaatcccgaagtgcagtat acatctaactatgcaaaatc |

TABLE 3-continued

Main reading frame of AAV capsid chimeras

| SEQ ID NO | Name | Protein sequence | SEQ ID NO | Nucleic acid sequence |
|---|---|---|---|---|
| | | | | tgccaacgttgatttcactg tggacaacaatggactttat actgagcctcgccccattgg cacccgttacctcacccgtc ccctgtaa |
| 27 | AAV11VP1u-AAV6VP2/3 | MAADGYLPDWLEDNLSEGIREW WDLKPGAPKPKANQQKQDDGRG LVLPGYKYLGPFNGLDKGEPVN AADAAALEHDKAYDQQLKAGDN PYLRYNHADAEFQERLQEDTSF GGNLGRAVFQAKKRVLEPLGLV EEGAKTAPGKKRPVEQSPQEPD SSSGIGKTGQQPAKKRLNFGQT GDSESVPDPQPLGEPPATPAAV GPTTMASGGGAPMADNNEGADG VGNASGNWHCDSTWLGDRVITT STRTWALPTYNNHLYKQISSAS TGASNDNHYFGYSTPWGYFDFN RFHCHFSPRDWQRLINNNWGFR PKRLNFKLFNIQVKEVTTNDGV TTIANNLTSTVQVFSDSEYQLP YVLGSAHQGCLPPFPADVFMIP QYGYLTLNNGSQAVGRSSFYCL EYFPSQMLRTGNNFTFSYTFED VPFHSSYAHSQSLDRLMNPLID QYLYYLNRTQNQSGSAQNKDLL FSRGSPAGMSVQPKNWLPGPCY RQQRVSKTKTDNNNSNFTWTGA SKYNLNGRESIINPGTAMASHK DDKDKFFPMSGVMIFGKESAGA SNTALDNVMITDEEEIKATNPV ATERFGTVAVNLQSSSTDPATG DVHVMGALPGMVWQDRDVYLQG PIWAKIPHTDGHFHPSPLMGGF GLKHPPPQILIKNTPVPANPPA EFSATKFASFITQYSTGQVSVE IEWELQKENSKRWNPEVQYTSN YAKSANVDFTVDNNGLYTEPRP IGTRYLTRPL | | |
| 28 | AAV12VP1u-AAV6VP2/3 Chimera 8 | MAADGYLPDWLEDNLSEGIREW WALKPGAPQPKANQQHQDNGRG LVLPGYKYLGPFNGLDKGEPVN EADAAALEHDKAYDKQLEQGDN PYLKYNHADAEFQQRLATDTSF GGNLGRAVFQAKKRILEPLGLV EEGVKTAPGKKRPVEQSPQEPD SSSGIGKTGQQPAKKRLNFGQT GDSESVPDPQPLGEPPATPAAV GPTTMASGGGAPMADNNEGADG VGNASGNWHCDSTWLGDRVITT STRTWALPTYNNHLYKQISSAS TGASNDNHYFGYSTPWGYFDFN RFHCHFSPRDWQRLINNNWGFR PKRLNFKLFNIQVKEVTTNDGV TTIANNLTSTVQVFSDSEYQLP YVLGSAHQGCLPPFPADVFMIP QYGYLTLNNGSQAVGRSSFYCL EYFPSQMLRTGNNFTFSYTFED VPFHSSYAHSQSLDRLMNPLID QYLYYLNRTQNQSGSAQNKDLL FSRGSPAGMSVQPKNWLPGPCY RQQRVSKTKTDNNNSNFTWTGA SKYNLNGRESIINPGTAMASHK DDKDKFFPMSGVMIFGKESAGA SNTALDNVMITDEEEIKATNPV ATERFGTVAVNLQSSSTDPATG DVHVMGALPGMVWQDRDVYLQG PIWAKIPHTDGHFHPSPLMGGF GLKHPPPQILIKNTPVPANPPA EFSATKFASFITQYSTGQVSVE IEWELQKENSKRWNPEVQYTSN YAKSANVDFTVDNNGLYTEPRP IGTRYLTRPL | 293 | atggctgctgacggttatct tccagattggctcgaggaca acctctctgaaggcattcgc gagtggtgggcgctgaaacc tggagctccacaacccaagg ccaaccaacagcatcaggac aacggcaggggtcttgtgct tcctgggtacaagtacctcg gacccttcaacggactcgac aagggagagccggtcaacga ggcagacgccgcggccctcg agcacgacaaggcctacgac aagcagctcgagcagggga caacccgtatctcaagtaca accacgccgacgccgagttc cagcagcgcttggcgaccga cacctcttttggggcaacc tcgggcgagcagtcttccag gccaaaaagaggattctcga gcctctgggtctggttgaag agggcgttaaaacggctcct ggaaagaaacgtccggtaga gcagtcgccacaagagccag actcctcctcgggcattggc aagacaggccagcagcccgc taaaaagagactcaattttg gtcagactggcgactcagag tcagtcccgacccacaacc tctcggagaacctccagcaa ccccgctgctgtgggacct actacaatggcttcaggcgg tggcgcaccaatggcagaca ataacgaaggcgccgacgga gtgggtaatgcctcaggaaa |

TABLE 3-continued

Main reading frame of AAV capsid chimeras

| SEQ ID NO | Name | Protein sequence | SEQ ID NO | Nucleic acid sequence |
|---|---|---|---|---|
| | | | | ttggcattgcgattccacat ggctgggcgacagagtcatc accaccagcacccgaacatg ggccttgcccacctataaca accacctctacaagcaaatc tccagtgcttcaacgggggc cagcaacgacaaccactact tcggctacagcacccctgg gggtattttgatttcaacag attccactgccatttctcac cacgtgactggcagcgactc atcaacaacaattggggatt ccggcccaagagactcaact tcaagctcttcaacatccaa gtcaaggaggtcacgacgaa tgatggcgtcacgaccatcg ctaataaccttaccagcacg gttcaagtcttctcggactc ggagtaccagttgccgtacg tcctcggctctgcgcaccag ggctgcctccctccgttccc ggcggacgtgttcatgattc cgcagtacggctacctaacg ctcaacaatggcagccaggc agtgggacggtcatcctttt actgcctggaatatttccca tcgcagatgctgagaacggg caataactttaccttcagct acaccttcgaggacgtgcct ttccacagcagctacgcgca cagccagagcctggaccggc tgatgaatcctctcatcgac cagtacctgtattacctgaa cagaactcagaatcagtccg gaagtgcccaaaacaaggac ttgctgtttagccgggggtc tccagctggcatgtctgttc agcccaaaaactggctacct ggaccctgttaccggcagca gcgcgtttctaaaacaaaaa cagacaacaacaacagcaac tttacctggactggtgcttc aaaatataaccttaatgggc gtgaatctataatcaaccct ggcactgctatggcctcaca caaagacgacaaagacaagt tctttcccatgagcggtgtc atgatttttggaaaggagag cgccggagcttcaaacactg cattggacaatgtcatgatc acagacgaagaggaaatcaa agccactaaccccgtggcca ccgaaagatttgggactgtg gcagtcaatctccagagcag cagcacagaccctgcgaccg gagatgtgcatgttatggga gccttacctggaatggtgtg gcaagacagagacgtatacc tgcagggtcctatttgggcc aaaattcctcacacgatgg acactttcacccgtctcctc tcatgggcggctttggactt aagcacccgcctcctcagat cctcatcaaaaacacgcctg ttcctgcgaatcctccggca gagttttcggctacaaagtt tgcttcattcatcacccagt attccacaggacaagtgagc gtggagattgaatgggagct gcagaaagaaaacagcaaac gctggaatcccgaagtgcag tatacatctaactatgcaaa atctgccaacgttgatttca ctgtggacaacaatggactt tatactgagcctcgcccat |

TABLE 3-continued

Main reading frame of AAV capsid chimeras

| SEQ ID NO | Name | Protein sequence | SEQ ID NO | Nucleic acid sequence |
|---|---|---|---|---|
| | | | | tggcacccgttacctcaccc gtcccctgtaa |
| 29 | AAV4VP1/2-AAV6VP3 Chimera 3 | MTDGYLPDWLEDNLSEGVREWW ALQPGAPKPKANQQHQDNARGL VLPGYKYLGPGNGLDKGEPVNA ADAAALEHDKAYDQQLKAGDNP YLKYNHADAEFQQRLQGDTSFG GNLGRAVFQAKKRVLEPLGLVE QAGETAPGKKRPLIESPQQPDS STGIGKKGKQPAKKKLVFEDET GAGDGPPEGSTSGAMSDDSEMA SGGGAPMADNNEGADGVGNASG NWHCDSTWLGDRVITTSTRTWA LPTYNNHLYKQISSASTGASND NHYFGYSTPWGYFDFNRFHCHF SPRDWQRLINNNWGFRPKRLNF KLFNIQVKEVTTNDGVTTIANN LTSTVQVFSDSEYQLPYVLGSA HQGCLPPFPADVFMIPQYGYLT LNNGSQAVGRSSFYCLEYFPSQ MLRTGNNFTFSYTFEDVPFHSS YAHSQSLDRLMNPLIDQYLYYL NRTQNQSGSAQNKDLLFSRGSP AGMSVQPKNWLPGPCYRQQRVS KTKTDNNSNFTWTGASKYNLN GRESIINPGTAMASHKDDKDF FPMSGVMIFGKESAGASNTALD NVMITDEEEIKATNPVATERFG TVAVNLQSSSTDPATGDVHVMG ALPGMVWQDRDVYLQGPIWAKI PHTDGHFHPSPLMGGFGLKHPP PQILIKNTPVPANPPAEFSATK FASFITQYSTGQVSVEIEWELQ KENSKRWNPEVQYTSNYAKSAN VDFTVDNNGLYTEPRPIGTRYL TRPL | 294 | atgactgacggttaccttcc agattggctagaggacaacc tctctgaaggcgttcgagag tggtgggcgctgcaacctgg agcccctaaacccaaggcaa atcaacaacatcaggacaac gctcggggtcttgtgcttcc gggttacaaatacctcggac ccggcaacggactcgacaag ggggaacccgtcaacgcagc ggacgcggcagccctcgagc acgacaaggcctacgaccag cagctcaaggccggtgacaa cccctacctcaagtacaacc acgccgacgcggagttccag cagcggcttcagggcgacac atcgtttggggcaacctcg gcagagcagtcttccaggcc aaaaagagggttcttgaacc tcttggtctggttgagcaag cgggtgagacggctcctgga aagaagagaccgttgattga atccccccagcagcccgact cctccacgggtatcggcaaa aaaggcaagcagccggctaa aaagaagctcgtttttcgaag acgaaactggagcaggcgac ggaccccctgagggatcaac ttccggagccatgtctgatg acagtgagatggcttcaggc ggtggcgcaccaatggcaga caataacgaaggcgccgacg gagtgggtaatgcctcagga aattggcattgcgattccac atggctgggcgacagagtca tcaccaccagcacccgaaca tgggccttgcccacctataa caaccacctctacaagcaaa tctccagtgcttcaacgggg gccagcaacgacaaccacta cttcggctacagcaccccct gggggtattttgatttcaac agattccactgccatttctc accacgtgactggcagcgac tcatcaacaacaattgggga ttccggcccaagagactcaa cttcaagctcttcaacatcc aagtcaaggaggtcacgacg aatgatggcgtcacgaccat cgctaataaccttaccagca cggttcaagtcttctcggac tcggagtaccagttgccgta cgtcctcggctctgcgcacc agggctgcctccctccgttc ccggcggacgtgttcatgat tccgcagtacggctacctaa cgctcaacaatggcagccag gcagtgggacggtcatcctt ttactgcctggaatatttcc catcgcagatgctgagaacg ggcaataactttaccttcag ctacaccttcgaggacgtgc cttttccacagcagctacgcg cacagccagagcctggaccg gctgatgaatcctctcatcg accagtacctgtattacctg aacagaactcagaatcagtc cggaagtgcccaaaacaagg acttgctgtttagccgggg tctccagctggcatgtctgt tcagcccaaaaactggctac ctggaccctgttaccggcag |

TABLE 3-continued

Main reading frame of AAV capsid chimeras

| SEQ ID NO | Name | Protein sequence | SEQ ID NO | Nucleic acid sequence |
|---|---|---|---|---|
| | | | | cagcgcgtttctaaaacaaa aacagacaacaacaacagca actttacctggactggtgct tcaaaatataaccttaatgg gcgtgaatctataatcaacc ctggcactgctatggcctca cacaaagacgacaaagacaa gttctttcccatgagcggtg tcatgattttggaaaggag agcgccggagcttcaaacac tgcattggacaatgtcatga tcacagacgaagaggaaatc aaagccactaaccccgtggc caccgaaagatttgggactg tggcagtcaatctccagagc agcagcacagaccctgcgac cggagatgtgcatgttatgg gagccttacctggaatggtg tggcaagacagagacgtata cctgcagggtcctatttggg ccaaaattcctcacacggat ggacactttcacccgtctcc tctcatgggcggctttggac ttaagcaccgcctcctcag atcctcatcaaaaacacgcc tgttcctgcgaatcctccgg cagagttttcggctacaaag tttgcttcattcatcaccca gtattccacaggacaagtga gcgtggagattaatgggag ctgcagaaagaaaacagcaa acgctggaatcccgaagtgc agtatacatctaactatgca aaatctgccaacgttgattt cactgtggacaacaatggac tttatactgagcctcgcccc attggcacccgttacctcac ccgtcccctgtaa |
| 30 | AAV5VP1_2-AAV6VP3 Chimera 4 | MSFVDHPPDWLEEVGEGLREFL GLEAGPPKPKPNQQHQDQARGL VLPGYNYLGPGNGLDRGEPVNR ADEVAREHDISYNEQLEAGDNP YLKYNHADAEFQEKLADDTSFG GNLGKAVFQAKKRVLEPFGLVE EGAKTAPTGKRIDDHFPKRKKA RTEEDSKPSTSSDAEAGPSGSQ QLQIPAQPASSLGADTMASGGG APMADNNEGADGVGNASGNWHC DSTWLGDRVITTSTRTWALPTY NNHLYKQISSASTGASNDNHYF GYSTPWGYFDFNRFHCHFSPRD WQRLINNNWGFRPKRLNFKLFN IQVKEVTTNDGVTTIANNLTST VQVFSDSEYQLPYVLGSAHQGC LPPFPADVFMIPQYGYLTLNNG SQAVGRSSFYCLEYFPSQMLRT GNNFTFSYTFEDVPFHSSYAHS QSLDRLMNPLIDQYLYYLNRTQ NQSGSAQNKDLLFSRGSPAGMS VQPKNWLPGPCYRQQRVSKTKT DNNNSNFTWTGASKYNLNGRES IINPGTAMASHKDDKDKFFPMS GVMIFGKESAGASNTALDNVMI TDEEEIKATNPVATERFGTVAV NLQSSSTDPATGDVHVMGALPG MVWQDRDVYLQGPIWAKIPHTD GHFHPSPLMGGFGLKHPPPQIL IKNTPVPANPPAEFSATKFASF ITQYSTGQVSVEIEWELQKENS KRWNPEVQYTSNYAKSANVDFT VDNNGLYTEPRPIGTRYLTRPL | 295 | atgtcttttgttgatcaccc tccagattggttggaagaag ttggtgaaggtcttcgcgag tttttgggccttgaagcggg cccaccgaaaccaaaaccca atcagcagcatcaagatcaa gcccgtggtcttgtgctgcc tggttataactatctcggac ccggaaacggtctcgatcga ggagagcctgtcaacagggc agacgaggtcgcgcgagagc acgacatctcgtacaacgag cagcttgaggcgggagacaa cccctacctcaagtacaacc acgcggacgccgagtttcag gagaagctcgccgacgacac atccttcggggggaaacctcg gaaaggcagtctttcaggcc aagaaaagggttctcgaacc ttttggcctggttgaagagg gtgctaagacggcccctacc ggaaagcggatagacgacca cttttccaaaaagaaagagg ctcggaccgaagaggactcc aagccttccacctcgtcaga cgccgaagctggacccagcg gatcccagcagctgcaaatc ccagcccaaccagcctcaag tttgggagctgatacaatgg cttcaggcggtggcgcacca atgcagacaataacgaagg cgccgacggagtgggtaatg cctcaggaaattggcattgc gattccacatggctgggcga cagagtcatcaccaccagca cccgaacatgggccttgccc |

TABLE 3-continued

Main reading frame of AAV capsid chimeras

| SEQ ID NO | Name | Protein sequence | SEQ ID NO | Nucleic acid sequence |
|---|---|---|---|---|
| | | | | acctataacaaccacctcta caagcaaatctccagtgctt caacgggggccagcaacgac aaccactacttcggctacag cacccctgggggtattttg atttcaacagattccactgc catttctcaccacgtgactg gcagcgactcatcaacaaca attggggattccggcccaag agactcaacttcaagctctt caacatccaagtcaaggagg tcacgacgaatgatggcgtc acgaccatcgctaataacct taccagcacggttcaagtct tctcggactcggagtaccag ttgccgtacgtcctcggctc tgcgcaccagggctgcctcc ctccgttcccggcggacgtg ttcatgattccgcagtacgg ctacctaacgctcaacaatg gcagccaggcagtgggacgg tcatcctttactgcctgga atatttcccatcgcagatgc tgagaacgggcaataacttt accttcagctacaccttcga ggacgtgccttccacagca gctacgcgcacagccagagc ctggaccggctgatgaatcc tctcatcgaccagtacctgt attacctgaacagaactcag aatcagtccggaagtgccca aaacaaggacttgctgttta gccggggtctccagctggc atgtctgttcagcccaaaaa ctggctacctggaccctgtt accggcagcagcgcgtttct aaaacaaaaacagacaacaa caacagcaactttacctgga ctggtgcttcaaaatataac cttaatgggcgtgaatctat aatcaaccctggcactgcta tggcctcacacaaagacgac aaagacaagttctttcccat gagcggtgtcatgattttg gaaaggagagcgccggagct tcaaacactgcattggacaa tgtcatgatcacagacgaag aggaaatcaaagccactaac cccgtggccaccgaaagatt tgggactgtggcagtcaatc tccagagcagcagcacagac cctgcgaccggagatgtgca tgttatgggagccttacctg gaatggtgtggcaagacaga gacgtatacctgcagggtcc tatttgggccaaaattcctc acacggatggacactttcac ccgtctcctctcatgggcgg ctttggacttaagcacccgc ctcctcagatcctcatcaaa aacacgcctgttcctgcgaa tcctccggcagagttttcgg ctacaaagtttgcttcattc atcacccagtattccacagg acaagtgagcgtggagattg aatgggagctgcagaaagaa aacagcaaacgctggaatcc cgaagtgcagtatacatcta actatgcaaaatctgccaac gttgatttcactgtggacaa caatggactttatactgagc ctcgccccattggcacccgt tacctcacccgtcccctgta a |

TABLE 3-continued

Main reading frame of AAV capsid chimeras

| SEQ ID NO | Name | Protein sequence | SEQ ID NO | Nucleic acid sequence |
|---|---|---|---|---|
| 31 | AAV11VP1/2-AAV6VP3 Chimera 5 | MAADGYLPDWLEDNLSEGIREW WDLKPGAPKPKANQQKQDDGRG LVLPGYKYLGPFNGLDKGEPVN AADAAALEHDKAYDQQLKAGDN PYLRYNHADAEFQERLQEDTSF GGNLGRAVFQAKKRVLEPLGLV EEGAKTAPGKKRPLESPQEPDS SSGIGKKGKQPARKRLNFEEDT GAGDGPPEGSDTSAMSSDIEMA SGGGAPMADNNEGADGVGNASG NWHCDSTWLGDRVITTSTRTWA LPTYNNHLYKQISSASTGASND NHYFGYSTPWGYFDFNRFHCHF SPRDWQRLINNNWGFRPKRLNF KLFNIQVKEVTTNDGVTTIANN LTSTVQVFSDSEYQLPYVLGSA HQGCLPPFPADVFMIPQYGYLT LNNGSQAVGRSSFYCLEYFPSQ MLRTGNNFTFSYTFEDVPFHSS YAHSQSLDRLMNPLIDQYLYYL NRTQNQSGSAQNKDLLFSRGSP AGMSVQPKNWLPGPCYRQQRVS KTKTDNNNSNFTWTGASKYNLN GRESIINPGTAMASHKDDKDF FPMSGVMIFGKESAGASNTALD NVMITDEEEIKATNPVATERFG TVAVNLQSSSTDPATGDVHVMG ALPGMVWQDRDVYLQGPIWAKI PHTDGHFHPSPLMGGFGLKHPP PQILIKNTPVPANPPAEFSATK FASFITQYSTGQVSVEIEWELQ KENSKRWNPEVQYTSNYAKSAN VDFTVDNNGLYTEPRPIGTRYL TRPL | 296 | atggctgctgacggttatct tccagattggctcgaggaca acctctctgagggcattcgc gagtggtgggacctgaaacc tggagccccgaagcccaagg ccaaccagcagaagcaggac gacggccggggtctggtgct tcctggctacaagtacctcg gacccttcaacggactcgac aaggggggagcccgtcaacgc ggcggacgcagcggccctcg agcacgacaaggcctacgac cagcagctcaaagcgggtga caatccgtacctgcgtata accacgccgacgccgagttt caggagcgtctgcaagaaga tacgtcttttgggggcaacc tcgggcgagcagtcttccag gccaagaagagggtactcga acctctggcctggttgaag aaggtgctaaaacggctcct ggaaagaagagaccgttaga gtcaccacaagagcccgact cctcctcgggcatcggcaaa aaaggcaaacaaccagccag aaagaggctcaactttgaag aggacactggagccgagac ggacccccctgaaggatcaga taccagcgccatgtcttcag acattgaaatggcttcaggc ggtggcgcaccaatggcaga caataacgaaggcgccgacg gagtgggtaatgcctcagga aattggcattgcgattccac atggctgggcgacagagtca tcaccaccagcacccgaaca tgggccttgcccacctataa caaccacctctacaagcaaa tctccagtgcttcaacgggg gccagcaacgacaaccacta cttcggctacagcacccct gggggtattttgatttcaac agattccactgccatttctc accacgtgactggcagcgac tcatcaacaacaattgggga ttccggcccaagagactcaa cttcaagctcttcaacatcc aagtcaaggaggtcacgacg aatgatggcgtcacgaccat cgctaataaccttaccagca cggttcaagtcttctcggac tcggagtaccagttgccgta cgtcctcggctctgcgcacc agggctgcctccctccgttc ccggcggacgtgttcatgat tccgcagtacggctacctaa cgctcaacaatggcagccag gcagtgggacggtcatcctt ttactgcctggaatatttcc catcgcagatgctgagaacg ggcaataacttaccttcag ctacaccttcgaggacgtgc ctttccacagcagctacgcg cacagccagagcctggaccg gctgatgaatcctctcatcg accagtacctgtattacctg aacagaactcagaatcagtc cggaagtgcccaaaacaagg acttgctgtttagccggggg tctccagctggcatgtctgt tcagcccaaaaactggctac ctggaccctgttaccggcag cagcgcgtttctaaaacaaa aacagacaacaacaacagca acttt acctggactggtgct |

TABLE 3-continued

Main reading frame of AAV capsid chimeras

| SEQ ID NO | Name | Protein sequence | SEQ ID NO | Nucleic acid sequence |
|---|---|---|---|---|
| | | | | tcaaaatataaccttaatgg gcgtgaatctataatcaacc ctggcactgctatggcctca cacaaagacgacaaagacaa gttctttcccatgagcggtg tcatgattttggaaaggag agcgccggagcttcaaacac tgcattggacaatgtcatga tcacagacgaagaggaaatc aaagccactaacccccgtggc caccgaaagatttgggactg tggcagtcaatctccagagc agcagcacagaccctgcgac cggagatgtgcatgttatgg gagccttacctggaatggtg tggcaagacagagacgtata cctgcagggtcctatttggg ccaaaattcctcacacggat ggacactttcacccgtctcc tctcatgggcggctttggac ttaagcacccgcctcctcag atcctcatcaaaaacacgcc tgttcctgcgaatcctccgg cagagttttcggctacaaag tttgcttcattcatcaccca gtattccacaggacaagtga gcgtggagattgaatgggag ctgcagaaagaaaacagcaa acgctggaatcccgaagtgc agtatacatctaactatgca aaatctgccaacgttgattt cactgtggacaacaatggac tttatactgagcctcgcccc attggcacccgttacctcac ccgtcccctgtaa |
| 32 | AAV12VP1/2-AAV6VP3 Chimera 6 | MAADGYLPDWLEDNLSEGIREW WALKPGAPQPKANQQHQDNGRG LVLPGYKYLGPFNGLDKGEPVN EADAAALEHDKAYDKQLEQGDN PYLKYNHADAEFQQRLATDTSF GGNLGRAVFQAKKRILEPLGLV EEGVKTAPGKKRPLEKTPNRPT NPDSGKAPAKKKQKDGEPADSA RRTLDFEDSGAGDGPPEGSSSG EMSHDAEMASGGGAPMADNNEG ADGVGNASGNWHCDSTWLGDRV ITTSTRTWALPTYNNHLYKQIS SASTGASNDNHYFGYSTPWGYF DFNRFHCHFSPRDWQRLINNNW GFRPKRLNFKLFNIQVKEVTTN DGVTTIANNLTSTVQVFSDSEY QLPYVLGSAHQGCLPPFPADVF MIPQYGYLTLNNGSQAVGRSSF YCLEYFPSQMLRTGNNFTFSYT FEDVPFHSSYAHSQSLDRLMNP LIDQYLYYLNRTQNQSGSAQNK DLLFSRGSPAGMSVQPKNWLPG PCYRQQRVSKTKTDNNNSNFTW TGASKYNLNGRESIINPGTAMA SHKDDKDKFFPMSGVMIFGKES AGASNTALDNVMITDEEEIKAT NPVATERFGTVAVNLQSSSTDP ATGDVHVMGALPGMVWQDRDVY LQGPIWAKIPHTDGHFHPSPLM GGFGLKHPPPQILIKNTPVPAN PPAEFSATKFASFITQYSTGQV SVEIEWELQKENSKRWNPEVQY TSNYAKSANVDFTVDNNGLYTE PRPIGTRYLTRPL | 297 | atggctgctgacggttatct tccagattggctcgaggaca acctctctgaaggcattcgc gagtggtgggcgctgaaacc tggagctccacaacccaagg ccaaccaacagcatcaggac aacggcaggggtcttgtgct tcctgggtacaagtacctcg gaccctcaacggactcgac aagggagagccggtcaacga ggcagacgccgcggccctcg agcacgacaaggcctacgac aagcagctcgagcaggggga caacccgtatctcaagtaca accacgccgacgccgagttc cagcagcgcttggcgaccga cacctcttttgggggcaacc tcgggcgagcagtcttccag gccaaaaagaggattctcga gcctctgggtctggttgaag agggcgttaaaacggctcct ggaaagaaacgccccattaga aaagactccaaatcggccga ccaacccgactctgggaag gccccgccaagaaaaagca aaaagacggcgaaccagccg actctgctagaaggacactc gactttgaagactctggagc aggagacggaccccctgagg gatcatcttccggagaaatg tctcatgatgctgagatggc ttcaggcggtggcgcaccaa tggcagacaataacgaaggc gccgacggagtgggtaatgc ctcaggaaattggcattgcg attccacatggctgggcgac agagtcatcaccaccagcac ccgaacatgggccttgccca cctataacaaccacctctac |

TABLE 3-continued

Main reading frame of AAV capsid chimeras

| SEQ ID NO | Name | Protein sequence | SEQ ID NO | Nucleic acid sequence |
|---|---|---|---|---|
| | | | | aagcaaatctccagtgcttc aacgggggccagcaacgaca accactacttcggctacagc accccctgggggtattttga tttcaacagattccactgcc atttctcaccacgtgactgg cagcgactcatcaacaacaa ttggggattccggcccaaga gactcaacttcaagctcttc aacatccaagtcaaggaggt cacgacgaatgatggcgtca cgaccatcgctaataacctt accagcacggttcaagtctt ctcggactcggagtaccagt tgccgtacgtcctcggctct gcgcaccagggctgcctccc tccgttcccggcggacgtgt tcatgattccgcagtacggc tacctaacgctcaacaatgg cagccaggcagtgggacggt catccttttactgcctggaa tatttcccatcgcagatgct gagaacgggcaataacttta ccttcagctacaccttcgag gacgtgcctttccacagcag ctacgcgcacagccagagcc tggaccggctgatgaatcct ctcatcgaccagtacctgta ttacctgaacagaactcaga atcagtccggaagtgcccaa aacaaggacttgctgtttag ccgggggtctccagctggca tgtctgttcagcccaaaaac tggctacctggaccctgtta ccggcagcagcgcgtttcta aaacaaaaacagacaacaac aacagcaactttacctggac tggtgcttcaaaatataacc ttaatgggcgtgaatctata atcaaccctggcactgctat ggcctcacacaaagacgaca aagacaagttctttcccatg agcggtgtcatgatttttgg aaaggagagcgccggagctt caaacactgcattggacaat gtcatgatcacagacgaaga ggaaatcaaagccactaacc ccgtggccaccgaaagattt gggactgtggcagtcaatct ccagagcagcagcacagacc ctgcgaccggagatgtgcat gttatgggagccttacctgg aatggtgtggcaagacagag acgtatacctgcagggtcct atttgggccaaaattcctca cacggatggacactttcacc cgtctcctctcatgggcggc tttggacttaagcacccgcc tcctcagatcctcatcaaaa acacgcctgttcctgcgaat cctccggcagagttttcggc tacaaagtttgcttcattca tcacccagtattccacagga caagtgagcgtggagattga atgggagctgcagaaagaaa acagcaaacgctggaatccc gaagtgcagtatacatctaa ctatgcaaaatctgccaacg ttgatttcactgtggacaac aatggactttatactgagcc tcgccccattggcacccgtt acctcacccgtcccctgtaa |

An isolated and purified adeno-associated virus (AAV) nucleic acid sequence can encodes mutations F129L and H642N in the corresponding polypeptide sequence of an AAV capsid nucleic acid sequence. An isolated and purified adeno-associated virus (AAV) nucleic acid sequence can have mutations F129L and L584D in the corresponding polypeptide sequence of an AAV capsid nucleic acid sequence. An isolated and purified adeno-associated virus (AAV) nucleic acid sequence can have mutations F129L and D418N in the corresponding polypeptide sequence of an AAV capsid nucleic acid sequence. An isolated and purified adeno-associated virus (AAV) nucleic acid sequence can have mutations F129L and L584H in the corresponding polypeptide sequence of an AAV capsid nucleic acid sequence. An isolated and purified adeno-associated virus (AAV) nucleic acid sequence can have mutations F129L, H642N, and D418N in the corresponding polypeptide sequence of an AAV capsid nucleic acid sequence. An isolated and purified adeno-associated virus (AAV) nucleic acid sequence can have mutations F129L, H642N, and L584D in the corresponding polypeptide sequence of an AAV capsid nucleic acid sequence. An isolated and purified adeno-associated virus (AAV) nucleic acid sequence can have mutations F129L, H642N, and L584N in the corresponding polypeptide sequence of an AAV capsid nucleic acid sequence. An isolated and purified adeno-associated virus (AAV) nucleic acid sequence can have mutations F129L, H642N and L584H in the corresponding polypeptide sequence of an AAV capsid nucleic acid sequence. An isolated and purified adeno-associated virus (AAV) nucleic acid sequence can have mutations F129L, H642N, and V598L in the corresponding polypeptide sequence of an AAV capsid nucleic acid sequence. An isolated and purified adeno-associated virus (AAV) nucleic acid sequence can have mutations F129L, H642N, and V598I in the corresponding polypeptide sequence of an AAV capsid nucleic acid sequence.

Another mutagenesis technique that can be used in methods of the invention is DNA shuffling. DNA or gene shuffling involves the creation of random fragments of members of a gene family and their recombination to yield many new combinations. To shuffle AAV capsid genes, several parameters can be considered, including: involvement of the three capsid proteins VP1, VP2, and VP3 and different degrees of homologies between 8 serotypes. To increase the likelihood of obtaining a viable AAV vector with a cell- or tissue-specific tropism, for example, a shuffling protocol yielding a high diversity and large number of permutations is preferred. An example of a DNA shuffling protocol for the generation of chimeric AAV is random chimeragenesis on transient templates (RACHITT), Coco et al., Nat. Biotech. 19:354-358, 2001. The RACHITT method can be used to recombine two PCR fragments derived from AAV genomes of two different serotypes (e.g., AAV 5d AAV6). For example, conservative regions of the cap gene, segments that are 85% identical, spanning approximately 1 kbp and including initiating codons for all three genes (VP1, VP2, and VP3) can be shuffled using a RATCHITT or other DNA shuffling protocol, including in vivo shuffling protocols (U.S. Pat. No. 5,093,257; Volkov et al., NAR 27:e18, 1999; and Wang P. L., Dis. Markers 16:3-13, 2000). A resulting combinatorial chimeric library can be cloned into a suitable AAV TR-containing vector to replace the respective fragment of the WT AAV genome. Random clones can be sequenced and aligned with parent genomes using AlignX application of Vector NTI 7 Suite Software. From the sequencing and alignment, the number of recombination crossovers per 1 Kbp gene can be determined. Alternatively, the variable domain of AAV genomes can be shuffled using methods of the invention. For example, mutations can be generated within two amino acid clusters (amino acids 509-522 and 561-591) of AAV that likely form a particle surface loop in VP3. To shuffle this low homology domain, recombination protocols can be utilized that are independent of parent's homology (Ostermeier et al., Nat. Biotechnol. 17:1205-1209, 1999; Lutz et al., Proceedings of the National Academy of Sciences 98:11248-11253, 2001; and Lutz et al., NAR 29:E16, 2001) or a RACHITT protocol modified to anneal and recombine DNA fragments of low homology.

In some cases, a targeted mutation of S/T/K residues on an AAV capsid can be performed. Following cellular internalization of AAV by receptor-mediated endocytosis, it can travel through the cytosol, undergoing acidification in the endosomes before getting released. Post endosomal escape, AAV undergoes nuclear trafficking, where uncoating of the viral capsid takes place resulting in release of its genome and induction of gene expression. S/T/K residues are potential sites for phosphorylation and subsequent poly-ubiquitination which serves as a cue for proteasomal degradation of capsid proteins. This can prevent trafficking of the vectors into the nucleus to express its transgene, an exogenous TCR, leading to low gene expression. Also, the proteasomally degraded capsid fragments can be presented by the MHC-Class I molecules on the cell surface for CD8 T-cell recognition. This leads to immune response thus destroying the transduced cells and further reducing persistent transgene expression. Point mutations, S/T to A and K to R, can prevent/reduce phosphorylation sites on the capsid. This can lead to reduced ubiquitination and proteasomal degradation allowing more number of intact vectors to enter nucleus and express the transgene. Preventing/lowering the overall capsid degradation also reduces antigen presentation to T cells resulting in lower host immune response against the vectors.

In some cases, an engineered AAV can include exogenous sequences from alternate serotypes. For example, a chimeric AAV can be generated that can include sequences from at least 2 different AAV serotypes. The term "serotype" can be a distinction with respect to an AAV having a capsid which is serologically distinct from other AAV serotypes. Serologic distinctiveness can be determined on the basis of the lack of cross-reactivity between antibodies to the AAV as compared to other AAV. Cross-reactivity can be measured in a neutralizing antibody assay. For this assay polyclonal serum can be generated against a specific AAV in a rabbit or other suitable animal model using the adeno-associated viruses. In this assay, serum generated against a specific AAV can then be tested in its ability to neutralize either the same (homologous) or a heterologous AAV. The dilution that achieves 50% neutralization is considered the neutralizing antibody titer. If for two AAVs the quotient of the heterologous titer divided by the homologous titer is lower than 16 in a reciprocal manner, those two vectors are considered as the same serotype. Conversely, if the ratio of the heterologous titer over the homologous titer is 16 or more in a reciprocal manner the two AAVs are considered distinct serotypes.

In some cases, a modification can be of an AAV serotype 6 capsid. In some cases a subject variant AAV capsid protein (or the variant AAV capsid protein encoded by a subject nucleic acid) can comprise homology to any one of the nucleic acid sequences and/or protein sequences encoded therefrom in Table 4, SEQ ID NO: 38 to SEQ ID NO: 45, from about 10%, 15%, 20%, 25%, 30%, 35%, 40%, 45%, 50%, 55%, 60%, 65%, 70%, 75%, 80%, 85% 90%, 91%, 92%, 93%, 94%, 95%, 96%, 97%, 98%, 99% or up to 100%.

TABLE 4

AAV chimeric capsid sequences

| SEQ ID NO: | Name | Sequence |
|---|---|---|
| 38 | AAV4VP1u-AAV6VP2/3 | ggtaccaaaacaaatgttctcgtcacgtgggcatgaatctgatgctgttt ccctgcagacaatgcgagagaatgaatcagaattcaaatatctgcttcac tcacggacagaaagactgtttagagtgctttcccgtgtcagaatctcaac ccgtttctgtcgtcaaaaaggcgtatcagaaactgtgctacattcatcat atcatgggaaaggtgccagacgcttgcactgcctgcgatctggtcaatgt ggatttggatgactgcatctttgaacaataaatgatttaaatcaggtatg actgacggttaccttccagattggctagaggacaacctctctgaaggcgt tcgagagtggtgggcgctgcaacctggagcccctaaacccaaggcaaatc aacaacatcaggacaacgctcggggtcttgtgcttccgggttacaaatac ctcggacccggcaacggactcgacaagggggaacccgtcaacgcagcgga cgcggcagccctcgagcacgacaaggcctacgaccagcagctcaaggccg gtgacaaccccacctcaagtacaaccacgccgacgcggagttccagcag cggcttcagggcgacacatcgtttgggggcaacctcggcagagcagtctt ccaggccaaaaagagggttcttgaacctcttggtctggttgagcaagcgg gtgagacggctcctggaaagaaacgtccggtagagcagtcgccacaagag ccagactcctcctcgggcattggcaagacaggccagcagcccgctaaaaa gagactcaattttggtcagactggcgactcagagtcagtcccgacccac aacctctcggagaacctccagcaaccccgctgctgtgggacctactaca atggcttcaggcggtggcgcaccaatggcagacaataacgaaggcgccga cggagtgggtaatgcctcaggaaattggcattgcgattccacatggctgg gcgacagagtcatcaccaccagcacccgaacatgggccttgcccacctat aacaaccacctctacaagcaaatctccagtgcttcaacggggccagcaa cgacaaccactacttcggctacagcaccccctgggggtattttgatttca acagattccactgccatttctcaccacgtgactggcagcagctcatcaac aacaattggggattccggcccaagagactcaacttcaagctcttcaacat ccaagtcaaggaggtcacgacgaatgatggcgtcacgaccatcgctaata accttaccagcacggttcaagtcttctcggactcggagtaccagttgccg tacgtcctcggctctgcgcaccagggctgcctccctccgttcccggcgga cgtgttcatgattccgcagtacggctacctaacgctcaacaatggcagcc aggcagtgggacggtcatcctttactgcctggaatatttcccatcgcag atgctgagaacgggcaataactttaccttcagctacaccttcgaggacgt gccttccacagcagctacgcgcacagccagagcctggaccggctgatga atcctctcatcgaccagtacctgtattacctgaacagaactcagaatcag tccggaagtgcccaaaacaaggacttgctgtttagccgggggtctccagc tggcatgtctgttcagcccaaaaactggcacctggaccctgttaccggc agcagcgcgtttctaaaacaaaaacagacaacaacaacagcaactttacc tggactggtgcttcaaaatataaccttaatgggcgtgaatctataatcaa ccctggcactgctatggcctcacacaaagacgacaaagacaagttctttc ccatgagcggtgtcatgattttttggaaaggagagcgccggagcttcaaac actgcattggacaatgtcatgatcacagacgaagaggaaatcaaagccac taaccccgtggccaccgaaagatttgggactgtggcagtcaatctccaga gcagcagcacagaccctgcgaccggagatgtgcatgttatgggagcctta cctggaatggtgtggcaagacagagacgtatacctgcagggtcctatttg ggccaaaattcctcacacggatggacactttcacccgtctcctctcatgg gcggctttggacttaagcacccgcctcctcagatcctcatcaaaaacacg cctgttcctgcgaatcctccggcagagttttcggctacaaagtttgcttc attcatcacccagtattccacaggacaagtgagcgtggagattaatggg agctgcagaaagaaaacagcaaacgctggaatcccgaagtgcagtataca tctaactatgcaaaatctgccaacgttgatttcactgtggacaacaatgg actttatactgagcctcgccccattggcacccgttacctcacccgtcccc tgtaattgtgtgttaatcaataaaccggt |
| 39 | AAV5VP1u-AAV6VP2/3 | ggtaccaaaacaaatgttctcgtcacgtgggcatgaatctgatgctgttt ccctgcagacaatgcgagagaatgaatcagaattcaaatatctgcttcac tcacggacagaaagactgtttagagtgctttcccgtgtcagaatctcaac ccgtttctgtcgtcaaaaaggcgtatcagaaactgtgctacattcatcat atcatgggaaaggtgccagacgcttgcactgcctgcgatctggtcaatgt ggatttggatgactgcatctttgaacaataaatgatttaaatcaggtatg tcttttgttgatcaccctccagattggttggaagaagttggtgaaggtct tcgcgagttttgggccttgaagcgggccaccgaaaccaaaacccaatc agcagcatcaagatcaagcccgtggtcttgtgctgcctggttataactat ctcggacccggaaacggtctcgatcgaggagagcctgtcaacggggcaga cgaggtcgcgcgagagcacgacatctcgtacaacgagcagcttgaggcgg gagacaacccctacctcaagtacaaccacgcggacgccgagtttcaggag aagctcgccgacgacacatccttcgggggaaacctcggaaaggcagtctt tcaggccaagaaaagggttcttgaaccttttggcctggttgagaggggtg ctaagacggctcctggaaagaaacgtccggtagagcagtcgccacaagag ccagactcctcctcgggcattggcaagacaggccagcagcccgctaaaaa gagactcaattttggtcagactggcgactcagagtcagtcccgacccac aacctctcggagaacctccagcaaccccgctgctgtgggacctactaca atggcttcaggcggtggcgcaccaatggcagacaataacgaaggcgccga |

TABLE 4-continued

AAV chimeric capsid sequences

| SEQ ID NO: | Name | Sequence |
|---|---|---|
| | | cggagtgggtaatgcctcaggaaattggcattgcgattccacatggctgg<br>gcgacagagtcatcaccaccagcacccgaacatgggccttgcccaccdtat<br>aacaaccacctctacaagcaaatctccagtgcttcaacgggggccagcaa<br>cgacaaccactacttcggctacagcaccccctgggggtattttgatttca<br>acagattccactgccatttctcaccacgtgactggcagcgactcatcaac<br>aacaattggggattccggcccaagagactcaacttcaagctcttcaacat<br>ccaagtcaaggaggtcacgacgaatgatggcgtcacgaccatcgctaata<br>accttaccagcacggttcaagtcttctcggactcggagtaccagttgccg<br>tacgtcctcggctctgcgcaccagggctgcctccctccgttcccggcgga<br>cgtgttcatgattccgcagtacggctacctaacgctcaacaatggcagcc<br>aggcagtgggacggtcatccttttactgcctggaatatttcccatcgcag<br>atgctgagaacgggcaataactttaccttcagctacaccttcgaggacgt<br>gcctttccacagcagctacgcgcacagccagagcctggaccggctgatga<br>atcctctcatcgaccagtacctgtattacctgaacagaactcagaatcag<br>tccggaagtgcccaaaacaaggacttgctgtttagccgggggtctccagc<br>tggcatgtctgttcagcccaaaaactggctacctggaccctgttaccggc<br>agcagcgcgtttctaaaacaaaaacagacaacaacaacagcaactttacc<br>tggactggtgcttcaaaatataaccttaatgggcgtgaatctataatcaa<br>ccctggcactgctatggcctcacacaaagacgacaaagacaagttctttc<br>ccatgagcggtgtcatgattttggaaaggagagcgccggagcttcaaac<br>actgcattggacaatgtcatgatcacagacgaagaggaaatcaaagccac<br>taaccccgtggccaccgaaagatttgggactgtggcagtcaatctccaga<br>gcagcagcacagaccctgcgaccggagatgtgcatgttatgggagccta<br>cctgaatggtgtggcaagacagagacgtatacctgcagggtcctatttg<br>ggccaaaattcctcacacggatggacactttcacccgtctcctctcatgg<br>gcggctttggacttaagcacccgcctcctcagatcctcatcaaaaacacg<br>cctgttcctgcgaatcctccggcagagttttcggctacaaagtttgcttc<br>attcatcacccagtattccacaggacaagtgagcgtggagattgaatggg<br>agctgcagaaagaaaacagcaaacgctggaatcccgaagtgcagtataca<br>tctaactatgcaaaatctgccaacgttgatttcactgtggacaacaatgg<br>actttatactgagcctcgcccattggcaccgttacctcacccgtcccc<br>tgtaattgtgtgttaatcaataaaccggt |
| 40 | AAV11VP1u-AAV6VP2/3 | ggtaccaaaacaaatgttctcgtcacgtgggcatgaatctgatgctgttt<br>ccctgcagacaatgcgagagaatgaatcagaattcaaatatctgcttcac<br>tcacggacagaaagactgtttagagtgcttcccgtgtcagaatctcaac<br>ccgtttctgtcgtcaaaaaggcgtatcagaaactgtgctacattcatcat<br>atcatgggaaaggtgccagacgcttgcactgctgcgatctggtcaatgt<br>ggatttggatgactgcatctttgaacaataaatgatttaaatcaggtatg<br>gctgctgacggttatcttccagattggctcgaggacaacctctctgaggg<br>cattcgcgagtggtgggacctgaaacctggagccccgaagcccaaggcca<br>accagcagaagcaggacgacggccggggtctggtgcttcctggctacaag<br>tacctcggacccttcaacggactcgacaagggggagcccgtcaacgcggc<br>ggacgcagcgggccctcgagcacgacaaggcctacgaccagcagctcaag<br>cgggtgacaatccgtacctgcggtataaccacgccgacgccgagtttcag<br>gagcgtctgcaagaagatacgtcttttgggggcaaccctcgggcgagcagt<br>cttccaggccaagaagagggtactcgaacctctgggcctggttgaagaag<br>gtgctaaaacggctcctggaaagaaacgtccggtagagcagtcgccacaa<br>gagccagactcctcctcgggcattggcaagacaggccagcagcccgctaa<br>aaagagactcaattttggtcagactggcgactcagagtcagtccccgacc<br>cacaacctctcggagaacctccagcaaccccgctgctgtgggacctact<br>acaatggcttcaggcggtggcgcaccaatggcagacaataacgaaggcgc<br>cgacggagtgggtaatgcctcaggaaattggcattgcgattccacatggc<br>tgggcgacagagtcataccaccagcacccgaacatgggccttgcccacc<br>tataacaaccacctctacaagcaaatctccagtgcttcaacggggggccag<br>caacgacaaccactacttcggctacagcaccccctgggggtatttgatt<br>tcaacagattccactgccatttctcaccacgtgactggcagcgactcatc<br>aacaacaattggggattccggcccaagagactcaacttcaagctcttcaa<br>catccaagtcaaggaggtcacgacgaatgatggcgtcacgaccatcgcta<br>ataaccttaccagcacggttcaagtcttctcggactcggagtaccagttg<br>ccgtacgtcctcggctctgcgcaccagggctgcctccctccgttcccggc<br>ggacgtgttcatgattccgcagtacggctacctaacgctcaacaatggca<br>gccaggcagtgggacggtcatccttttactgcctggaatatttcccatcg<br>cagatgctgagaacgggcaataactttaccttcagctacaccttcgagga<br>cgtgcctttccacagcagctacgcgcacagccagagcctggaccggctga<br>tgaatcctctcatcgaccagtacctgtattacctgaacagaactcagaat<br>cagtccggaagtgcccaaaacaaggacttgctgtttagccggggggtctcc<br>agctggcatgtctgttcagcccaaaaactggctacctggaccctgttacc<br>ggcagcagcgcgtttctaaaacaaaaacagacaacaacaacagcaacttt<br>acctggactggtgcttcaaaatataaccttaatgggcgtgaatctataat<br>caaccctggcactgctatggcctcacacaaagacgacaaagacaagttct<br>ttcccatgagcggtgtcatgattttggaaaggagagcgccggagcttca<br>aacactgcattggacaatgtcatgatcacagacgaagaggaaatcaaagc<br>cactaaccccgtggccaccgaaagatttgggactgtggcagtcaatctcc |

TABLE 4-continued

AAV chimeric capsid sequences

| SEQ ID NO: | Name | Sequence |
|---|---|---|
| | | agagcagcagcacagaccctgcgaccggagatgtgcatgttatgggagcc<br>ttacctggaatggtgtggcaagacagagacgtatacctgcagggtcctat<br>ttgggccaaaattcctcacacggatggacactttcacccgtctcctctca<br>tgggcggctttggacttaagcacccgcctcctcagatcctcatcaaaaac<br>acgcctgttcctgcgaatcctccggcagagttttcggctacaaagtttgc<br>ttcattcatcacccagtattccacaggacaagtgagcgtggagattgaat<br>gggagctgcagaaagaaaacagcaaacgctggaatcccgaagtgcagtat<br>acatctaactatgcaaaatctgccaacgttgatttcactgtggacaacaa<br>tggactttatactgagcctcgccccattggcacccgttacctcacccgtc<br>ccctgtaattgtgtgttaatcaataaaccggt |
| 41 | AAV12VP1u-<br>AAV6VP2/3 | ggtaccaaaacaaatgttctcgtcacgtgggcatgaatctgatgctgttt<br>ccctgcagacaatgcgagagaatgaatcagaattcaaatatctgcttcac<br>tcacggacagaaagactgtttagagtgctttcccgtgtcagaatctcaac<br>ccgtttctgtcgtcaaaaaggcgtatcagaaactgtgctacattcatcat<br>atcatgggaaaggtgccagacgcttgcactgcctgcgatctggtcaatgt<br>ggatttggatgactgcatctttgaacaataaatgatttaaatcaggtatg<br>gctgctgacggttatcttccagattggctcgaggacaacctctctgaagg<br>cattcgcgagtggtgggcgctgaaacctggagctccacaacccaaggca<br>accaacagcatcaggacaacggcaggggtcttgtgcttcctgggtacaag<br>tacctcggacccttcaacggactcgacaagggagagccggtcaacgaggc<br>agacgccgcggccctcgagcacgacaaggcctacgacaagcagctcgagc<br>aggggggacaacccgtatctcaagtacaaccacgccgacgccgagttccag<br>cagcgcttggcgaccgacacctcttttgggggcaacctcggcgagcagt<br>cttccaggccaaaaagaggattctcgagcctctgggtctggttgaagagg<br>gcgttaaaacggctcctggaaagaaacgtccggtagagcagtcgccacaa<br>gagccagactcctcctcgggcattggcaagacaggccagcagcccgctaa<br>aaagagactcaattttggtcagactggcgactcagagtcagtcccccgacc<br>cacaacctctcggagaacctccagcaaccccgctgctgtgggacctact<br>acaatggcttcaggcggtggcgcaccaatggcagacaataacgaaggcgc<br>cgacggagtgggtaatgcctcaggaaattggcattgcgattccacatggc<br>tgggcgacagagtcatcaccaccagcaccgaacatgggccttgcccacc<br>tataacaaccacctctacaagcaaatctccagtgcttcaacggggggccag<br>caacgacaaccactacttcggctacagcaccccctgggggtattttgatt<br>caacagattccactgccatttctcaccacgtgactggcagcgactcatc<br>aacaacaattggggattccggcccaagagactcaacttcaagctcttcaa<br>catccaagtcaaggaggtcacgacgaatgatggcgtcacgaccatcgcta<br>ataaccttaccagcacggttcaagtcttctcggactcggagtaccagttg<br>ccgtacgtcctcggctctgcgcaccagggctgcctccctccgttcccggc<br>ggacgtgttcatgattccgcagtacggctacctaacgctcaacaatggca<br>gccaggcagtgggacggtcatccttttactgcctggaatatttcccatcg<br>cagatgctgagaacgggcaataactttaccttcagctacaccttcgagga<br>cgtgcctttccacagcagctacgcgcacagccagagcctggaccggctga<br>tgaatcctctcatcgaccagtacctgtattacctgaacagaactcagaat<br>cagtccggaagtgcccaaaacaaggacttgctgtttagccgggggtctcc<br>agctggcatgtctgttcagcccaaaaactggctacctggaccctgttacc<br>ggcagcagcgcgtttctaaaacaaaaacagacaacaacaacagcaacttt<br>acctggactggtgcttcaaaatataaccttaatgggcgtgaatctataat<br>caaccctggcactgctatggcctcacacaaagacgacaaagacaagttct<br>ttcccatggagcggtgtcatgattttggaaaggagagcgccggagcttca<br>aacactgcattggacaatgtcatgatcacagacgaagaggaaatcaaagc<br>cactaaccccgtggccaccgaaagatttgggactgtggcagtcaatctcc<br>agagcagcagcacagaccctgcgaccggagatgtgcatgttatgggagcc<br>ttacctggaatggtgtggcaagacagagacgtatacctgcagggtcctat<br>ttgggccaaaattcctcacacggatggacactttcacccgtctcctctca<br>tgggcggctttggacttaagcacccgcctcctcagatcctcatcaaaaac<br>acgcctgttcctgcgaatcctccggcagagttttcggctacaaagtttgc<br>ttcattcatcacccagtattccacaggacaagtgagcgtggagattgaat<br>gggagctgcagaaagaaaacagcaaacgctggaatcccgaagtgcagtat<br>acatctaactatgcaaaatctgccaacgttgatttcactgtggacaacaa<br>tggactttatactgagcctcgccccattggcacccgttacctcacccgtc<br>ccctgtaattgtgtgttaatcaataaaccggt |
| 42 | AAV4VP1/2-<br>AAV6VP3 | ggtaccaaaacaaatgttctcgtcacgtgggcatgaatctgatgctgttt<br>ccctgcagacaatgcgagagaatgaatcagaattcaaatatctgcttcac<br>tcacggacagaaagactgtttagagtgctttcccgtgtcagaatctcaac<br>ccgtttctgtcgtcaaaaaggcgtatcagaaactgtgctacattcatcat<br>atcatgggaaaggtgccagacgcttgcactgcctgcgatctggtcaatgt<br>ggatttggatgactgcatctttgaacaataaatgatttaaatcaggtatg<br>actgacggttaccttccagattggctagaggacaacctctctgaaggcgt<br>tcgagagtggtgggcgctgcaacctggagccccta aacccaaggcaaatc<br>aacaacatcaggacaacgctcggggtcttgtgcttccgggttacaaatac<br>ctcggacccggcaacggactcgacaaggggaacccgtcaacgcagcgga<br>cgcggcagccctcgagcacgacaaggcctacgaccagcagctcaaggccg |

TABLE 4-continued

AAV chimeric capsid sequences

| SEQ ID NO: | Name | Sequence |
|---|---|---|
| | | gtgacaaccccctacctcaagtacaaccacgccgacgcggagttccagcag cggcttcagggcgacacatcgtttgggggcaacctcggcagagcagtctt ccaggccaaaaagaggggttcttgaacctcttggtctggttgagcaagcgg gtgagacggctcctggaaagaagagaccgttgattgaatccccccagcag cccgactcctccacgggtatcggcaaaaaaggcaagcagccggctaaaaa gaagctcgttttcgaagacgaaactggagcaggcgacggaccccctgagg gatcaacttccggagccatgtctgatgacagtgagatggcttcaggcggt ggcgcaccaatggcagacaataacgaaggcgccgacggagtgggtaatgc ctcaggaaattggcattgcgattccacatggctgggcgacagagtcatca ccaccagcacccgaacatgggccttgcccacctataacaaccacctctac aagcaaatctccagtgcttcaacgggggccagcaacgacaaccactactt cggctacagcacccccctgggggtattttgatttcaacagattccactgcc atttctcaccacgtgactggcagcgactcatcaacaacaattggggattc cggcccaagagactcaacttcaagctcttcaacatccaagtcaaggaggt cacgacgaatgatggcgtcacgaccatcgctaataaccttaccagcacgg ttcaagtcttctcggactcggagtaccagttgccgtacgtcctcggctct gcgcaccagggctgcctccctccgttcccggcggacgtgttcatgattcc gcagtacggctacctaacgctcaacaatggcagccaggcagtgggacggt catccttttactgcctggaatatttcccatcgcagatgctgagaacgggc aataactttaccttcagctacaccttcgaggacgtgccttttccacagcag ctacgcgcacagccagagcctggaccggctgataatcctctcatcgacc agtacctgtattacctgaacagaactcagaatcagtccggaagtgcccaa aacaaggacttgctgtttagccggggtctccagctggcatgtctgttca gcccaaaaactggctacctggaccctgttaccggcagcagcgcgtttcta aaacaaaaacagacaacaacaacagcaactttacctggactggtgcttca aaatataaccttaatgggcgtgaatctataatcaaccctggcactgctat ggcctcacacaaagacgacaaagacaagttctctttcccatgagcggtgtca tgattttggaaaggagagcgccggagcttcaaacactgcattggacaat gtcatgatcacagacgaagaggaaatcaaagccactaacccccgtggccac cgaaagatttgggactgtggcagtcaatctccagagcagcagcacagacc ctgcgaccggagatgtgcatgttatgggagccttacctggaatggtgtgg caagacagagacgtatacctgcagggtcctatttgggccaaaattcctca cacggatggacactttcacccgtctcctctcatgggcggctttggactta agcacccgcctcctcagatcctcatcaaaaacacgcctgttcctgcgaat cctccggcagagttttcggctacaaagtttgcttcattcatcacccagta ttccacaggacaagtgagcgtggagattgaatgggagctgcagaaagaaa acagcaaacgctggaatcccgaagtgcagtatacatctaactatgcaaaa tctgccaacgttgatttcactgtggacaacaatggactttatactgagcc tcgccccattggcacccgttacctcacccgtcccctgtaattgtgtgtta atcaataaaccggt |
| 43 | AAV5VP1_2-AAV6VP3 | ggtaccaaaacaaatgttctcgtcacgtgggcatgaatctgatgctgttt ccctgcagacaatgcgagagaatgaatcagaattcaaatatctgcttcac tcacggacaaagactgtttagagtgctttcccgtgtcagaatctcaac ccgtttctgtcgtcaaaaaggcgtatcagaaactgtgctacattcatcat atcatgggaaaggtgccagacgcttgcactgcctgcgatctggtcaatgt ggatttggatgactgcatctttgaacaataaatgatttaaatcaggtatg tcttttgttgatcaccctccagattggttggaagaagttggtgaaggtct tcgcgagttttgggccttgaagcgggccaccgaaaccaaaaacccaatc agcagcatcaagatcaagcccgtggtcttgtgctgcctggttataactat ctcggacccggaaacggtctcgatcgaggagagcctgtcaacagggcaga cgaggtcgcgcgagagcacgacatctcgtacaacgagcagcttgaggcgg gagcaaccccctaccttcaagtacaaccacgcggacgccggagtttcaggag aagctcgccgacgacacatccttcggggggaaacctcggaaaggcagtctt tcaggccaagaaaagggttctcgaacctttttggcctggttgaagagggtg ctaagacggcccctaccggaaagcggatagacgaccactttccaaaagaa aagaaggctcggaccgaagaggactccaagccttccacctcgtcagacgc cgaagctggacccagcggatcccagcagctgcaaatcccagcccaaccag cctcaagtttgggagctgatacaatggcttcaggcggtggcgcaccaatg gcagacaataacgaaggcgccgacggagtgggtaatgcctcaggaaattg gcattccgattccacatggctgggcgacagagtcatcaccaccagcaccc gaacatgggccttgcccacctataacaaccacctctacaagcaaatctcc agtgcttcaacgggggccagcaacgacaaccactacttcggctacagcac ccccctgggggtattttgatttcaacagattccactgccatttctcaccac gtgactggcagcgactcatcaacaacaattggggattccggcccaagaga ctcaacttcaagctcttcaacatccaagtcaaggaggtcacgacgaatga tggcgtcacgaccatcgctaataaccttaccagcacggttcaagtcttct cggactcggagtaccagttgccgtacgtcctcggctctgcgcaccagggc tgcctccctccgttcccggcggacgtgttcatgattccgcagtacggcta cctaacgctcaacaatggcagccaggcagtgggacggtcatccttttact gcctggaatatttcccatcgcagatgctgagaacgggcaataactttacc ttcagctacaccttcgaggacgtgccttttccacagcagctacgcgcacag ccagagcctggaccggctgataatcctctcatcgaccagtacctgtatt acctgaacagaactcagaatcagtccggaagtgcccaaaacaaggacttg |

TABLE 4-continued

AAV chimeric capsid sequences

| SEQ ID NO: | Name | Sequence |
|---|---|---|
|  |  | ctgtttagccgggggtctccagctggcatgtctgttcagcccaaaaactg gctacctggaccctgttaccggcagcagcgcgtttctaaaacaaaaacag acaacaacaacagcaactttacctggactggtgcttcaaaatataaccttc aatgggcgtgaatctataatcaaccctggcactgctatggcctcacacaa agacgacaaagacaagttctttcccatgagcggtgtcatgatttttggaa aggagagcgccggagcttcaaacactgcattggacaatgtcatgatcaca gacgaagaggaaatcaaagccactaaccccgtggccaccgaaagatttgg gactgtggcagtcaatctccagagcagcagcacagaccctgcgaccggag atgtgcatgttatgggagccttacctggaatggtgtggcaagacagagac gtatacctgcagggtcctatttgggccaaaattcctcacacggatggaca ctttcacccgtctcctctcatgggcggctttggacttaagcacccgcctc ctcagatcctcatcaaaaacacgcctgttcctgcgaatcctccggcagag ttttcggctacaaagtttgcttcattcatcacccagtattccacaggaca agtgagcgtggagattgaatgggagctgcagaaagaaaacagcaaacgct ggaatcccgaagtgcagtatacatctaactatgcaaaatctgccaacgtt gatttcactgtggacaacaatggactttatactgagcctcgccccattgg cacccgttacctcacccgtcccctgtaattgtgtgttaatcaataaaccg gt |
| 44 | AAV11VP1/ 2-AAV6VP3 | ggtaccaaaacaaatgttctcgtcacgtgggcatgaatctgatgctgttt ccctgcagacaatgcgagagaatgaatcagaattcaaatatctgcttcac tcacggacagaaagactgtttagagtgctttcccgtgtcagaatctcaac ccgtttctgtcgtcaaaaaggcgtatcagaaactgtgctacattcatcat atcatgggaaaggtgccagacgcttgcactgcctgcgatctggtcaatgt ggatttggatgactgcatctttgaacaataaatgatttaaatcaggtatg gctgctgacggttatcttccagattggctcgaggacaacctctctgaggg cattcgcgagtggtgggacctgaaacctggagccccgaagcccaaggcca accagcagaagcaggacgacggccgggctcggtgcttcctggctacaag tacctcggaccctcaacggactcgacaaggggagcccgtcaacgcggc ggacgcagcggccctcgagcacgacaaggcctacgaccagcagctcaaag cgggtgacaatccgtacctgcggtataaccacgccgacgccgagtttcag gagcgtctgcaagaagatacgtcttttggggcaacctcgggcgagcagt cttccaggccaagaagagggtactcgaacctctgggcctggttgaagaag gtgctaaaacggctcctggaaagaagagaccgttagagtcaccacaagag cccgactcctcctcgggcatcggcaaaaaggcaaacaaccagccagaaa gaggctcaactttgaagaggacactggagccggagacggacccccctgaag gatcagataccagcgccatgtcttcagacattgaaatggcttcaggcggt ggcgcaccaatggcagacaataacgaaggcgccgacggagtgggtaatgc ctcaggaaattggcattgcgattccacatggctgggcgacagagtcatca ccaccagcacccgaacatgggccttgcccacctataacaaccacctctac aagcaaatctccagtgcttcaacggggggccagcaacgacaaccactactt cggctacagcaccccctgggggtatttgatttcaacagattccactgcc atttctcaccacgtgactggcagcgactcatcaacaacaattggggattc cggcccaagagactcaacttcaagctcttcaacatccaagtcaaggaggt cacgacgaatgatggcgtcacgaccatcgctaataaccttaccagcacgg ttcaagtcttctcggactcggagtaccagttgccgtacgtcctcggctct gcgcaccagggctgcctccctccgttcccggcggacgtgttcatgattcc gcagtacggctacctaacgctcaacaatggcagccaggcagtgggacggt catcctttactgcctggaatattccccatcgcagatgctgagaacgggc aataactttaccttcagctacacccttcgaggacgtgccttccacagcag ctacgcgcacagccagagcctggaccggctgatgaatcctctcatcgacc agtacctgtattacctgaacagaactcagaatcagtccggaagtgcccaa aacaaggacttgctgtttagccggggggtctccagctggcatgtctgttca gcccaaaaactggctacctggaccctgttaccggcagcagcgcgtttcta aaacaaaaacagacaacaacaacagcaactttacctggactggtgcttca aaatataaccttaatgggcgtgaatctataatcaaccctggcactgctat ggcctcacacaaagacgacaaagacaagttctttcccatgagcggtgtca tgatttttggaaaggagagcgccggagcttcaaacactgcattggacaat gtcatgatcacagacgaagaggaaatcaaagccactaaccccgtggccac cgaaagatttgggactgtggcagtcaatctccagagcagcagcacagacc ctgcgaccggagatgtgcatgttatgggagccttacctggaatggtgtgg caagacagagacgtatacctgcagggtcctatttgggccaaaattcctca cacggatggacactttcacccgtctcctctcatgggcggctttggactta agcacccgcctcctcagatcctcatcaaaaacacgcctgttcctgcgaat cctccggcagagttttcggctacaaagtttgcttcattcatcacccagta ttccacaggacaagtgagcgtggagattgaatgggagctgcagaaagaaa acagcaaacgctggaatcccgaagtgcagtatacatctaactatgcaaaa tctgccaacgttgatttcactgtggacaacaatggactttatactgagcc tcgccccattggcacccgttacctcacccgtcccctgtaattgtgtgtta atcaataaaccggt |
| 45 | AAV12VP1/ 2-AAV6VP3 | ggtaccaaaacaaatgttctcgtcacgtgggcatgaatctgatgctgttt ccctgcagacaatgcgagagaatgaatcagaattcaaatatctgcttcac tcacggacagaaagactgtttagagtgctttcccgtgtcagaatctcaac |

TABLE 4-continued

AAV chimeric capsid sequences

| SEQ ID NO: | Name | Sequence |
|---|---|---|
| | | ccgtttctgtcgtcaaaaaggcgtatcagaaactgtgctacattcatcat
atcatgggaaaggtgccagacgcttgcactgcctgcgatctggtcaatgt
ggatttggatgactgcatcttttgaacaataaatgatttaaatcaggtatg
gctgctgacggttatcttccagattggctcgaggacaacctctctgaagg
cattcgcgagtggtgggcgctgaaacctggagctccacaacccaaggcca
accaacagcatcaggacaacggcagggtcttgtgcttcctgggtacaag
tacctcggacccttcaacggactcgacaagggagagccggtcaacgaggc
agacgccgcggccctcgagcacgacaaggcctacgacaagcagctcgagc
aggggggacaacccgtatctcaagtacaaccacgccgacgccgagttccag
cagcgcttggcgaccgacacctcttttgggggcaacctcgggcgagcagt
cttccaggccaaaaagaggattctcgagcctctgggtctggttgaagagg
gcgttaaaacggctcctggaaagaaacgcccattagaaaagactccaaat
cggccgaccaacccggactctgggaaggcccggccaagaaaagcaaaa
agacggcgaaccagccgactctgctagaaggacactcgactttgaagact
ctggagcaggagacggacccctgagggatcatcttccggagaaatgtct
catgatgctgagatggcttcaggcggtggcgcaccaatggcagacaataa
cgaaggcgccgacggagtgggtaatgcctcaggaaattggcattgcgatt
ccacatggctgggcgacagagtcatcaccaccagcacccgaacatgggcc
ttgcccacctataacaaccacctctacaagcaaatctccagtgcttcaac
gggggccagcaacgacaaccactacttcggctacagccccctgggggt
atttttgatttcaacagattccactgccatttctcaccacgtgactggcag
cgactcatcaacaacaattggggattccggcccaagagactcaacttcaa
gctcttcaacatccaagtcaaggaggtcacgacgaatgatggcgtcacga
ccatcgctaataaccttaccagcacggttcaagtcttctcggactcggag
taccagttgccgtacgtcctcggctctgcgcaccagggctgcctccctcc
gttcccggcggacgtgttcatgattccgcagtacggctacctaacgctca
acaatggcagccaggcagtgggacggtcatcctttactgcctggaatat
ttcccatcgcagatgctgagaacgggcaataacttttaccttcagctacac
cttcgaggacgtgcctttccacagcagctacgcgcacagccagagcctgg
accggctgatgaatcctctcatcgaccagtacctgtattacctgaacaga
actcagaatcagtccggaagtgcccaaaacaaggacttgctgtttagccg
ggggtctccagctggcatgtctgttcagcccaaaaactgctacctggac
cctgttaccggcagcagcgcgtttctaaaacaaaaacagacaacaacaac
agcaactttacctggactggtgcttcaaaatataaccttaatgggcgtga
atctataatcaaccctggcactgctatggcctcacacaaagacgacaaag
acaagttctttcccatgagcggtgtcatgatttttggaaaggagagcgcc
ggagcttcaaacactgcattggacaatgtcatgatcacagacgaagagga
aatcaaagccactaaccccgtggccaccgaaagatttgggactgtggcag
tcaatctccagagcagcagcacagaccctgcgaccggagatgtgcatgtt
atgggagccttacctggaatggtgtggcaagacagagacgtatacctgca
gggtcctatttgggccaaaattcctcacacggatggacacttcaccccgt
ctcctctcatgggcggctttggacttaagcacccgcctcctcagatcctc
atcaaaaacacgcctgttcctgcgaatcctccggcagagttttcggctac
aaagtttgcttcattcatcacccagtattccacaggacaagtgagcgtgg
agattgaatgggagctgcagaaagaaaacagcaaacgctggaatcccgaa
gtgcagtatacatctaactatgcaaaatctgccaacgttgatttcactgt
ggacaacaatggactttatactgagcctcgccccattggcacccgttacc
tcacccgtccctgtaattgtgtgttaatcaataaaccggt |

In some cases, a modification can be of an AAV serotype 6 capsid. In some cases a subject variant AAV capsid protein (or the variant AAV capsid protein encoded by a subject amino acid) can comprise homology to any one of of the protein or nucleic acid sequences of Table 5 from about 10%, 15%, 20%, 25%, 30%, 35%, 40%, 45%, 50%, 55%, 60%, 65%, 70%, 75%, 80%, 85% 90%, 91%, 92%, 93%, 94%, 95%, 96%, 97%, 98%, 99% or up to 100%.

TABLE 5

AAV control and chimera alternative reading frames (AAP)

| SEQ ID NO | Construct | Protein sequence | SEQ ID NO | Nucleic acid sequence |
|---|---|---|---|---|
| 46 | AAV6 | LATQSQSPTHNLSENLQQPPL LWDLLQWLQAVAHQWQTITKA PTEWVMPQEIGIAIPHGWATE SSPPAPEHGPCPPITTTSTSK SPVLQRGPATTTTTSATAPPG GILISTDSTAISHHVTGSDSS TTIGDSGPRDSTSSSSTSKSR RSRRMMASRPSLITLPARFKS SRTRSTSCRTSSALRTRAASL RSRRTCS | 298 | CTGGCGACTCAGAGTCAGTC CCCGACCCACAACCTCTCGG AGAACCTCCAGCAACCCCCG CTGCTGTGGGACCTACTACA ATGGCTTCAGGCGGTGGCGC ACCAATGGCAGACAATAACG AAGGCGCCGACGGAGTGGGT AATGCCTCAGGAAATTGGCA TTGCGATTCCACATGGCTGG GCGACAGAGTCATCACCACC |

TABLE 5-continued

AAV control and chimera alternative reading frames (AAP)

| SEQ ID NO | Construct | Protein sequence | SEQ ID NO | Nucleic acid sequence |
|---|---|---|---|---|
| | | | | AGCACCCGAACATGGGCCTT GCCCACCTATAACAACCACC TCTACAAGCAAATCTCCAGT GCTTCAACGGGGGCCAGCAA CGACAACCACTACTTCGGCT ACAGCACCCCTGGGGGTAT TTTGATTTCAACAGATTCCA CTGCCATTTCTCACCACGTG ACTGGCAGCGACTCATCAAC AACAATTGGGGATTCCGGCC CAAGAGACTCAACTTCAAGC TCTTCAACATCCAAGTCAAG GAGGTCACGACGAATGATGG CGTCACGACCATCGCTAATA ACCTTACCAGCACGGTTCAA GTCTTCTCGGACTCGGAGTA CCAGTTGCCGTACGTCCTCG GCTCTGCGCACCAGGGCTGC CTCCCTCCGTTCCCGGCGGA CGTGTTCATGA |
| 47 | AAV4 | LNPPSSPTPPRVSAKKASSRL KRSSFSKTKLEQATDPLRDQL PEPCLMTVRCVQQLAELQSRA DKVPMEWVMPRVIGIAIPPGL RATSRPPAPEPGSCPPTTTTS TSDSERACSPTPTTDSPPPGD TLTSTASTATSHHVTGSDSST TTGACDPKPCGSKSSTSRSRR SRRRTARQRWLITLPARFRSL RTRRTNCRT | 299 | TTGAATCCCCCCAGCAGCCC GACTCCTCCACGGGTATCGG CAAAAAAGGCAAGCAGCCGG CTAAAAAGAAGCTCGTTTTC GAAGACGAAACTGGAGCAGG CGACGGACCCCCTGAGGGAT CAACTTCCGGAGCCATGTCT GATGACAGTGAGATGCGTGC AGCAGCTGGCGGAGCTGCAG TCGAGGGCGGACAAGGTGCC GATGGAGTGGGTAATGCCTC GGGTGATTGGCATTGCGATT CCACCTGGTCTGAGGGCCAC GTCACGACCACCAGCACCAG AACCTGGGTCTTGCCCACCT ACAACAACCACCTCTACAAG CGACTCGGAGAGAGCCTGCA GTCCAACACCTACAACGGAT TCTCCACCCCCTGGGGATAC TTTGACTTCAACCGCTTCCA CTGCCACTTCTCACCACGTG ACTGGCAGCGACTCATCAAC AACAACTGGGGCATGCGACC CAAAGCCATGCGGGTCAAAA TCTTCAACATCCAGGTCAAG GAGGTCACGACGTCGAACGG CGAGACAACGGTGGCTAATA ACCTTACCAGCACGGTTCAG ATCTTTGCGGACTCGTCGTA CGAACTGCCGTACGTGA |
| 48 | AAV5 | TTTFQKERRLGPKRTPSLPPR QTPKLDPADPSSCKSQPNQPQ VWELIQCLREVAAHWATITKV PMEWAMPREIGIAIPRGWGTE SSPSPPEPGCCPATTTTSTER SKAAPSTEATPTPTLDTAPPG GTLTLTASTATGAPETGKDSS TTTGASDPGPSESKSSTFKSK RSRCRTPPPPSPTTSPPPSKC LRTTTTSCPTSSATGPRDACR PSLRRSLRCRSTVTRR | 300 | ACGACCACTTTCCAAAAAGA AAGAAGGCTCGGACCGAAGA GGACTCCAAGCCTTCCACCT CGTCAGACGCCGAAGCTGGA CCCAGCGGATCCCAGCAGCT GCAAATCCCAGCCCAACCAG CCTCAAGTTTGGGAGCTGAT ACAATGTCTGCGGGAGGTGG CGGCCCATTGGGCGACAATA ACCAAGGTGCCGATGGAGTG GGCAATGCCTCGGGAGATTG GCATTGCGATTCCACGTGGA TGGGGGACAGAGTCGTCACC AAGTCCACCCGAACCTGGGT GCTGCCCAGCTACAACAACC ACCAGTACCGAGAGATCAAA AGCGGCTCCGTCGACGGAAG CAACGCCAACGCCTACTTTG GATACAGCACCCCCTGGGGG TACTTTGACTTTAACCGCTT CCACAGCCACTGGAGCCCCC GAGACTGGAAAGACTCATC AACAACTACTGGGGCTTCAG |

TABLE 5-continued

AAV control and chimera alternative reading frames (AAP)

| SEQ ID NO | Construct | Protein sequence | SEQ ID NO | Nucleic acid sequence |
|---|---|---|---|---|
| | | | | ACCCCGGTCCCTCAGAGTCAAAATCTTCAACATTCAAGTCAAAGAGGTCACGGTGCAGGACTCCACCACCACCATCGCCAACAACCTCACCTCCACCGTCCAAGTGTTTACGGACGACGACTACCAGCTGCCCTACGTCGTCGGCAACGGGACCGAGGGATGCCTGCCGGCCTTCCCTCCGCAGGTCTTTACGCTGCCGCAGTACGGTTACGCGACGCTGA |
| 49 | AAV11 | SHHKSPTPPRASAKKANNQPERGSTLKRTLEPETDPLKDQIPAPCLQTLKCVQHRAEMLSMRDKVPMEWVMPRVIGIAIPPGLRARSQQPRPEPGSCPPTTTTCTCVSEQHQAATPTTDSPPPGDILTSTDSTVTSHHVTGKDSSTTTGDYDQKPCALKSSISKLRRSQRRTARLRSLITLPARFRYLRTRRMSSRT | 301 | AGTCACCACAAGAGCCCGACTCCTCCTCGGGCATCGGCAAAAAAGGCAAACAACCAGCCAGAAAGAGGCTCAACTTTGAAGAGGACACTGGAGCCGGAGACGGACCCCCTGAAGGATCAGATACCAGCGCCATGTCTTCAGACATTGAAATGCGTGCAGCACCGGGCGGAAATGCTGTCGATGCGGGACAAGGTTCCGATGGAGTGGGTAATGCCTCGGGTGATTGGCATTGCGATTCCACCTGGTCTGAGGGCAAGGTCACAACAACCTCGACCAGAACCTGGGTCTTGCCCACCTACAACAACCACTTGTACCTGCGTCTCGGAACAACATCAAGCAGCAACACCTACAACGGATTCTCCACCCCCTGGGGATATTTTGACTTCAACAGATTCCACTGTCACTTCTCACCACGTGACTGGCAAAGACTCATCAACAACAACTGGGGACTACGACCAAAAGCCATGCGCGTTAAAATCTTCAATATCCAAGTTAAGGAGGTCACAACGTCGAACGGCGAGACTACGGTCGCTAATAACCTTACCAGCACGGTTCAGATATTTGCGGACTCGTCGTATGAGCTCCCGTACGTGA |
| 50 | AAV12 | KRLQIGRPTRTLGRPRPRKSKKTANQPTLLEGHSTLKTLEQETDPLRDHLPEKCLMMLRCVRRQAEMLSRRDKVPMEWVMPPVIGIAIPPGQRAESPPPAPEPGSYPRTTTTCTCESEQRPTATPTTDSPPPGDTLTLTASTATFPHATGSDSSTTTGDSGRNRCVLKSSTYRSRRSRRQTARLRSLITLPARFRSLRIRRMNSHT | 302 | AAAAGACTCCAAATCGGCCGACCAACCCGGACTCTGGGAAGGCCCCGGCCAAGAAAAAGCAAAAAGACGGCGAACCAGCCGACTCTGCTAGAAGGACACTCGACTTTGAAGACTCTGGAGCAGGAGACGGACCCCCTGAGGGATCATCTTCCGGAGAAATGTCTCATGATGCTGAGATGCGTGCGGCGCCAGGCGGAAATGCTGTCGAGGCGGGACAAGGTGCCGATGGAGTGGGTAATGCCTCCGGTGATTGGCATTGCGATTCCACCTGGTCAGAGGGCCGAGTCACCACCACCAGCACCCGAACCTGGGTCCTACCCACGTACAACAACCACCTGTACCTGCGAATCGGAACAACGGCCAACAGCAACACCTACAACGGATTCTCCACCCCCTGGGGATACTTTGACTTTAACCGCTTCCACTGCCACTTTTCCCCACGCGACTGGCAGCGACTCATCAACAACAACTGGGGACTCAGGCCGAAATCGATGCGTGTTAAAATCTTCAACATACAGGTCAAGGAGGTCACGACGTCAAACGGCGAGACTACGGTCGCTAATAACCTTACCAGCACGGT |

TABLE 5-continued

AAV control and chimera alternative reading frames (AAP)

| SEQ ID NO | Construct | Protein sequence | SEQ ID NO | Nucleic acid sequence |
|---|---|---|---|---|
| | | | | TCAGATCTTTGCGGATTCGACGTATGAACTCCCATACGTGA |
| 51 | AAV4VP1/ 2- AAV6VP3 Chimera 3 | LNPPSSPTPPRVSAKKASSRLKRSSFSKTKLEQATDPLRDQLPEPCLMTVRWLQAVAHQWQTITKAPTEWVMPQEIGIAIPHGWATESSPPAPEHGPCPPITTTSTSKSPVLQRGPATTTTTSATAPPGGILISTDSTAISHHVTGSDSSTTIGDSGPRDSTSSSSTSKSRRSRRMMASRPSLITLPARFKSSRTRSTSCRTSSALRTRAASLRSRRTCS | 303 | TTGAATCCCCCAGCAGCCCGACTCCTCCACGGGTATCGGCAAAAAAGGCAAGCAGCCGGCTAAAAAGAAGCTCGTTTTCGAAGACGAAACTGGAGCAGGCGACGGACCCCCTGAGGGATCAACTTCCGGAGCCATGTCTGATGACAGTGAGATGGCTTCAGGCGGTGGCGCACCAATGGCAGACAATAACGAAGGCGCCGACGGAGTGGGTAATGCCTCAGGAAATTGGCATTGCGATTCCACATGGCTGGGCGACAGAGTCATCACCACCAGCACCCGAACATGGGCCTTGCCCACCTATAACAACCACCTCTACAAGCAAATCTCCAGTGCTTCAACGGGGGCCAGCAACGACAACCACTACTTCGGCTACAGCACCCCTGGGGGTATTTTGATTTCAACAGATTCCACTGCCATTTCTCACCACGTGACTGGCAGCGACTCATCAACAACAATTGGGGATTCCGGCCCAAGAGACTCAACTTCAAGCTCTTCAACATCCAAGTCAAGGAGGTCACGACGAATGATGGCGTCACGACCATCGCTAATAACCTTACCAGCACGGTTCAAGTCTTCTCGGACTCGGAGTACCAGTTGCCGTACGTCCTCGGCTCTGCGCACCAGGGCTGCCTCCCTCCGTTCCCGGCGGACGTGTTCATGA |
| 52 | AAV5VP1_ 2- AAV6VP3 Chimera 4 | TTTFQKERRLGPKRTPSLPPRQTPKLDPADPSSCKSQPNQPQVWELIQWLQAVAHQWQTITKAPTEWVMPQEIGIAIPHGWATESSPPAPEHGPCPPITTTSTSKSPVLQRGPATTTTTSATAPPGGILISTDSTAISHHVTGSDSSTTIGDSGPRDSTSSSSTSKSRRSRRMMASRPSLITLPARFKSSRTRSTSCRTSSALRTRAASLRSRRTCS | 304 | ACGACCACTTTCCAAAAAGAAAGAAGGCTCGGACCGAAGAGGACTCCAAGCCTTCCACCTCGTCAGACGCCGAAGCTGGACCCAGCGGATCCCAGCAGCTGCAAATCCCAGCCCAACCAGCCTCAAGTTTGGGAGCTGATACAATGGCTTCAGGCGGTGGCGCACCAATGGCAGACAATAACGAAGGCGCCGACGGAGTGGGTAATGCCTCAGGAAATTGGCATTGCGATTCCACATGGCTGGGCGACAGAGTCATCACCACCAGCACCCGAACATGGGCCTTGCCCACCTATAACAACCACCTCTACAAGCAAATCTCCAGTGCTTCAACGGGGGCCAGCAACGACAACCACTACTTCGGCTACAGCACCCCCTGGGGGTATTTTGATTTCAACAGATTCCACTGCCATTTCTCACCACGTGACTGGCAGCGACTCATCAACAACAATTGGGGATTCCGGCCCAAGAGACTCAACTTCAAGCTCTTCAACATCCAAGTCAAGGAGGTCACGACGAATGATGGCGTCACGACCATCGCTAATAACCTTACCAGCACGGTTCAAGTCTTCTCGGACTCGGAGTACCAGTTGCCGTACGTCCTCGGCTCTGCGCACCAGGGCTGCCTCCCTCCGTTCCCGGCGGACGTGTTCATGA |
| 53 | AAV11VP1/ 2- | SHHKSPTPPRASAKKANNQPERGSTLKRTLEPETDPLKDQIP | 305 | AGTCACCACAAGAGCCCGACTCCTCCTCGGGCATCGGCAA |

TABLE 5-continued

AAV control and chimera alternative reading frames (AAP)

| SEQ ID NO | Construct | Protein sequence | SEQ ID NO | Nucleic acid sequence |
|---|---|---|---|---|
| | AAV6VP3 Chimera 5 | APCLQTLKWLQAVAHQWQTIT KAPTEWVMPQEIGIAIPHGWA TESSPPAPEHGPCPPITTTST SKSPVLQRGPATTTTSATAP PGGILISTDSTAISHHVTGSD SSTTIGDSGPRDSTSSSSTSK SRRSRRMMASRPSLITLPARF KSSRTRSTSCRTSSALRTRAA SLRSRRTCS | | AAAAGGCAAACAACCAGCCA GAAAGAGGCTCAACTTTGAA GAGGACACTGGAGCCGGAGA CGGACCCCTGAAGGATCAG ATACCAGCGCCATGTCTTCA GACATTGAAATGGCTTCAGG CGGTGGCGCACCAATGGCAG ACAATAACGAAGGCGCCGAC GGAGTGGGTAATGCCTCAGG AAATTGGCATTGCGATTCCA CATGGCTGGGCGACAGAGTC ATCACCACCAGCACCCGAAC ATGGGCCTTGCCCACCTATA ACAACCACCTCTACAAGCAA ATCTCCAGTGCTTCAACGGG GGCCAGCAACGACAACCACT ACTTCGGCTACAGCACCCCC TGGGGGTATTTTGATTTCAA CAGATTCCACTGCCATTTCT CACCACGTGACTGGCAGCGA CTCATCAACAACAATTGGGG ATTCCGGCCCAAGAGACTCA ACTTCAAGCTCTTCAACATC CAAGTCAAGGAGGTCACGAC GAATGATGGCGTCACGACCA TCGCTAATAACCTTACCAGC ACGGTTCAAGTCTTCTCGGA CTCGGAGTACCAGTTGCCGT ACGTCCTCGGCTCTGCGCAC CAGGGCTGCCTCCCTCCGTT CCCGGCGGACGTGTTCATGA |
| 54 | AAV12VP1/ 2- AAV6VP3 Chimera 6 | KRLQIGRPTRTLGRPRPRKSK KTANQPTLLEGHSTLKTLEQE TDPLRDHLPEKCLMMLRWLQA VAHQWQTITKAPTEWVMPQEI GIAIPHGWATESSPPAPEHGP CPPITTTSTSKSPVLQRGPAT TTTTSATAPPGGILISTDSTA ISHHVTGSDSSTTIGDSGPRD STSSSSTSKSRRSRRMMASRP SLITLPARFKSSRTRSTSCRT SSALRTRAASLRSRRTCS | 306 | AAAAGACTCCAAATCGG CCGACCAACCCGGACTCTGG GAAGGCCCCGGCCAAGAAAA AGCAAAAAGACGGCGAACCA GCCGACTCTGCTAGAAGGAC ACTCGACTTTGAAGACTCTG GAGCAGGAGACGGACCCCCT GAGGGATCATCTTCCGGAGA AATGTCTCATGATGCTGAGA TGGCTTCAGGCGGTGGCGCA CCAATGGCAGACAATAACGA AGGCGCCGACGGAGTGGGTA ATGCCTCAGGAAATTGGCAT TGCGATTCCACATGGCTGGG CGACAGAGTCATCACCACCA GCACCCGAACATGGGCCTTG CCCACCTATAACAACCACCT CTACAAGCAAATCTCCAGTG CTTCAACGGGGCCAGCAAC GACAACCACTACTTCGGCTA CAGCACCCCCTGGGGGTATT TTGATTTCAACAGATTCCAC TGCCATTTCTCACCACGTGA CTGGCAGCGACTCATCAACA ACAATTGGGGATTCCGGCCC AAGAGACTCAACTTCAAGCT CTTCAACATCCAAGTCAAGG AGGTCACGACGAATGATGGC GTCACGACCATCGCTAATAA CCTTACCAGCACGGTTCAAG TCTTCTCGGACTCGGAGTAC CAGTTGCCGTACGTCCTCGG CTCTGCGCACCAGGGCTGCC TCCCTCCGTTCCCGGCGGAC GTGTTCATGA |

In some cases, proteins can include AAV capsid proteins, which are encoded by the nucleotide sequences identified above. An AAV capsid can be composed of three proteins, vp1, vp2 and vp3, which can be alternative splice variants. Other desirable fragments of the capsid protein include the constant and variable regions, located between hypervariable regions (HVR). In some cases, fragments of a capsid protein include the HVR themselves.

In some aspects, an AAV vector comprising a nucleotide sequence of interest flanked by AAV ITRs can be constructed by directly inserting heterologous sequences into an AAV vector. These constructs can be designed using techniques well known in the art. See, e.g., Carter B., Adeno-associated virus vectors, Curr. Opin. Biotechnol., 3:533-539 (1992); and Kotin R M, Prospects for the use of adeno-associated virus as a vector for human gene therapy, Hum Gene Ther 5:793-801 (1994).

In some embodiments, an AAV expression vector comprises a heterologous nucleic acid sequences of interest, such as a transgene with a therapeutic effect. An AAV virion can be constructed using methods that are well known in the art. See, e.g., Koerber et al. (2009) Mol. Ther. 17:2088; Koerber et al. (2008) Mol Ther. 16:1703-1709; U.S. Pat. Nos. 7,439,065 and 6,491,907. For example, exogenous or heterologous sequence(s) can be inserted into an AAV genome wherein its major AAV open reading frames have been excised therefrom. Other portions of the AAV genome can also be deleted, which certain portions of the ITRs remain intact to support replication and packaging functions. Such constructs can be designed using techniques well known in the art. See, e.g., U.S. Pat. Nos. 5,173,414 and 5,139,941; Lebkowski et al. (1988) Molec. Cell. Biol. 8:3988-3996.

Disclosed herein can be a method of generating a variant AAV capsid protein from a WT capsid protein, the method comprising: subjecting a nucleic acid that comprises a nucleotide sequence encoding a WT capsid protein to a type of mutagenesis selected from the group consisting of: polymerase chain reaction mutagenesis, oligonucleotide-directed mutagenesis, saturation mutagenesis, loop-swapping mutagenesis, fragment shuffling mutagenesis, and a combination thereof. In some cases, a screen can be performed to isolate highly effective mutated AAV from a plurality of mutated AAVs. For example a screen can include a flow cytometry assay to determine a mutated or chimeric AAV that is able to transduce a primary cell at a greater efficiency as compared to a WT AAV. A mutated or chimeric AAV capsid protein (or any variant AAV capsid protein encoded by a subject nucleic acid) can be said to confer to an infectious AAV virion an increased transduction of mammalian cells compared to the transduction exhibited by a wild type AAV (e.g., AAV6 (wild type AAV serotype 6)) or an AAV comprising a wild-type capsid protein. In some cases, the increased transduction is at least about 1.5-fold (e.g., at least about 1.5-fold, at least about 2-fold, at least about 3-fold, at least about 4-fold, at least about 5-fold, at least about 7.5-fold, at least about 10-fold, at least about 12-fold, at least about 15-fold, at least about 17-fold, at least about 20-fold, at least about 25-fold, at least about 30-fold, at least about 40-fold, at least about 50-fold, at least about 75-fold, at least about 100-fold, at least about 150-fold, at least about 200-fold, at least about 250-fold, at least about 300-fold, etc.) greater than the transduction exhibited by a wild type AAV (e.g., AAV6 (wild type AAV serotype 6)) or an AAV comprising a wild-type capsid protein. In some cases, the increased transduction is at least about 5%, 10%, 15%, 20%, 25%, 30%, 35%, 40%, 45%, 50%, 55%, 60%, 65%, 70%, 75%, 80%, 85%, 90%, 95% or up to about 100% greater than the transduction exhibited by a wild type AAV (e.g., AAV6 (wild type AAV serotype 6)) or an AAV comprising a wild-type capsid protein as measured by the detection of a transgene by flow cytometry. In some cases, an increased transfection can be at least about 5%, 10%, 15%, 20%, 25%, 30%, 35%, 40%, 45%, 50%, 55%, 60%, 65%, 70%, 75%, 80%, 85%, 90%, 95% or up to about 100% greater than the transfection exhibited by a wild type AAV (e.g., AAV6 (wild type AAV serotype 6)) or an AAV comprising a wild-type capsid protein as measured by the detection of a transgene by flow cytometry. Transduction and transfection can be detected on a producer cell, such as a 293T cell, or in a primary cell, such as a lymphocyte (e.g., a tumor infiltrating lymphocyte). In some cases, the increased transduction or transfection is at least about 5%-10%, 15%-20%, 25%-30%, 35%-40%, 45%-50%, 55%-60%, 65%-70%, 75%-80%, 85%-90%, 95% or up to about 100% greater than the transduction exhibited by a wild type AAV (e.g., AAV6 (wild type AAV serotype 6)) or an AAV comprising a wild-type capsid protein as measured by the detection of a transgene by flow cytometry. Transfection or transduction efficiency can be detected by an in vitro assay such as PCR, qPCR, intracellular staining, flow cytometry, quantitative western blotting, and ELISA, to name a few.

In some cases, a subject variant AAV capsid protein (or the variant AAV capsid protein encoded by a subject nucleic acid) exhibits decreased binding to a neutralizing antibody that binds a wild-type AAV capsid protein. For example, a subject variant AAV capsid protein can exhibit at least about 1.5-fold (e.g., at least about 1.5-fold, at least about 2-fold, at least about 3-fold, at least about 4-fold, at least about 5-fold, at least about 7.5-fold, at least about 10-fold, at least about 12-fold, at least about 15-fold, at least about 17-fold, at least about 20-fold, at least about 25-fold, at least about 30-fold, at least about 40-fold, at least about 50-fold, at least about 75-fold, at least about 100-fold, at least about 150-fold, at least about 200-fold, at least about 250-fold, at least about 300-fold, etc.) reduced binding (e.g., reduced affinity) to a neutralizing antibody that binds a wild-type capsid AAV protein, compared to the binding affinity of the antibody to wild-type AAV capsid protein. Methods for Producing modified AAVs The present application provides methods and materials for producing recombinant AAVs that can express one or more proteins of interest in a cell. As described herein, the methods and materials disclosed herein allow for high production or production of the proteins of interest at levels that would achieve a therapeutic effect in vivo. An example of a protein of interest is an exogenous receptor. An exogenous receptor can be a TCR.

To general AAV virions or viral particles, an AAV expression vector is introduced into a suitable host cell using known techniques, such as by transfection. Transfection techniques are known in the art. See, e.g., Graham et al. (1973) Virology, 52:456, Sambrook et al. (1989) Molecular Cloning, A Laboratory Manual, Cold Spring Harbor Laboratories, New York, Davis et al. (1986) Basic Methods in Molecular Biology, Elsevier, and Chu et al. (1981) Gene 13:197. Suitable transfection methods include calcium phosphate co-precipitation, direct micro-injection, electroporation, liposome mediated gene transfer, and nucleic acid delivery using high-velocity microprojectiles, which are known in the art.

In some cases, methods for producing a recombinant AAV include providing a packaging cell line with a viral construct comprising a 5' inverted terminal repeat (ITR) of AAV and a 3' AAV ITR, such as described herein, helper functions for generating a productive AAV infection, and AAV cap genes; and recovering a recombinant AAV from the supernatant of the packaging cell line. Various types of cells can be used as the packaging cell line. For example, packaging cell lines that can be used include, but are not limited to, HEK 293 cells, HeLa cells, and Vero cells to name a few. In some cases, supernatant of the packaging cell line is treated by PEG precipitation for concentrating the virus. In other cases, a centrifugation step can be used to concentrate a virus. For example a column can be used to concentration a virus during a centrifugation. In some embodiments, a precipitation occurs at no more than about 4° C. (for example about 3° C., about 2° C., about 1° C., or about 1° C.) for at least about 2 hours, at least about 3 hours, at least about 4 hours, at least about 6 hours, at least about 9 hours, at least about 12 hours, or at least about 24 hours. In some embodiments, the recombinant AAV is isolated from the PEG-precipitated supernatant by low-speed centrifugation followed by CsCl gradient. The low-speed centrifugation can be to can be about 4000 rpm, about 4500 rpm, about 5000 rpm, or about 6000 rpm for about 20 minutes, about 30 minutes, about 40 minutes, about 50 minutes or about 60 minutes. In some cases, recombinant AAV is isolated from the PEG-precipitated supernatant by centrifugation at about 5000 rpm for about 30 minutes followed by CsCl gradient. In some cases CsCl purification can be replaced with IDX gradient ultracentrifugation. Supernatant can be collected at about 12 hours, about 24 hours, about 36 hours, about 48 hours, about 72 hours, about 96 hours, about 120 hours, or a time between any of these two time points after a transfection. Supernatant can also be purified, concentrated, or a combination thereof. For example, a concentration or viral titer can be determined by qPCR or silver stain. A viral titer can be from about $10^2$ vp/mL, $10^3$ vp/mL, $10^4$ vp/mL, $10^5$ vp/mL, $10^6$ vp/mL, $10^7$ vp/mL, $10^8$ vp/mL, or up to about $10^9$ vp/mL. A viral titer can be from about $10^2$ GC/mL, $10^3$ GC/mL, $10^4$ GC/mL, $10^5$ GC/mL, $10^6$ GC/mL, $10^7$ GC/mL, $10^8$ GC/mL, or up to about $10^9$ GC/mL. In some cases, a viral titer can be from about $10^2$ TU/mL, $10^3$ TU/mL, $10^4$ TU/mL, $10^5$ TU/mL, $10^6$ TU/mL, $10^7$ TU/mL, $10^8$ TU/mL, or up to about $10^9$ TU/mL. An optimal viral titer can vary depending on cell type to be transduced. A range of virus can be from about 1000 MOI to 2000 MOI, from 1500 MOI to 2500 MOI, from 2000 MOI to 3000 MOI, from 3000 MOI to 4000 MOI, from 4000 MOI to 5000 MOI, from 5000 MOI to 6000 MOI, from 6000 MOI to 7000M01, from 7000 MOI to 8000 MOI, from 8000 MOI to 9000 MOI, from 9000 MOI to 10,000 MOI. For example, to infect 1 million cells using an MOI of 10,000, one will need $10,000 \times 1,000,000 = 10^{10}$ GC.

Introduction of plasmids or viruses into a host cell can also be accomplished using techniques known to the skilled artisan and as discussed throughout the specification. In some cases, standard transfection techniques are used, e.g., $CaPO_4$ transfection or electroporation, and/or infection by hybrid adenovirus/AAV vectors into cell lines such as the human embryonic kidney cell line HEK 293 (a human kidney cell line containing functional adenovirus E1 genes which provides trans-acting E1 proteins). One of skill in the art will readily understand that the novel AAV sequences of the invention can be readily adapted for use in these and other viral vector systems for in vitro, ex vivo or in vivo gene delivery. Similarly, one of skill in the art can readily select other fragments of the AAV genome of the invention for use in a variety of AAV and non-AAV vector systems. Such vectors systems can include, e.g., lentiviruses, retroviruses, poxviruses, vaccinia viruses, and adenoviral systems, among others. Selection of these vector systems is not a limitation of the present invention.

In some embodiments, helper functions are provided by one or more helper plasmids or helper viruses comprising adenoviral helper genes. Non-limiting examples of the adenoviral helper genes include E1A, E1B, E2A, E4 and VA, which can provide helper functions to AAV packaging. In some cases, an AAV cap gene can be present in a plasmid. A plasmid can further comprise an AAV rep gene.

Serology can be defined as the inability of an antibody that is reactive to the viral capsid proteins of one serotype in neutralizing those of another serotype. In some cases, a cap gene and/or rep gene from any AAV serotype (including, but not limited to, AAV1, AAV2, AAV3, AAV4, AAV5, AAV6, AAV7, AAV8, AAV9, AAV10, AAV11, AAV12, and any variant or derivative thereof) can be used herein to produce the recombinant AAV disclosed herein to express one or more proteins of interest. An adeno-associated virus can be AAV5 or AAV6 or a variant thereof. In some cases, an AAV cap gene can encode a capsid from serotype 1, serotype 2, serotype 3, serotype 4, serotype 5, serotype 6, serotype 7, serotype 8, serotype 9, serotype 10, serotype 11, serotype 12, or a variant thereof. In some embodiments, a packaging cell line can be transfected with the helper plasmid or helper virus, the viral construct and the plasmid encoding the AAV cap genes; and the recombinant AAV virus can be collected at various time points after co-transfection. For example, the recombinant AAV virus can be collected at about 12 hours, about 24 hours, about 36 hours, about 48 hours, about 72 hours, about 96 hours, about 120 hours, or a time between any of these two time points after the co-transfection.

In some cases, a modification can be of an AAV serotype 6 capsid. In some cases a subject variant AAV capsid protein (or the variant AAV capsid protein encoded by a subject nucleic acid) can be compared to a WT AAV, such as AAV6, that can comprise homology to SEQ ID NO: 55 from about 10%, 15%, 20%, 25%, 30%, 35%, 40%, 45%, 50%, 55%, 60%, 65%, 70%, 75%, 80%, 85% 90%, 91%, 92%, 93%, 94%, 95%, 96%, 97%, 98%, 99% or up to 100%.

TABLE 6

WT AAV6 Capsid

| SEQ ID NO | Nucleotide sequence |
|---|---|
| 55 | atggctgccgatggttatcttccagattggctcgaggacaacctctctgagggcattcg<br>cgagtggtgggacttgaaacctggagccccgaaacccaaagccaaccagcaaaagcagg<br>acgacggccgggtctggtgcttcctggctacaagtacctcggacccttcaacggactc<br>gacaaggggagcccgtcaacgcggcggatgcagcggccctcgagcacgacaaggccta<br>cgaccagcagctcaaagcgggtgacaatccgtacctgcggtataaccacgccgacgccg<br>agtttcaggagcgtctgcaagaagatacgtcttttgggggcaacctcgggcgagcagtc<br>ttccaggccaagaagagggttctcgaaccttttggtctggttgaggaaggtgctaagac<br>ggctcctggaaagaaacgtccggtagagcagtcgccacaagagccagactcctcctcgg<br>gcattggcaagacaggccagcagcccgctaaaaagagactcaattttggtcagactggc<br>gactcagagtcagtccccgacccacaacctctcggagaacctccagcaaccccgctgc<br>tgtgggacctactacaatggcttcaggcggtggcgcaccaatggcagacaataacgaag<br>gcgccgacggagtgggtaatgcctcaggaaattggcattgcgattccacatggctgggc<br>gacagagtcatcaccaccagcacccgaacatgggccttgcccacctataacaaccacct<br>ctacaagcaaatctccagtgcttcaacggggggccagcaacgacaaccactacttcggct |

TABLE 6-continued

WT AAV6 Capsid

| SEQ ID NO | Nucleotide sequence |
|---|---|
| | acagcaccccctgggggtattttgatttcaacagattccactgccatttctcaccacgt<br>gactggcagcgactcatcaacaacaattggggattccggcccaagagactcaacttcaa<br>gctcttcaacatccaagtcaaggaggtcacgacgaatgatggcgtcacgaccatcgcta<br>ataaccttaccagcacggttcaagtcttctcggactcggagtaccagttgccgtacgtc<br>ctcggctctgcgcaccagggctgcctcctccgttcccggcggacgtgttcatgattcc<br>gcagtacggctacctaacgctcaacaatggcagccaggcagtgggacggtcatccttt<br>actgcctggaatatttcccatcgcagatgctgagaacgggcaataactttaccttcagc<br>tacaccttcgaggacgtgcctttccacagcagctacgcgcacagcgcagagcctggaccg<br>gctgatgaatcctctcatcgaccagtacctgtattacctgaacagaactcagaatcagt<br>ccggaagtgcccaaaacaaggacttgctgtttagccgggggtctccagctggcatgtct<br>gttcagcccaaaaactggctacctggaccctgttaccggcagcagcgcgtttctaaaac<br>aaaaacagacaacaacaacagcaactttacctggactggtgcttcaaaatataaccta<br>atgggcgtgaatctataatcaaccctggcactgctatggcctcacacaaagacgacaaa<br>gacaagttctttcccatgagcggtgtcatgattttggaaaggagagcgccggagcttc<br>aaacactgcattggacaatgtcatgatcacagacgaagaggaaatcaaagccactaacc<br>ccgtggccaccgaaagatttgggactgtggcagtcaatctccagagcagcagcacagac<br>cctgcgaccggagatgtgcatgttatgggagccttacctggaatggtgtggcaagacag<br>agacgtatacctgcagggtcctatttgggccaaaattcctcacacggatggacactttc<br>acccgtctcctctcatgggcggctttggacttaagcaccgcctcctcagatcctcatc<br>aaaaacacgcctgttcctgcgaatcctccggcagagttttcggctacaaagtttgcttc<br>attcatcacccagtattccacaggacaagtgagcgtggagattgaatgggagctgcaga<br>aagaaaacagcaaacgctggaatcccgaagtgcagtatacatctaactatgcaaaatct<br>gccaacgttgatttcactgtggacaacaatggactttatactgagcctcgcccattgg<br>cacccgttacctcacccgtccctgtaa |

In some cases, a method of screening a plurality of engineered adeno associated viral (AAV) particles can comprise: introducing at least one of a mutation or exogenous AAV genome to a genome of an adeno-associated virus (AAV) nucleotide sequence to form engineered AAV particles. In some cases, engineered AAV particles are then introduced to a plurality of cellular genomes. A screen can comprise comparing a level of expression of a transgene encoded by a plurality of AAV particles in a plurality of cellular genomes in different mutation or chimeric AAV variants. In some cases, a level of expression of a transgene is quantified. In other cases, a level of cell death in a transduced cellular population of quantified. In other cases, a level of persistence of a transgene in a cellular population is quantified.

In some cases, a screening method can involve performing a titration experiment of a viral supernatant. For example, cells can be transduced using AAV supernatant from modified AAV viruses, mutated or chimeric; to determine a degree of infectivity of viral particles from modified AAV viruses. For example, an MOI can be titrated from $1 \times 10^6$ GC/mL to 200 GC/mL. An output such as expression of a transgene on a transduced cell can be quantified to determine a mutant or chimera that can be selected.

Helper viruses of AAV are known in the art and include, for example, viruses from the family Adenoviridae and the family Herpesviridae. Examples of helper viruses of AAV include, but are not limited to, SAdV-13 helper virus and SAdV-13-like helper virus described in US Publication No. 20110201088, helper vectors pHELP (Applied Viromics). A skilled artisan will appreciate that any helper virus or helper plasmid of AAV that can provide adequate helper function to AAV can be used herein. The recombinant AAV viruses disclosed herein can also be produced using any convention methods known in the art suitable for producing infectious recombinant AAV. In some instances, a recombinant AAV can be produced by using a cell line that stably expresses some of the necessary components for AAV particle production. For example, a plasmid (or multiple plasmids) comprising AAV rep and cap genes, and a selectable marker, such as a neomycin resistance gene, can be integrated into the genome of a cell (the packaging cells). The packaging cell line can then be co-infected with a helper virus (e.g., adenovirus providing the helper functions) and the viral vector comprising the 5' and 3' AAV ITR and the nucleotide sequence encoding the protein(s) of interest. In another non-limiting example, adenovirus or baculovirus rather than plasmids can be used to introduce rep and cap genes into packaging cells. As yet another non-limiting example, both the viral vector containing the 5' and 3' AAV ITRs and the rep-cap genes can be stably integrated into the DNA of producer cells, and the helper functions can be provided by a wild-type adenovirus to produce the recombinant AAV.

In some cases, a packaging plasmid can contain all the necessary viral proteins on one plasmid to enable packing of an ITR-flanked donor template into replication-incompetent virus particles.

Suitable host cells that can be used to produce AAV virions or viral particles include yeast cells, insect cells, microorganisms, and mammalian cells. Various stable human cell lines can be used, including, but not limited to, 293 cells. Host cells can be engineered to provide helper functions in order to replicate and encapsidate nucleotide sequences flanked by AAV ITRs to produce viral particles or AAV virions. AAV helper functions can be provided by AAV-derived coding sequences that are expressed in host cells to provide AAV gene products in trans for AAV replication and packaging. AAV virus can be made replication competent or replication deficient. In general, a replication-deficient AAV virus lacks one or more AAV packaging genes. Cells can be contacted with viral vectors, viral particles, or virus as described herein in vitro, ex vivo, or in vivo. In some embodiments, cells that are contacted in vitro can be derived from established cell lines or primary cells derived from a subject, either modified ex vivo for return to the subject, or allowed to grow in culture in vitro. In some aspects, a virus is used to deliver a viral vector into primary cells ex vivo to modify the cells, such as introducing an exogenous nucleic acid sequence, a transgene, or an engineered cell receptor in an immune cell, or a T cell in particular, followed by expansion, selection, or limited number of passages in culture before such modified cells are returned back to the subject. In some aspects, such modified cells are used in cell-based therapy to treat a disease or condition, including cancer.

In some cases, an engineered AAV is not a self-complementary AAV (scAAV). Any conventional methods suitable for purifying AAV can be used in the embodiments described herein to purify the recombinant AAV. For example, the recombinant can be isolated and purified from packaging cells and/or the supernatant of the packaging cells. In some embodiments, the AAV can be purified by separation method using a CsCl gradient. Also, US Patent Publication No. 20020136710 describes another non-limiting example of method for purifying AAV, in which AAV was isolated and purified from a sample using a solid support that includes a matrix to which an artificial receptor or receptor-like molecule that mediates AAV attachment is immobilized.

In some cases, a population of cells can be transduced with a viral vector, an AAV for example A transduction with a virus can occur before a genomic disruption with a CRISPR system or after a genomic disruption with a CRISPR system. For example, a genomic disruption with a CRISPR system can facilitate integration of an exogenous polynucleic acid into a portion of a genome. In some cases, a CRISPR system can be used to introduce a double strand break in a portion of a genome comprising a gene, such as an immune checkpoint gene or a safe harbor gene or portion thereof. A double strand break can be repaired by introducing an exogenous receptor sequence delivered to a cell by a viral vector, an AAV in some cases. An AAV can comprise a polynucleic acid with recombination arms to a portion of a gene disrupted by a CRISPR system. For example, a CRISPR system can introduce a double strand break at a CISH gene. A CISH gene can then be repaired by introduction of a transgene encoding an exogenous TCR, wherein a transgene can be flanked by recombination arms with regions complementary to a portion of a genome previously disrupted by a CRISPR system. A population of cells comprising a genomic disruption and a viral introduction can be transduced. A transduced population of cells can be from about 5% to about 100%.

One or more transgenes of the methods described herein can be inserted randomly into the genome of a cell. These transgenes can be functional if inserted anywhere in a genome. For instance, a transgene can encode its own promoter or can be inserted into a position where it is under the control of an endogenous promoter. Alternatively, a transgene can be inserted into a gene, such as an intron of a gene, an exon of a gene, a promoter, or a non-coding region.

A nucleic acid, e.g., RNA, encoding a transgene sequences can be randomly inserted into a chromosome of a cell. A random integration can result from any method of introducing a nucleic acid, e.g., RNA, into a cell. For example, the method can be, but is not limited to, electroporation, sonoporation, use of a gene gun, lipotransfection, calcium phosphate transfection, use of dendrimers, microinjection, and use of viral vectors including adenoviral, AAV, and retroviral vectors, and/or group II ribozymes.

An RNA encoding a transgene can also be designed to include a reporter gene so that the presence of a transgene or its expression product can be detected via activation of the reporter gene. Any reporter gene can be used, such as those disclosed above. By selecting in cell culture those cells in which a reporter gene has been activated, cells can be selected that contain a transgene.

A transgene to be inserted can be flanked by engineered sites analogous to a targeted double strand break site in the genome to excise the transgene from a polynucleic acid so it can be inserted at the double strand break region. A transgene can be virally introduced in some cases. For example, an AAV virus can be utilized to infect a cell with a transgene. Flow cytometry can be utilized to measure expression of an integrated transgene by an AAV virus. In some cases, integration of a transgene by an AAV virus does not induce cellular toxicity. In some cases, cellular viability as measured by flow cytometry of a cellular population engineered utilizing an AAV virus can be from about 30% to 100% viable. Cellular viability as measured by flow cytometry of an engineered cellular population can be from about 30%, 40%, 50%, 60%, 70%, 80%, 90%, to about 100%. In some cases, an AAV virus can introduce a transgene into the genome of a cell. An integrated transgene can be expressed by an engineered cell from immediately after genomic introduction to the duration of the life of an engineered cell. For example, an integrated transgene can be measured from about 0.1 min after introduction into a genome of a cell up, 1 hour to 5 hours, 5 hours to 10 hours, 10 hours to 20 hours, 20 hours to 1 day, 1 day to 3 days, 3 days to 5 days, 5 days to 15 days, 15 days to 30 days, 30 days to 50 days, 50 days to 100 days, or up to 1000 days after the initial introduction of a transgene into a cell. Expression of a transgene can be detected from 3 days. Expression of a transgene can be detected from 7 days. Expression of a transgene can be detected from about 4 hours, 6 hours, 8 hours, 12 hours, 18 hours, to about 24 hours after introduction of a transgene into a genome of a cell. In some cases, viral titer can influence the percent of transgene expression.

In some cases, a viral vector, such as an AAV viral vector, containing a gene of interest or a transgene as described herein can be inserted randomly into a genome of a cell following transfection of the cell by a viral particle containing the viral vector. Such random sites for insertion include genomic sites with a double strand break. Some viruses, such as retrovirus, comprise factors, such as integrase, that can result in random insertions of the viral vector.

In some cases, a modified or engineered AAV virus can be used to introduce a transgene to a cell. A modified or wildtype AAV can comprise homology arms to at least one genomic location.

An RNA encoding a transgene can be introduced into a cell via electroporation. RNA can also be introduced into a cell via lipofection, infection, or transformation. Electroporation and/or lipofection can be used to transfect primary cells. Electroporation and/or lipofection can be used to transfect primary hematopoietic cells. In some cases, RNA can be reverse transcribed within a cell into DNA. A DNA substrate can then be used in a homologous recombination reaction. A DNA can also be introduced into a cell genome without the use of homologous recombination. In some cases, a DNA can be flanked by engineered sites that are complementary to the targeted double strand break region in a genome. In some cases, a DNA can be excised from a polynucleic acid so it can be inserted at a double strand break region without homologous recombination.

Expression of a transgene can be verified by an expression assay, for example, qPCR or by measuring levels of RNA. Expression level can be indicative also of copy number. For example, if expression levels are extremely high, this can indicate that more than one copy of a transgene was integrated in a genome. Alternatively, high expression can indicate that a transgene was integrated in a highly transcribed area, for example, near a highly expressed promoter. Expression can also be verified by measuring protein levels, such as through Western blotting. In some cases, a splice acceptor assay can be used with a reporter system to measure transgene integration. For example, a splice acceptor can show expression when successfully integrated into a genome and under the control of an endogenous promoter. In some cases, a splice acceptor assay can be used with a reporter system to measure transgene integration when a transgene is introduced to a genome using an AAV system.

Inserting one or more transgenes in any of the methods disclosed herein can be site-specific. For example, one or more transgenes can be inserted adjacent to or near a promoter. In another example, one or more transgenes can be inserted adjacent to, near, or within an exon of a gene (e.g., PD-1 gene). Such insertions can be used to knock-in a transgene (e.g., cancer-specific TCR transgene) while simultaneously disrupting another gene (e.g., PD-1 gene). In another example, one or more transgenes can be inserted adjacent to, near, or within an intron of a gene. A transgene can be introduced by an AAV viral vector and integrate into a targeted genomic location. In some cases, an AAV vector can be utilized to direct insertion of a transgene into a certain location. For example in some cases, a transgene can be integrated into at least a portion of a CTLA4, PD-1, AAVS1, or CISH gene by an AAV.

Modification of a targeted locus of a cell can be produced by introducing DNA into cells, where the DNA has homology to the target locus. DNA can include a marker gene, allowing for selection of cells comprising the integrated construct. Complementary DNA in a target vector can recombine with a chromosomal DNA at a target locus. A marker gene can be flanked by complementary DNA sequences, a 3' recombination arm, and a 5' recombination arm. Multiple loci within a cell can be targeted. For example, transgenes with recombination arms specific to 1 or more target loci can be introduced at once such that multiple genomic modifications occur in a single step.

In some cases, recombination arms or homology arms to a particular genomic site can be from about 0.2 kb to about 5 kb in length. Recombination arms can be from about 0.2 kb, 0.4 kb 0.6 kb, 0.8 kb, 1.0 kb, 1.2 kb, 1.4 kb, 1.6 kb, 1.8 kb, 2.0 kb, 2.2 kb, 2.4 kb, 2.6 kb, 2.8 kb, 3.0 kb, 3.2 kb, 3.4 kb, 3.6 kb, 3.8 kb, 4.0 kb, 4.2 kb, 4.4 kb, 4.6 kb, 4.8 kb, to about 5.0 kb in length. Recombination arms can also be from about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, or up to about 200 bases or base pairs.

A variety of enzymes can catalyze insertion of foreign DNA into a host genome. For example, site-specific recombinases can be clustered into two protein families with distinct biochemical properties, namely tyrosine recombinases (in which DNA is covalently attached to a tyrosine residue) and serine recombinases (where covalent attachment occurs at a serine residue). In some cases, recombinases can comprise Cre, fC31 integrase (a serine recombinase derived from Streptomyces phage fC31), or bacteriophage derived site-specific recombinases (including Flp, lambda integrase, bacteriophage HK022 recombinase, bacteriophage R4 integrase and phage TP901-1 integrase).

Expression control sequences can also be used in constructs. For example, an expression control sequence can comprise a constitutive promoter, which is expressed in a wide variety of cell types. Tissue-specific promoters can also be used and can be used to direct expression to specific cell lineages.

Site specific gene editing can be achieved using non-viral gene editing such as CRISPR, TALEN (see U.S. patent Ser. No. 14/193,037), transposon-based, ZFN, meganuclease, or Mega-TAL, or Transposon-based system. For example, PiggyBac (see Moriarty, B. S., et al., "Modular assembly of transposon integratable multigene vectors using RecWay assembly," Nucleic Acids Research (8):e92 (2013) or sleeping beauty (see Aronovich, E. L, et al., "The Sleeping Beauty transposon system: a non-viral vector for gene therapy," Hum. Mol. Genet., 20(R1): R14-R20. (2011) transposon systems can be used.

Site specific gene editing can also be achieved without homologous recombination. An exogenous polynucleic acid can be introduced into a cell genome without the use of homologous recombination. In some cases, a transgene can be flanked by engineered sites that are complementary to a targeted double strand break region in a genome. A transgene can be excised from a polynucleic acid so it can be inserted at a double strand break region without homologous recombination.

In some embodiments where genomic integration of a transgene is desired, an exogenous or an engineered nuclease can be introduced to a cell in addition to a plasmid, a linear or circular polynucleotide, a viral or a non-viral vector comprising a transgene to facilitate integration of the transgene at a site where the nuclease cleaves the genomic DNA. Integration of the transgene into the cell's genome allows stable expression of the transgene over time. In some aspects, a viral vector can be used to introduce a promoter that is operably linked to the transgene. In other cases, a viral vector does not comprise a promoter, which requires insertion of the transgene at a target locus that comprises an endogenous promoter for expressing the inserted transgene.

In other embodiments, a viral vector comprises homology arms that direct integration of a transgene into a target genomic locus, such as the AAVS1 site or a safe harbor site. In one embodiment, a first nuclease is engineered to cleave at a specific genomic site to suppress or disable a deleterious gene, such as an oncogene, a checkpoint inhibitor gene, or a gene that is implicated in a disease or condition, such as cancer. After a double strand break is generated at such genomic locus by the nuclease, a non-viral or a viral vector (e.g., an AAV viral vector) can be introduced to allow integration of a transgene or any exogenous nucleic acid sequence with a therapeutic effect at the site of DNA cleavage or site of the double strand break generated by the nuclease. Alternatively, the transgene can be inserted at a different genomic site using methods known in the art, such as site directed insertion via homologous recombination, using homology arms comprising sequences complementary to the desired site of insertion, such as the AAVS1 site or a safe harbor locus. In some cases, a second nuclease can be provided to facilitate site specific insertion of a transgene at a different locus than the site of DNA cleavage by the first nuclease. In some embodiments, an AAV virus or an AAV viral vector can be used as a delivery system for introducing the transgene, such as a T cell receptor. Homology arms on an AAV donor can be from 500 base pairs to 2000 base pairs. For example, homology arms on an AAV donor can be from 500 bp, 600 bp, 700 bp, 800 bp, 900 bp, 1000 bp, 1100 bp, 1200 bp, 1300 bp, 1400 bp, 1500 bp, 1600 bp, 1700 bp, 1800 bp, 1900 bp, or up to 2000 bp long. Homology arm length can be 850 bp. In other cases, homology arm length can be 1040 bp. In some cases, homology arms are extended to allow for accurate integration of a donor. In other cases, homology arms are extended to improve integration of a donor. In some cases, in order to increase the length of homology arms without compromising the size of the donor polynucleic acid, an alternate part of the donor polynucleic acid can be eliminated. In some cases, a poly A tail can be reduced to allow for increased homology arm length.

Disclosed herein can be a functional AAV. A functional AAV can be an AAV characterized by the ability to produce viral particles with equivalent or greater packaging and transduction efficiency as any one of a WT AAV, such as AAV6. Function can be assessed in a pseudotyping setting with AAV6 rep and AAV6 ITRs. Thus, an altered parental AAV can be constructed using conventional techniques and the AAV vector can be considered functional if virus is produced from the parental AAV at titers of at least 50% when compared to production of a WT AAV such as AAV6. Further, the ability of AAV to transduce cells can be readily determined by one of skill in the art. For example, a parental AAV can be constructed such that it contains a marker gene which allows ready detection of virus. For example, an AAV can contain eGFP or another transgene which allows fluorescent detection. Where the AAV contains CMV-eGFP, when the virus produced from the altered parental AAV capsid is transduced into 293 cells at a multiplicity of infection of $10^4$, function is demonstrated where transduction efficiency is greater than 5% GFP fluorescence of total cells in a context where the cells were pretreated with wild-type human adenovirus type 5 at a multiplicity of infection of 20 for 2 hours.

Transgenes

In some cases, the methods disclosed herein can comprise a nucleic acid (e.g., a first nucleic acid and/or a second nucleic acid). In some cases, the nucleic acid can encode a transgene. Generally, a transgene can refer to a linear polymer comprising multiple nucleotide subunits. A transgene can comprise any number of nucleotides. In some cases, a transgene can comprise less than about 100 nucleotides. In some cases, a transgene can comprise at least about 100 nucleotides. In some cases, a transgene can comprise at least about 200 nucleotides. In some cases, a transgene can comprise at least about 300 nucleotides. In some cases, a transgene can comprise at least about 400 nucleotides. In some cases, a transgene can comprise at least about 500 nucleotides. In some cases, a transgene can comprise at least about 1000 nucleotides. In some cases, a transgene can comprise at least about 5000 nucleotides. In some cases, a transgene can comprise at least about 10,000 nucleotides. In some cases, a transgene can comprise at least about 20,000 nucleotides. In some cases, a transgene can comprise at least about 30,000 nucleotides. In some cases, a transgene can comprise at least about 40,000 nucleotides. In some cases, a transgene can comprise at least about 50,000 nucleotides. In some cases, a transgene can comprise between about 500 and about 5000 nucleotides. In some cases, a transgene can comprise between about 5000 and about 10,000 nucleotides. In any of the cases disclosed herein, the transgene can comprise DNA, RNA, or a hybrid of DNA and RNA. In some cases, the transgene can be single stranded. In some cases, the transgene can be double stranded.

Transgenes can be useful for expressing, e.g., overexpressing, endogenous genes at higher levels than without a transgenes. Additionally, transgenes can be used to express exogenous genes at a level greater than background, i.e., a cell that has not been transfected with a transgenes. Transgenes can also encompass other types of genes, for example, a dominant negative gene.

Transgenes can be placed into an organism, cell, tissue, or organ, in a manner which produces a product of a transgene. A polynucleic acid can comprise a transgene. A polynucleic acid can encode an exogenous receptor. For example, disclosed herein is a polynucleic acid comprising at least one exogenous T cell receptor (TCR) sequence flanked by at least two recombination arms having a sequence complementary to polynucleotides within a genomic sequence that is adenosine A2a receptor, CD276, V-set domain containing T cell activation inhibitor 1, B and T lymphocyte associated, cytotoxic T-lymphocyte-associated protein 4, indoleamine 2,3-dioxygenase 1, killer cell immunoglobulin-like receptor, three domains, long cytoplasmic tail, 1, lymphocyte-activation gene 3, programmed cell death 1, hepatitis A virus cellular receptor 2, V-domain immunoglobulin suppressor of T-cell activation, or natural killer cell receptor 2B4. One or more transgenes can be in combination with one or more disruptions.

Insertion of a transgene (e.g., exogenous sequence) can be used, for example, for expression of a polypeptide, correction of a mutant gene or for increased expression of a wild-type gene. A transgene is typically not identical to the genomic sequence where it is placed. A donor transgene can contain a non-homologous sequence flanked by two regions of homology to allow for efficient HDR at the location of interest. Additionally, transgene sequences can comprise a vector molecule containing sequences that are not homologous to the region of interest in cellular chromatin. A transgene can contain several, discontinuous regions of homology to cellular chromatin. For example, for targeted insertion of sequences not normally present in a region of interest, a sequence can be present in a donor nucleic acid molecule and flanked by regions of homology to sequence in the region of interest.

A transgene polynucleic acid can be DNA or RNA, single-stranded or double-stranded and can be introduced into a cell in linear or circular form. A transgene sequence(s) can be contained within a DNA mini-circle, which can be introduced into the cell in circular or linear form. If introduced in linear form, the ends of a transgene sequence can be protected (e.g., from exonucleolytic degradation) by any method. For example, one or more dideoxynucleotide residues can be added to the 3' terminus of a linear molecule and/or self-complementary oligonucleotides can be ligated to one or both ends. Additional methods for protecting exogenous polynucleotides from degradation include, but are not limited to, addition of terminal amino group(s) and the use of modified internucleotide linkages such as, for example, phosphorothioates, phosphoramidates, and O-methyl ribose or deoxyribose residues.

A polynucleotide can be introduced into a cell as part of a vector molecule having additional sequences such as, for example, replication origins, promoters and genes encoding antibiotic resistance. Moreover, transgene polynucleotides can be introduced as naked nucleic acid, as nucleic acid complexed with an agent such as a liposome or poloxamer, or can be delivered by viruses (e.g., adenovirus, AAV, herpesvirus, retrovirus, lentivirus and integrase defective lentivirus (IDLV)). A virus that can deliver a transgene can be an AAV virus.

A transgene is generally inserted so that its expression is driven by the endogenous promoter at the integration site, namely the promoter that drives expression of the endogenous gene into which a transgene is inserted (e.g., AAVS SITE (E.G. AAVS1, AAVS2, ETC.), CCR5, HPRT). A transgene can comprise a promoter and/or enhancer, for example a constitutive promoter or an inducible or tissue/cell specific promoter. A minicircle vector can encode a transgene.

Targeted insertion of non-coding nucleic acid sequence can also be achieved. Sequences encoding antisense RNAs, RNAi, shRNAs and micro RNAs (miRNAs) can also be used for targeted insertions.

A transgene can be inserted into an endogenous gene such that all, some or none of the endogenous gene is expressed. For example, a transgene as described herein can be inserted into an endogenous locus such that some (N-terminal and/or C-terminal to a transgene) or none of the endogenous sequences are expressed, for example as a fusion with a transgene. In other cases, a transgene (e.g., with or without additional coding sequences such as for the endogenous gene) is integrated into any endogenous locus, for example a safe-harbor locus. For example, a TCR transgene can be inserted into an endogenous TCR gene. A transgene can be inserted into any gene, e.g., the genes as described herein.

When endogenous sequences (endogenous or part of a transgene) are expressed with a transgene, the endogenous sequences can be full-length sequences (wild-type or mutant) or partial sequences. The endogenous sequences can be functional. Non-limiting examples of the function of these full length or partial sequences include increasing the serum half-life of the polypeptide expressed by a transgene (e.g., therapeutic gene) and/or acting as a carrier.

A T cell can comprise one or more transgenes. One or more transgenes can express a TCR alpha, beta, gamma, and/or delta chain protein recognizing and binding to at least one epitope (e.g., cancer epitope) on an antigen or bind to a mutated epitope on an antigen. A TCR can bind to a cancer neo-antigen. A TCR can be a functional TCR. A TCR can comprise only one of the alpha chain or beta chain sequences as defined herein (e.g., in combination with a further alpha chain or beta chain, respectively) or can comprise both chains. A TCR can comprise only one of the gamma chain or delta chain sequences as defined herein (e.g., in combination with a further gamma chain or delta chain, respectively) or can comprise both chains A functional TCR maintains at least substantial biological activity in the fusion protein. In the case of the alpha and/or beta chain of a TCR, this can mean that both chains remain able to form a T cell receptor (either with a non-modified alpha and/or beta chain or with another fusion protein alpha and/or beta chain) which exerts its biological function, in particular binding to the specific peptide-MHC complex of a TCR, and/or functional signal transduction upon peptide activation. In the case of the gamma and/or delta chain of a TCR, this can mean that both chains remain able to form a T cell receptor (either with a non-modified gamma and/or delta chain or with another fusion protein gamma and/or delta chain) which exerts its biological function, in particular binding to the specific peptide-MHC complex of a TCR, and/or functional signal transduction upon peptide activation. A T cell can also comprise one or more TCRs. A T cell can also comprise a single TCRs specific to more than one target.

Transgenes that can be used and are specifically contemplated can include those genes, vectors, or vector cargo that exhibit a certain identity and/or homology to genes, transgenes, or vectors disclosed herein, for example, a TCR gene. Therefore, it is contemplated that if a sequence described herein exhibits at least or at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or 100% homology (at the nucleic acid or protein level), it can be used as a transgene. A vector comprising a transgene can be described by any one of the sequences of Table 8. A vector comprising a transgene can have percent identity from about 10%, 15%, 20%, 25%, 30%, 35%, 40%, 45%, 50%, 55%, 60%, 65%, 70%, 75%, 80%, 85% 90%, 91%, 92%, 93%, 94%, 95%, 96%, 97%, 98%, 99% or up to 100% to any sequence described in Table 8. In some cases, the transgene can be functional and can enhance the performance of an engineered cell by about 10%, 15%, 20%, 25%, 30%, 35%, 40%, 45%, 50%, 55%, 60%, 65%, 70%, 75%, 80%, 85% 90%, 91%, 92%, 93%, 94%, 95%, 96%, 97%, 98%, 99% or up to 100% over that of a comparable cell that is not introduced the transgene or that receives a control transgene.

A transgene can be incorporated into a cell. For example, a transgene can be incorporated into an organism's germ line. When inserted into a cell, a transgene can be either a complementary DNA (cDNA) segment, which is a copy of messenger RNA (mRNA), or a gene itself residing in its original region of genomic DNA (with or without introns). A transgene of protein X can refer to a transgene comprising a nucleotide sequence encoding protein X. As used herein, in some cases, a transgene encoding protein X can be a transgene encoding 100% or about 100% of the amino acid sequence of protein X. In other cases, a transgene encoding protein X can be a transgene encoding at least or at least about 99%, 98%, 97%, 96%, 95%, 94%, 93%, 92%, 91%, 90%, 85%, 80%, 75%, 70%, 65%, 60%, 55%, 50%, 40%, 30%, 20%, 10%, 5%, or 1% of the amino acid sequence of protein X. Expression of a transgene can ultimately result in a functional protein, e.g., a partially, fully, or overly functional protein. As discussed above, if a partial sequence is expressed, the ultimate result can be a nonfunctional protein or a dominant negative protein. A nonfunctional protein or dominant negative protein can also compete with a functional (endogenous or exogenous) protein. A transgene can also encode RNA (e.g., mRNA, shRNA, siRNA, or microRNA). In some cases, where a transgene encodes for an mRNA, this can in turn be translated into a polypeptide (e.g., a protein). Therefore, it is contemplated that a transgene can encode for protein. A transgene can, in some instances, encode a protein or a portion of a protein. Additionally, a protein can have one or more mutations (e.g., deletion, insertion, amino acid replacement, or rearrangement) compared to a wild-type polypeptide. A protein can be a natural polypeptide or an artificial polypeptide (e.g., a recombinant polypeptide). A transgene can encode a fusion protein formed by two or more polypeptides. A T cell can comprise or can comprise about 1, 2, 3, 4, 5, 6, 7, 8, 9, 10, 11, 12, 13, 14, 15, 16, 17, 18, 19, 20, or more transgenes. For example, a T cell can comprise one or more transgene comprising a TCR gene.

A transgene (e.g., a TCR gene) can be inserted in a safe harbor locus. A safe harbor can comprise a genomic location where a transgene can integrate and function without perturbing endogenous activity. For example, one or more transgenes can be inserted into any one of HPRT, AAVS SITE (E.G. AAVS1, AAVS2, ETC.), CCR5, hROSA26, and/or any combination thereof. A transgene (e.g., TCR gene) can also be inserted in an endogenous immune checkpoint gene. An endogenous immune checkpoint gene can be stimulatory checkpoint gene or an inhibitory checkpoint gene. A transgene (e.g., TCR gene) can also be inserted in a stimulatory checkpoint gene such as CD27, CD40, CD122, OX40, GITR, CD137, CD28, or ICOS Immune checkpoint gene locations are provided using the Genome Reference Consortium Human Build 38 patch release 2 (GRCh38.p2) assembly. A transgene (e.g., TCR gene) can also be inserted in an endogenous inhibitory checkpoint gene such as A2AR, B7-H3, B7-H4, BTLA, CTLA-4, IDO, KIR, LAG3, PD-1, TIM-3, VISTA or CISH. For example, one or more transgene can be inserted into any one of CD27, CD40, CD122, OX40, GITR, CD137, CD28, ICOS, A2AR, B7-H3, B7-H4, BTLA, CTLA-4, IDO, KIR, LAG3, PD-1, TIM-3, VISTA, HPRT, AAVS SITE (E.G. AAVS1, AAVS2, ETC.), CCR5, and/or any combination thereof. A transgene can be inserted in an endogenous TCR gene. A transgene can be inserted within a coding genomic region. A transgene can also be inserted within a noncoding genomic region. A transgene can be inserted into a genome without homologous recombination. Insertion of a transgene can comprise a step of an intracellular genomic transplant. A transgene can be inserted at a PD-1 gene. In some cases, more than one guide can target an immune checkpoint. In other cases, a transgene can be integrated at a CTLA-4 gene. In other cases, a transgene can be integrated at a CTLA-4 gene and a PD-1 gene. A transgene can also be integrated into a safe harbor such as AAVS1. A transgene can be inserted into an AAV integration site. An AAV integration site can be a safe harbor in some cases. Alternative AAV integration sites can exist, such as AAVS2 on chromosome 5 or AAVS3 on chromosome 3. Additional AAV integration sites such as AAVS 2, AAVS3, AAVS4, AAVS5, AAVS6, AAVS7, AAVS8, and the like are also considered to be possible integration sites for an exogenous receptor, such as a TCR. As used herein, AAVS can refer to AAVS1 as well as related adeno-associated virus (AAVS) integration sites.

A chimeric antigen receptor can be comprised of an extracellular antigen recognition domain, a trans-membrane domain, and a signaling region that controls T cell activation. The extracellular antigen recognition domain can be derived from a murine, a humanized or fully human monoclonal antibody. Specifically, the extracellular antigen recognition domain is comprised of the variable regions of the heavy and light chains of a monoclonal antibody that is cloned in the form of single-chain variable fragments (scFv) and joined through a hinge and a transmembrane domain to an intracellular signaling molecule of the T-cell receptor (TCR) complex and at least one co-stimulatory molecule. In some cases a co-stimulatory domain is not used.

A transgene, such as a cellular receptor, can be inserted into a genome of a T cell in a random or site-specific manner, as described above. For example, a transgene can be inserted to a random locus in a genome of a T cell. These transgenes can be functional, e.g., fully functional if inserted anywhere in a genome. For instance, a transgene can encode its own promoter or can be inserted into a position where it is under the control of an endogenous promoter. Alternatively, a transgene can be inserted into a gene, such as an intron of a gene or an exon of a gene, a promoter, or a non-coding region. A transgene can be inserted such that the insertion disrupts a gene, e.g., an endogenous checkpoint. A transgene insertion can comprise an endogenous checkpoint region. A transgene insertion can be guided by recombination arms that can flank a transgene.

Expression of a transgene, such as a cellular receptor, can be controlled by one or more promoters. A promoter can be a ubiquitous, constitutive (unregulated promoter that allows for continual transcription of an associated gene), tissue-specific promoter or an inducible promoter. Expression of a transgene that is inserted adjacent to or near a promoter can be regulated. For example, a transgene can be inserted near or next to a ubiquitous promoter. Some ubiquitous promoters can be a CAGGS promoter, an hCMV promoter, a PGK promoter, an SV40 promoter, or a ROSA26 promoter.

A promoter can be endogenous or exogenous. For example, one or more transgenes can be inserted adjacent or near to an endogenous or exogenous ROSA26 promoter. Further, a promoter can be specific to a T cell. For example, one or more transgenes can be inserted adjacent or near to a porcine ROSA26 promoter. Tissue specific promoter or cell-specific promoters can be used to control the location of expression. For example, one or more transgenes can be inserted adjacent or near to a tissue-specific promoter. Tissue-specific promoters can be a FABP promoter, an Lck promoter, a CamKII promoter, a CD19 promoter, a Keratin promoter, an Albumin promoter, an aP2 promoter, an insulin promoter, an MCK promoter, a MyHC promoter, a WAP promoter, or a Col2A promoter.

Inducible promoters can be used as well. These inducible promoters can be turned on and off when desired, by adding or removing an inducing agent. It is contemplated that an inducible promoter can be, but is not limited to, a Lac, tac, trc, trp, araBAD, phoA, recA, proU, cst-1, tetA, cadA, nar, PL, cspA, T7, VHB, Mx, and/or Trex.

A cell can be engineered to knock out endogenous genes. Endogenous genes that can be knocked out can comprise immune checkpoint genes. An immune checkpoint gene can be stimulatory checkpoint gene or an inhibitory checkpoint gene. Immune checkpoint gene locations can be provided using the Genome Reference Consortium Human Build 38 patch release 2 (GRCh38.p2) assembly. A gene to be knocked out can be selected using a database. In some cases, certain endogenous genes are more amendable to genomic engineering. A database can comprise epigenetically permissive target sites. A database can be ENCODE (encyclopedia of DNA Elements)(www_genome.gov/10005107) in some cases. A databased can identify regions with open chromatin that can be more permissive to genomic engineering.

A T cell can comprise one or more disrupted genes. For example, one or more genes whose expression is disrupted can comprise any one of adenosine A2a receptor (ADORA), CD276, V-set domain containing T cell activation inhibitor 1 (VTCN1), B and T lymphocyte associated (BTLA), cytotoxic T-lymphocyte-associated protein 4 (CTLA4), indoleamine 2,3-dioxygenase 1 (IDO1), killer cell immunoglobulin-like receptor, three domains, long cytoplasmic tail, 1 (KIR3DL1), lymphocyte-activation gene 3 (LAG3), programmed cell death 1 (PD-1), hepatitis A virus cellular receptor 2 (HAVCR2), V-domain immunoglobulin suppressor of T-cell activation (VISTA), natural killer cell receptor 2B4 (CD244), cytokine inducible SH2-containing protein (CISH), hypoxanthine phosphoribosyltransferase 1 (HPRT), adeno-associated virus integration site (AAVS SITE (E.G. AAVS1, AAVS2, ETC.)), or chemokine (C—C motif) receptor 5 (gene/pseudogene) (CCR5), CD160 molecule (CD160), T-cell immunoreceptor with Ig and ITIM domains (TIGIT), CD96 molecule (CD96), cytotoxic and regulatory T-cell molecule (CRTAM), leukocyte associated immunoglobulin like receptor 1(LAIR1), sialic acid binding Ig like lectin 7 (SIGLEC7), sialic acid binding Ig like lectin 9

(SIGLEC9), tumor necrosis factor receptor superfamily member 10b (TNFRSF10B), tumor necrosis factor receptor superfamily member 10a (TNFRSF10A), caspase 8 (CASP8), caspase 10 (CASP10), caspase 3 (CASP3), caspase 6 (CASP6), caspase 7 (CASP7), Fas associated via death domain (FADD), Fas cell surface death receptor (FAS), transforming growth factor beta receptor II (TGFBRII), transforming growth factor beta receptor I (TGFBR1), SMAD family member 2 (SMAD2), SMAD family member 3 (SMAD3), SMAD family member 4 (SMAD4), SKI proto-oncogene (SKI), SKI-like proto-oncogene (SKIL), TGFB induced factor homeobox 1(TGIF1), interleukin 10 receptor subunit alpha (IL10RA), interleukin 10 receptor subunit beta (IL10RB), heme oxygenase 2 (HMOX2), interleukin 6 receptor (IL6R), interleukin 6 signal transducer (IL6ST), c-src tyrosine kinase (CSK), phosphoprotein membrane anchor with glycosphingolipid microdomains 1(PAG1), signaling threshold regulating transmembrane adaptor 1(SIT1), forkhead box P3(FOXP3), PR domain 1(PRDM1), basic leucine zipper transcription factor, ATF-like (BATF), guanylate cyclase 1, soluble, alpha 2(GUCY1A2), guanylate cyclase 1, soluble, alpha 3(GUCY1A3), guanylate cyclase 1, soluble, beta 2(GUCY1B2), guanylate cyclase 1, soluble, beta 3(GUCY1B3), cytokine inducible SH2-containing protein (CISH), or any combination thereof. In some cases an endogenous TCR can also be knocked out. For example, solely to illustrate various combinations, one or more genes whose expression is disrupted can comprise PD-1, CLTA-4, and CISH.

A T cell can comprise one or more suppressed genes. For example, one or more genes whose expression is suppressed can comprise any one of adenosine A2a receptor (ADORA), CD276, V-set domain containing T cell activation inhibitor 1 (VTCN1), B and T lymphocyte associated (BTLA), cytotoxic T-lymphocyte-associated protein 4 (CTLA4), indoleamine 2,3-dioxygenase 1 (IDOL), killer cell immunoglobulin-like receptor, three domains, long cytoplasmic tail, 1 (KIR3DL1), lymphocyte-activation gene 3 (LAG3), programmed cell death 1 (PD-1), hepatitis A virus cellular receptor 2 (HAVCR2), V-domain immunoglobulin suppressor of T-cell activation (VISTA), natural killer cell receptor 2B4 (CD244), cytokine inducible SH2-containing protein (CISH), hypoxanthine phosphoribosyltransferase 1 (HPRT), adeno-associated virus integration site (AAVS1), or chemokine (C—C motif) receptor 5 (gene/pseudogene) (CCR5), CD160 molecule (CD160), T-cell immunoreceptor with Ig and ITIM domains (TIGIT), CD96 molecule (CD96), cytotoxic and regulatory T-cell molecule (CRTAM), leukocyte associated immunoglobulin like receptor 1(LAIR1), sialic acid binding Ig like lectin 7 (SIGLEC7), sialic acid binding Ig like lectin 9 (SIGLEC9), tumor necrosis factor receptor superfamily member 10b (TNFRSF10B), tumor necrosis factor receptor superfamily member 10a (TNFRSF10A), caspase 8 (CASP8), caspase 10 (CASP10), caspase 3 (CASP3), caspase 6 (CASP6), caspase 7 (CASP7), Fas associated via death domain (FADD), Fas cell surface death receptor (FAS), transforming growth factor beta receptor II (TGFBRII), transforming growth factor beta receptor I (TGFBR1), SMAD family member 2 (SMAD2), SMAD family member 3 (SMAD3), SMAD family member 4 (SMAD4), SKI proto-oncogene (SKI), SKI-like proto-oncogene (SKIL), TGFB induced factor homeobox 1(TGIF1), interleukin 10 receptor subunit alpha (IL10RA), interleukin 10 receptor subunit beta (IL10RB), heme oxygenase 2 (HMOX2), interleukin 6 receptor (IL6R), interleukin 6 signal transducer (IL6ST), c-src tyrosine kinase (CSK), phosphoprotein membrane anchor with glycosphingolipid microdomains 1(PAG1), signaling threshold regulating transmembrane adaptor 1(SIT1), forkhead box P3(FOXP3), PR domain 1(PRDM1), basic leucine zipper transcription factor, ATF-like (BATF), guanylate cyclase 1, soluble, alpha 2(GUCY1A2), guanylate cyclase 1, soluble, alpha 3(GUCY1A3), guanylate cyclase 1, soluble, beta 2(GUCY1B2), guanylate cyclase 1, soluble, beta 3(GUCY1B3), cytokine inducible SH2-containing protein (CISH), or any combination thereof. For example, solely to illustrate various combinations, one or more genes whose expression is suppressed can comprise PD-1, CLTA-4, and CISH.

An engineered cell, such as one modified with a modified adeno-associated virus, can target an antigen. An engineered cell can also target an epitope. An antigen can be a tumor cell antigen. An epitope can be a tumor cell epitope. Such a tumor cell epitope can be derived from a wide variety of tumor antigens such as antigens from tumors resulting from mutations (neo antigens or neo epitopes), shared tumor specific antigens, differentiation antigens, and antigens over-expressed in tumors. Those antigens, for example, can be derived from alpha-actinin-4, ARTC1, BCR-ABL fusion protein (b3a2), B-RAF, CASP-5, CASP-8, beta-catenin, Cdc27, CDK4, CDKN2A, COA-1, dek-can fusion protein, EFTUD2, Elongation factor 2, ETV6-AML1 fusion protein, FLT3-ITD, FN1, GPNMB, LDLR-fucosyltransferase fusion protein, HLA-A2d, HLA-A11d, hsp70-2, KIAAO205, MART2, ME1, MUM-1f, MUM-2, MUM-3, neo-PAP, Myosin class I, NFYC, OGT, OS-9, p53, pml-RARalpha fusion protein, PRDX5, PTPRK, K-ras, N-ras, RBAF600, SIRT2, SNRPD1, SYT-SSX1- or -SSX2 fusion protein, TGF-betaRll, triosephosphate isomerase, BAGE-1, GAGE-1, 2, 8, Gage 3, 4, 5, 6, 7, GnTVf, HERV-K-MEL, KK-LC-1, KM-HN-1, LAGE-1, MAGE-A1, MAGE-A2, MAGE-A3, MAGE-A4, MAGE-A6, MAGE-A9, MAGE-A10, MAGE-A12, MAGE-C2, mucink, NA-88, NY-ESO-1/LAGE-2, SAGE, Sp17, SSX-2, SSX-4, TAG-1, TAG-2, TRAG-3, TRP2-INT2g, XAGE-1b, CEA, gp100/Pme117, Kallikrein 4, mammaglobin-A, Melan-A/MART-1, NY-BR-1, OA1, PSA, RAB38/NY-MEL-1, TRP-1/gp75, TRP-2, tyrosinase, adipophilin, AIM-2, ALDH1A1, BCLX (L), BCMA, BING-4, CPSF, cyclin D1, DKK1, ENAH (hMena), EP-CAM, EphA3, EZH2, FGF5, G250/MN/CAIX, HER-2/neu, IL13Ralpha2, intestinal carboxyl esterase, alpha fetoprotein, M-CSFT, MCSP, mdm-2, MMP-2, MUC1, p53, PBF, PRAME, PSMA, RAGE-1, RGSS, RNF43, RU2AS, secernin 1, SOX10, STEAP1, PIK3, survivin, Telomerase, VEGF, and/or WT1, just to name a few. Tumor-associated antigens can be antigens not normally expressed by the host; they can be mutated, truncated, misfolded, or otherwise abnormal manifestations of molecules normally expressed by the host; they can be identical to molecules normally expressed but expressed at abnormally high levels; or they can be expressed in a context or environment that is abnormal. Tumor-associated antigens can be, for example, proteins or protein fragments, complex carbohydrates, gangliosides, haptens, nucleic acids, other biological molecules or any combinations thereof. In some cases, a portion of an antigen or epitope of a phosphatidylinositol-4,5-bisphosphate 3-kinase (PIK3), Kirsten rat sarcoma (KRAS), or Erbb2 interacting protein (ERBB2IP) (also referred to as "MB") gene can be targeted with an engineered cell. TCR sequences specific for tumor antigens can readily be identified by sequencing, for example as descrbed in WO2017048593A1 and US20180030110.

In some cases, a target is a neo antigen or neo epitope. For example, a neo antigen can be encoded by an E805G mutation in ERBB2IP. Neo antigen and neo epitopes can be identified by whole-exome sequencing in some cases. A neo antigen and neo epitope target can be expressed by a gastrointestinal cancer cell in some cases. A neo antigen and neo epitope can be expressed on an epithelial carcinoma. In some cases, an engineered cell can target a universal antigen, such as a neoantigen or neoepitope.

An epitope can be a stromal epitope. Such an epitope can be on the stroma of the tumor microenvironment. The antigen can be a stromal antigen. Such an antigen can be on the stroma of the tumor microenvironment. Those antigens and those epitopes, for example, can be present on tumor endothelial cells, tumor vasculature, tumor fibroblasts, tumor pericytes, tumor stroma, and/or tumor mesenchymal cells, just to name a few. Those antigens, for example, can comprise CD34, MCSP, FAP, CD31, PCNA, CD117, CD40, MMP4, and/or Tenascin.

CRISPR System

Methods described herein can take advantage of a CRISPR system. There are at least five types of CRISPR systems which all incorporate RNAs and Cas proteins. Types I, III, and IV assemble a multi-Cas protein complex that is capable of cleaving nucleic acids that are complementary to the crRNA. Types I and III both require pre-crRNA processing prior to assembling the processed crRNA into the multi-Cas protein complex. Types II and V CRISPR systems comprise a single Cas protein complexed with at least one guiding RNA.

The general mechanism and recent advances of CRISPR system is discussed in Cong, L. et al., "Multiplex genome engineering using CRISPR systems," Science, 339(6121): 819-823 (2013); Fu, Y. et al., "High-frequency off-target mutagenesis induced by CRISPR-Cas nucleases in human cells," Nature Biotechnology, 31, 822-826 (2013); Chu, V T et al. "Increasing the efficiency of homology-directed repair for CRISPR-Cas9-induced precise gene editing in mammalian cells," Nature Biotechnology 33, 543-548 (2015); Shmakov, S. et al., "Discovery and functional characterization of diverse Class 2 CRISPR-Cas systems," Molecular Cell, 60, 1-13 (2015); Makarova, K S et al., "An updated evolutionary classification of CRISPR-Cas systems,", Nature Reviews Microbiology, 13, 1-15 (2015). Site-specific cleavage of a target DNA occurs at locations determined by both 1) base-pairing complementarity between the guide RNA and the target DNA (also called a protospacer) and 2) a short motif in the target DNA referred to as the protospacer adjacent motif (PAM). For example, an engineered cell can be generated using a CRISPR system, e.g., a type II CRISPR system. A Cas enzyme used in the methods disclosed herein can be Cas9, which catalyzes DNA cleavage. Enzymatic action by Cas9 derived from *Streptococcus pyogenes* or any closely related Cas9 can generate double stranded breaks at target site sequences which hybridize to 20 nucleotides of a guide sequence and that have a protospacer-adjacent motif (PAM) following the 20 nucleotides of the target sequence.

A vector can be operably linked to an enzyme-coding sequence encoding a CRISPR enzyme, such as a Cas protein (CRISPR-associated protein). Non-limiting examples of Cas proteins can include Cas1, Cas1B, Cas2, Cas3, Cas4, Cas5, Cas6, Cas7, Cas8, Cas9 (also known as Csn1 or Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpf1, c2c1, c2c3, Cas9HiFi, homologues thereof, or modified versions thereof An unmodified CRISPR enzyme can have DNA cleavage activity, such as Cas9. A CRISPR enzyme can direct cleavage of one or both strands at a target sequence, such as within a target sequence and/or within a complement of a target sequence. For example, a CRISPR enzyme can direct cleavage of one or both strands within or within about 1, 2, 3, 4, 5, 6, 7, 8, 9, 10, 15, 20, 25, 50, 100, 200, 500, or more base pairs from the first or last nucleotide of a target sequence. A vector that encodes a CRISPR enzyme that is mutated with respect to a corresponding wild-type enzyme such that the mutated CRISPR enzyme lacks the ability to cleave one or both strands of a target polynucleotide containing a target sequence can be used. A Cas protein can be a high fidelity Cas protein such as Cas9HiFi.

TABLE 7

*Streptococcus pyogenes* Cas9 (SpCas9)

| SEQ ID | Sequence 5' to 3' |
|---|---|
| 56 | atggactataaggaccacgacggagactacaaggatcatga<br>tattgattacaaagacgatgacgataagatggccccaaaga<br>agaagcggaaggtcggtatccacggagtcccagcagccgac<br>aagaagtacagcatcggcctggacatcggcaccaactctgt<br>gggctgggccgtgatcaccgacg |

Cas9 can refer to a polypeptide with at least or at least about 50%, 60%, 70%, 80%, 90%, 100% sequence identity and/or sequence similarity to a wild type exemplary Cas9 polypeptide (e.g., Cas9 from *S. pyogenes*). Cas9 can refer to a polypeptide with at most or at most about 50%, 60%, 70%, 80%, 90%, 100% sequence identity and/or sequence similarity to a wild type exemplary Cas9 polypeptide (e.g., from *S. pyogenes*). Cas9 can refer to the wild type or a modified form of the Cas9 protein that can comprise an amino acid change such as a deletion, insertion, substitution, variant, mutation, fusion, chimera, or any combination thereof. Cas9 can refer to a polypeptide with at least or at least about 50%, 60%, 70%, 80%, 90%, 91%, 92%, 93%, 94%, 95%, 96%, 97%, 98%, 99%, 100% sequence identity and/or sequence similarity to SEQ ID NO: 56. A sequence identity disclosed herein can be calculated by determining a percent identity between two sequences. For example a percent identity can be calculated by multiplying the number of matches in a sequence pair by 100 and dividing by the length of the aligned region. A variety of sequence alignment programs can be utilized for example, LALIGN, FFAS, BLAST, GeneWise, SIM, and SSEA to name a few.

A polynucleotide encoding an endonuclease (e.g., a Cas protein such as Cas9) can be codon optimized for expression in particular cells, such as eukaryotic cells. This type of optimization can entail the mutation of foreign-derived (e.g., recombinant) DNA to mimic the codon preferences of the intended host organism or cell while encoding the same protein.

An endonuclease can comprise an amino acid sequence having at least or at least about 50%, 60%, 70%, 75%, 80%, 85%, 90%, 95%, 99%, or 100%, amino acid sequence identity to the nuclease domain of a wild type exemplary site-directed polypeptide (e.g., Cas9 from *S. pyogenes*).

While *S. pyogenes* Cas9 (SpCas9), Table 7, is commonly used as a CRISPR endonuclease for genome engineering, it may not be the best endonuclease for every target excision site. For example, the PAM sequence for SpCas9 (5' NGG 3') is abundant throughout the human genome, but a NGG sequence is not always positioned correctly to target a desired gene for modification. In some cases, a different endonuclease can be used to target certain genomic targets. In some cases, synthetic SpCas9-derived variants with non-NGG PAM sequences can be used. Additionally, other Cas9 orthologues from various species have been identified and these "non-SpCas9s" bind a variety of PAM sequences that could also be useful for the present invention. For example, the relatively large size of SpCas9 (approximately 4 kb coding sequence) means that plasmids carrying the SpCas9 cDNA may not always be efficiently expressed in a cell. Conversely, the coding sequence for Staphylococcus aureus Cas9 (SaCas9) is approximately 1 kilo base shorter than SpCas9, possibly allowing it to be efficiently expressed in a cell Similar to SpCas9, the SaCas9 endonuclease is capable of modifying target genes in mammalian cells in vitro and in mice in vivo.

Alternatives to S. pyogenes Cas9 can include RNA-guided endonucleases from the Cpf1 family that display cleavage activity in mammalian cells. Unlike Cas9 nucleases, the result of Cpf1-mediated DNA cleavage is a double-strand break with a short 3' overhang. Cpf1's staggered cleavage pattern can open up the possibility of directional gene transfer, analogous to traditional restriction enzyme cloning, which can increase the efficiency of gene editing. Like the Cas9 variants and orthologues described above, Cpf1 can also expand the number of sites that can be targeted by CRISPR to AT-rich regions or AT-rich genomes that lack the NGG PAM sites favored by SpCas9.

A guide RNA (gRNA) can refer to an RNA which can be specific for a target DNA and can form a complex with a Cas protein. A guide RNA can comprise a guide sequence, or spacer sequence, that specifies a target site and guides an RNA/Cas complex to a specified target DNA for cleavage. In some cases, a guide RNA can target a CRISPR complex to three genes and perform a targeted double strand break. Site-specific cleavage of a target DNA occurs at locations determined by both 1) base-pairing complementarity between a guide RNA and a target DNA (also called a protospacer) and 2) a short motif in a target DNA referred to as a protospacer adjacent motif (PAM). Guiding polynucleic acids can be designed using methods known to the skilled artisan using for instance publically available software such as Benchling, MIT, or Wellcome Trust tool.

A method disclosed herein also can comprise introducing into a cell or embryo at least one guide RNA or nucleic acid, e.g., DNA encoding at least one guide RNA. A guide RNA can interact with a RNA-guided endonuclease to direct the endonuclease to a specific target site, at which site the 5' end of the guide RNA base pairs with a specific protospacer sequence in a chromosomal sequence.

A guide RNA can comprise two RNAs, e.g., CRISPR RNA (crRNA) and transactivating crRNA (tracrRNA). A guide RNA can sometimes comprise a single-guide RNA (sgRNA) formed by fusion of a portion (e.g., a functional portion) of crRNA and tracrRNA. A guide RNA can also be a dual RNA comprising a crRNA and a tracrRNA. A guide RNA can comprise a crRNA and lack a tracrRNA. Furthermore, a crRNA can hybridize with a target DNA or protospacer sequence.

As discussed above, a guide RNA can be an expression product. For example, a DNA that encodes a guide RNA can be a vector comprising a sequence coding for the guide RNA. A guide RNA can be transferred into a cell or organism by transfecting the cell or organism with an isolated guide RNA or plasmid DNA comprising a sequence coding for the guide RNA and a promoter. A guide RNA can also be transferred into a cell or organism in other way, such as using virus-mediated gene delivery.

A guide RNA can be isolated. For example, a guide RNA can be transfected in the form of an isolated RNA into a cell or organism. A guide RNA can be prepared by in vitro transcription using any in vitro transcription system. A guide RNA can be transferred to a cell in the form of isolated RNA rather than in the form of plasmid comprising encoding sequence for a guide RNA.

A guide RNA can comprise a DNA-targeting segment and a protein binding segment. A DNA-targeting segment (or DNA-targeting sequence, or spacer sequence) comprises a nucleotide sequence that can be complementary to a specific sequence within a target DNA (e.g., a protospacer). A protein-binding segment (or protein-binding sequence) can interact with a site-directed modifying polypeptide, e.g. an RNA-guided endonuclease such as a Cas protein. By "segment" it is meant a segment/section/region of a molecule, e.g., a contiguous stretch of nucleotides in RNA. A segment can also mean a region/section of a complex such that a segment can comprise regions of more than one molecule. For example, in some cases a protein-binding segment of a DNA-targeting RNA is one RNA molecule and the protein-binding segment therefore comprises a region of that RNA molecule. In other cases, the protein-binding segment of a DNA-targeting RNA comprises two separate molecules that are hybridized along a region of complementarity.

A guide RNA can comprise two separate RNA molecules or a single RNA molecule. An exemplary single molecule guide RNA comprises both a DNA-targeting segment and a protein-binding segment.

An exemplary two-molecule DNA-targeting RNA can comprise a crRNA-like ("CRISPR RNA" or "targeter-RNA" or "crRNA" or "crRNA repeat") molecule and a corresponding tracrRNA-like ("trans-acting CRISPR RNA" or "activator-RNA" or "tracrRNA") molecule. A first RNA molecule can be a crRNA-like molecule (targeter-RNA), that can comprise a DNA-targeting segment (e.g., spacer) and a stretch of nucleotides that can form one half of a double-stranded RNA (dsRNA) duplex comprising the protein-binding segment of a guide RNA. A second RNA molecule can be a corresponding tracrRNA-like molecule (activator-RNA) that can comprise a stretch of nucleotides that can form the other half of a dsRNA duplex of a protein-binding segment of a guide RNA. In other words, a stretch of nucleotides of a crRNA-like molecule can be complementary to and can hybridize with a stretch of nucleotides of a tracrRNA-like molecule to form a dsRNA duplex of a protein-binding domain of a guide RNA. As such, each crRNA-like molecule can be said to have a corresponding tracrRNA-like molecule. A crRNA-like molecule additionally can provide a single stranded DNA-targeting segment, or spacer sequence. Thus, a crRNA-like and a tracrRNA-like molecule (as a corresponding pair) can hybridize to form a guide RNA. A subject two-molecule guide RNA can comprise any corresponding crRNA and tracrRNA pair.

A DNA-targeting segment or spacer sequence of a guide RNA can be complementary to sequence at a target site in a chromosomal sequence, e.g., protospacer sequence) such that the DNA-targeting segment of the guide RNA can base pair with the target site or protospacer. In some cases, a DNA-targeting segment of a guide RNA can comprise from or from about 10 nucleotides to from or from about 25 nucleotides or more. For example, a region of base pairing between a first region of a guide RNA and a target site in a chromosomal sequence can be or can be about 10, 11, 12, 13, 14, 15, 16, 17, 18, 19, 20, 22, 23, 24, 25, or more than 25 nucleotides in length. Sometimes, a first region of a guide RNA can be or can be about 19, 20, or 21 nucleotides in length.

A guide RNA can target a nucleic acid sequence of or of about 20 nucleotides. A target nucleic acid can be less than or less than about 20 nucleotides. A target nucleic acid can be at least or at least about 5, 10, 15, 16, 17, 18, 19, 20, 21, 22, 23, 24, 25, 30 or more nucleotides. A target nucleic acid can be at most or at most about 5, 10, 15, 16, 17, 18, 19, 20, 21, 22, 23, 24, 25, 30 or more nucleotides. A target nucleic acid sequence can be or can be about 1, 2, 3, 4, 5, 6, 7, 8, 9, 10, 11, 12, 13, 14, 15, 16, 17, 18, 19, or 20 bases immediately 5' of the first nucleotide of the PAM. A guide RNA can target the nucleic acid sequence.

A guide nucleic acid, for example, a guide RNA, can refer to a nucleic acid that can hybridize to another nucleic acid, for example, the target nucleic acid or protospacer in a genome of a cell. A guide nucleic acid can be RNA. A guide nucleic acid can be DNA. The guide nucleic acid can be programmed or designed to bind to a sequence of nucleic acid site-specifically. A guide nucleic acid can comprise a polynucleotide chain and can be called a single guide nucleic acid. A guide nucleic acid can comprise two polynucleotide chains and can be called a double guide nucleic acid.

A guide nucleic acid can comprise one or more modifications to provide a nucleic acid with a new or enhanced feature. A guide nucleic acid can comprise a nucleic acid affinity tag. A guide nucleic acid can comprise synthetic nucleotide, synthetic nucleotide analog, nucleotide derivatives, and/or modified nucleotides.

A guide nucleic acid can comprise a nucleotide sequence (e.g., a spacer), for example, at or near the 5' end or 3' end, that can hybridize to a sequence in a target nucleic acid (e.g., a protospacer). A spacer of a guide nucleic acid can interact with a target nucleic acid in a sequence-specific manner via hybridization (i.e., base pairing). A spacer sequence can hybridize to a target nucleic acid that is located 5' or 3' of a protospacer adjacent motif (PAM). The length of a spacer sequence can be at least or at least about 5, 10, 15, 16, 17, 18, 19, 20, 21, 22, 23, 24, 25, 30 or more nucleotides. The length of a spacer sequence can be at most or at most about 5, 10, 15, 16, 17, 18, 19, 20, 21, 22, 23, 24, 25, 30 or more nucleotides.

A guide RNA can also comprises a dsRNA duplex region that forms a secondary structure. For example, a secondary structure formed by a guide RNA can comprise a stem (or hairpin) and a loop. A length of a loop and a stem can vary. For example, a loop can range from about 3 to about 10 nucleotides in length, and a stem can range from about 6 to about 20 base pairs in length. A stem can comprise one or more bulges of 1 to about 10 nucleotides. The overall length of a second region can range from about 16 to about 60 nucleotides in length. For example, a loop can be or can be about 4 nucleotides in length and a stem can be or can be about 12 base pairs. A dsRNA duplex region can comprise a protein-binding segment that can form a complex with an RNA-binding protein, such as a RNA-guided endonuclease, e.g. Cas protein.

A guide RNA can also comprise a tail region at the 5' or 3' end that can be essentially single-stranded. For example, a tail region is sometimes not complementarity to any chromosomal sequence in a cell of interest and is sometimes not complementarity to the rest of a guide RNA. Further, the length of a tail region can vary. A tail region can be more than or more than about 4 nucleotides in length. For example, the length of a tail region can range from or from about 5 to from or from about 60 nucleotides in length.

A guide RNA can be introduced into a cell or embryo as an RNA molecule. For example, a RNA molecule can be transcribed in vitro and/or can be chemically synthesized. A guide RNA can then be introduced into a cell or embryo as an RNA molecule. A guide RNA can also be introduced into a cell or embryo in the form of a non-RNA nucleic acid molecule, e.g., DNA molecule. For example, a DNA encoding a guide RNA can be operably linked to promoter control sequence for expression of the guide RNA in a cell or embryo of interest. A RNA coding sequence can be operably linked to a promoter sequence that is recognized by RNA polymerase III (Pol III).

A DNA molecule encoding a guide RNA can also be linear. A DNA molecule encoding a guide RNA can also be circular.

A DNA sequence encoding a guide RNA can also be part of a vector. Some examples of vectors can include plasmid vectors, phagemids, cosmids, artificial/mini-chromosomes, transposons, and viral vectors. For example, a DNA encoding a RNA-guided endonuclease is present in a plasmid vector. Other non-limiting examples of suitable plasmid vectors include pUC, pBR322, pET, pBluescript, and variants thereof. Further, a vector can comprise additional expression control sequences (e.g., enhancer sequences, Kozak sequences, polyadenylation sequences, transcriptional termination sequences, etc.), selectable marker sequences (e.g., antibiotic resistance genes), origins of replication, and the like.

When both a RNA-guided endonuclease and a guide RNA are introduced into a cell as DNA molecules, each can be part of a separate molecule (e.g., one vector containing fusion protein coding sequence and a second vector containing guide RNA coding sequence) or both can be part of a same molecule (e.g., one vector containing coding (and regulatory) sequence for both a fusion protein and a guide RNA).

A Cas protein, such as a Cas9 protein or any derivative thereof, can be pre-complexed with a guide RNA to form a ribonucleoprotein (RNP) complex. The RNP complex can be introduced into primary immune cells. Introduction of the RNP complex can be timed. The cell can be synchronized with other cells at G1, S, and/or M phases of the cell cycle. The RNP complex can be delivered at a cell phase such that HDR is enhanced. The RNP complex can facilitate homology directed repair.

A guide RNA can also be modified. The modifications can comprise chemical alterations, synthetic modifications, nucleotide additions, and/or nucleotide subtractions. The modifications can also enhance CRISPR genome engineering. A modification can alter chirality of a gRNA. In some cases, chirality can be uniform or stereopure after a modification. A guide RNA can be synthesized. The synthesized guide RNA can enhance CRISPR genome engineering. A guide RNA can also be truncated. Truncation can be used to reduce undesired off-target mutagenesis. The truncation can comprise any number of nucleotide deletions. For example, the truncation can comprise 1, 2, 3, 4, 5, 10, 15, 20, 25, 30, 40, 50 or more nucleotides. A guide RNA can comprise a region of target complementarity of any length. For example, a region of target complementarity can be less than 20 nucleotides in length. A region of target complementarity can be more than 20 nucleotides in length.

In some cases, a dual nickase approach can be used to introduce a double stranded break. Cas proteins can be mutated at known amino acids within either nuclease domains, thereby deleting activity of one nuclease domain and generating a nickase Cas protein capable of generating a single strand break. A nickase along with two distinct guide RNAs targeting opposite strands can be utilized to generate a DSB within a target site (often referred to as a "double nick" or "dual nickase" CRISPR system). This approach can dramatically increase target specificity, since it is unlikely that two off-target nicks will be generated within close enough proximity to cause a DSB.

In some cases, a GUIDE-Seq analysis can be performed to determine the specificity of engineered guide RNAs. The general mechanism and protocol of GUIDE-Seq profiling of off-target cleavage by CRISPR system nucleases is discussed in Tsai, S. et al., "GUIDE-Seq enables genome-wide profiling of off-target cleavage by CRISPR system nucleases," Nature, 33: 187-197 (2015).

A gRNA can be introduced at any functional concentration. For example, a gRNA can be introduced to a cell at 10 micrograms. In other cases, a gRNA can be introduced from 0.5 micrograms to 100 micrograms. A gRNA can be introduced from 0.5, 5, 10, 15, 20, 25, 30, 35, 40, 45, 50, 55, 60, 65, 70, 75, 80, 85, 90, 95, or 100 micrograms.

In some cases, a method can comprise an endonuclease selected from the group consisting of Cas1, Cas1B, Cas2, Cas3, Cas4, Cas5, Cas6, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpf1, c2c1, c2c3, Cas9HiFi, homologues thereof or modified versions thereof. A Cas protein can be Cas9. In some cases, a method can further comprise at least one guide RNA (gRNA). A gRNA can comprise at least one modification. An exogenous TCR can bind a cancer neo-antigen.

Disclosed herein is a method of making an engineered cell comprising: introducing at least one polynucleic acid encoding at least one exogenous T cell receptor (TCR) receptor sequence; introducing at least one guide RNA (gRNA) comprising at least one modification; and introducing at least one endonuclease; wherein the gRNA comprises at least one sequence complementary to at least one endogenous genome. In some cases, a modification is on a 5' end, a 3' end, from a 5' end to a 3' end, a single base modification, a 2'-ribose modification, or any combination thereof. A modification can be selected from a group consisting of base substitutions, insertions, deletions, chemical modifications, physical modifications, stabilization, purification, and any combination thereof.

In some cases, a modification is a chemical modification. A modification can be selected from 5'adenylate, 5' guanosine-triphosphate cap, 5'N7-Methylguanosine-triphosphate cap, 5'-triphosphate cap, 3'phosphate, 3'thiophosphate, 5'phosphate, 5'thiophosphate, Cis-Syn thymidine dimer, trimers, C12 spacer, C3 spacer, C6 spacer, dSpacer, PC spacer, rSpacer, Spacer 18, Spacer 9,3'-3' modifications, 5'-5' modifications, abasic, acridine, azobenzene, biotin, biotin BB, biotin TEG, cholesteryl TEG, desthiobiotin TEG, DNP TEG, DNP-X, DOTA, dT-Biotin, dual biotin, PC biotin, psoralen C2, psoralen C6, TINA, 3'DABCYL, black hole quencher 1, black hole quencer 2, DABCYL SE, dT-DABCYL, IRDye QC-1, QSY-21, QSY-35, QSY-7, QSY-9, carboxyl linker, thiol linkers, 2' deoxyribonucleoside analog purine, 2' deoxyribonucleoside analog pyrimidine, ribonucleoside analog, 2'-O-methyl ribonucleoside analog, sugar modified analogs, wobble/universal bases, fluorescent dye label, 2'fluoro RNA, 2'O-methyl RNA, methylphosphonate, phosphodiester DNA, phosphodiester RNA, phosphothioate DNA, phosphorothioate RNA, UNA, pseudouridine-5'-triphosphate, 5-methylcytidine-5'-triphosphate, 2-O-methyl 3phosphorothioate or any combinations thereof. A modification can be a pseudouride modification. In some cases, a modification does not affect viability.

In some cases, a modification is a 2-O-methyl 3 phosphorothioate addition. A 2-O-methyl 3 phosphorothioate addition can be performed from 1 base to 150 bases. A 2-O-methyl 3 phosphorothioate addition can be performed from 1 base to 4 bases. A 2-O-methyl 3 phosphorothioate addition can be performed on 2 bases. A 2-O-methyl 3 phosphorothioate addition can be performed on 4 bases. A modification can also be a truncation. A truncation can be a 5 base truncation.

In some cases, a 5 base truncation can prevent a Cas protein from performing a cut. An endonuclease can be selected from the group consisting of a CRISPR system, TALEN, Zinc Finger, transposon-based, ZFN, meganuclease, Mega-TAL, and any combination. An endonuclease can be a Cas endonuclease. A Cas endonuclease can be selected from the group consisting of Cas1, Cas1B, Cas2, Cas3, Cas4, Cas5, Cas6, Cas7, Cas8, Cas9, Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Cpf1, c2c1, c2c3, Cas9HiFi, homologues thereof or modified versions thereof. A Cas endonuclease can have at least or at least about 50%, 60%, 65%, 70%, 75%, 80%, 85%, 90%, 95%, 98%, or up to about 100% sequence identity and/or sequence similarity to the sequence of SEQ ID NO: 221. A modified version of a Cas can be a clean Cas. A Cas protein can be Cas9. A Cas9 can create a double strand break in said at least one endogenous genome. In some cases, an endogenous genome comprises at least one gene. A gene can be CISH, PD-1, TRA, TRB, or a combination thereof. In some cases, a double strand break can be repaired using homology directed repair (HR), non-homologous end joining (NHEJ), microhomology-mediated end joining (MMEJ), or any combination or derivative thereof. A TCR can be integrated into a double strand break.

A T cell can comprise one or more disrupted target genes and one or more transgenes, for instance a receptor. For example, one or more target genes whose expression is disrupted can comprise any one of CD27, CD40, CD122, OX40, GITR, CD137, CD28, ICOS, A2AR, B7-H3, B7-H4, BTLA, CTLA-4, IDO, KIR, LAG3, PD-1, TIM-3, VISTA, CISH, PPP1R12C, and/or any combination thereof. For example, solely to illustrate various combinations, one or more genes whose expression is disrupted can comprise PD-land one or more transgenes comprise TCR. In another example, one or more target genes whose expression is disrupted can also comprise CTLA-4, and one or more transgenes comprise TCR. A disruption can result in a reduction of copy number of genomic transcript of a disrupted gene or portion thereof. For example, a target gene that can be disrupted can have reduced transcript quantities compared to the same target gene in an undisrupted cell. A disruption can result in disruption results in less than 145 copies/µL, 140 copies/µL, 135 copies/µL, 130 copies/µL, 125 copies/µL, 120 copies/µL, 115 copies/µL, 110 copies/µL, 105 copies/µL, 100 copies/µL, 95 copies/µL, 190 copies/µL, 185 copies/µL, 80 copies/µL, 75 copies/µL, 70 copies/µL, 65 copies/µL, 60 copies/µL, 55 copies/µL, 50 copies/µL, 45 copies/µL, 40 copies/µL, 35 copies/µL, 30 copies/µL, 25 copies/µL, 20 copies/µL, 15 copies/µL, 10 copies/µL, 5 copies/µL, 1 copies/µL, or 0.05 copies/µL. A disruption can result in less than 100 copies/µL in some cases.

TABLE 8

Target gene summary

| SEQ ID | Gene Symbol | Abbreviation | Name | NCBI number (GRCh38.p2) *AC010327.8 **GRCh38.p7 | Original Start | Original Stop | Location in genome |
|---|---|---|---|---|---|---|---|
| 63 | ADORA2A | A2aR; RDC8; ADORA2 | adenosine A2a receptor | 135 | 24423597 | 24442360 | 22q11.23 |
| 64 | CD276 | B7H3; B7-H3; B7RP-2; 4Ig-B7-H3 | CD276 molecule | 80381 | 73684281 | 73714518 | 15q23-q24 |
| 65 | VTCN1 | B7X; B7H4; B7S1; B7-H4; B7h.5; VCTN1; PRO1291 | V-set domain containing T cell activation inhibitor 1 | 79679 | 117143587 | 117270368 | 1p13.1 |
| 66 | BTLA | BTLA1; CD272 | B and T lymphocyte associated | 151888 | 112463966 | 112499702 | 3q13.2 |
| 67 | CTLA4 | GSE; GRD4; ALPS5; CD152; CTLA-4; IDDM12; CELIAC3 | cytotoxic T-lymphocyte-associated protein 4 | 1493 | 203867788 | 203873960 | 2q33 |
| 68 | IDO1 | IDO; INDO; IDO-1 | indoleamine 2,3-dioxygenase 1 | 3620 | 39913809 | 39928790 | 8p12-p11 |
| 69 | KIR3DL1 | KIR; NKB1; NKAT3; NKB1B; NKAT-3; CD158E1; KIR3DL2; KIR3DL1/S1 | killer cell immunoglobulin-like receptor, three domains, long cytoplasmic tail, 1 | 3811 | 54816438 | 54830778 | 19q13.4 |
| 70 | LAG3 | LAG3; CD223 | lymphocyte-activation gene 3 | 3902 | 6772483 | 6778455 | 12p13.32 |
| 71 | PDCD1 | PD1; PD-1; CD279; SLEB2; hPD-1; hPD-1; hSLE1 | programmed cell death 1 | 5133 | 241849881 | 241858908 | 2q37.3 |
| 72 | HAVCR2 | TIM3; CD366; KIM-3; TIMD3; Tim-3; TIMD-3; HAVcr-2 | hepatitis A virus cellular receptor 2 | 84868 | 157085832 | 157109237 | 5q33.3 |
| 73 | VISTA | C10orf54, differentiation of ESC-1 (Dies1); platelet receptor Gi24 precursor; PD1 homolog (PD1H) B7H5; GI24; B7-H5; SISP1; PP2135 | V-domain immunoglobulin suppressor of T-cell activation | 64115 | 71747556 | 71773580 | 10q22.1 |
| 74 | CD244 | 2B4; 2B4; NAIL; Nmrk; NKR2B4; SLAMF4 | CD244 molecule, natural killer cell receptor 2B4 | 51744 | 160830158 | 160862902 | 1q23.3 |
| 75 | CISH | CIS; G18; SOCS; CIS-1; BACTS2 | cytokine inducible SH2-containing protein | 1154 | 50606454 | 50611831 | 3p21.3 |
| 76 | HPRT1 | HPRT; HGPRT | hypoxanthine phosphoribosyltransferase 1 | 3251 | 134452842 | 134500668 | Xq26.1 |
| 77 | AAV*S1 | AAV | adeno-associated virus integration site 1 | 14 | 7774 | 11429 | 19q13 |
| 78 | CCR5 | CKR5; CCR-5; CD195; CKR-5; CCCKR5; CMKBR5; IDDM22; CC-CKR-5 | chemokine (C—C motif) receptor 5 (gene/pseudogene) | 1234 | 46370142 | 46376206 | 3p21.31 |

TABLE 8-continued

Target gene summary

| SEQ ID | Gene Symbol | Abbreviation | Name | NCBI number (GRCh38.p2) *AC010327.8 **GRCh38.p7 | Original Start | Original Stop | Location in genome |
|---|---|---|---|---|---|---|---|
| 79 | CD160 | NK1; BY55; NK28 | CD160 molecule | 11126 | 145719433 | 145739288 | 1q21.1 |
| 80 | TIGIT | VSIG9; VSTM3; WUCAM | T-cell immunoreceptor with Ig and ITIM domains | 201633 | 114293986 | 114310288 | 3q13.31 |
| 81 | CD96 | TACTILE | CD96 molecule | 10225 | 111542079 | 111665996 | 3q13.13-q13.2 |
| 82 | CRTAM | CD355 | cytotoxic and regulatory T-cell molecule | 56253 | 122838431 | 122872643 | 11q24.1 |
| 83 | LAIR1 | CD305; LAIR-1 | leukocyte associated immunoglobulin like receptor 1 | 3903 | 54353624 | 54370556 | 19q13.4 |
| 84 | SIGLEC7 | p75; QA79; AIRM1; CD328; CDw328; D-siglec; SIGLEC-7; SIGLECP2; SIGLEC19P; p75/AIRM1 | sialic acid binding Ig like lectin 7 | 27036 | 51142294 | 51153526 | 19q13.3 |
| 85 | SIGLEC9 | CD329; CDw329; FOAP-9; siglec-9; OBBP-LIKE | sialic acid binding Ig like lectin 9 | 27180 | 51124880 | 51141020 | 19q13.41 |
| 86 | TNFRSF10B | DR5; CD262; KILLER; TRICK2; TRICKB; ZTNFR9; TRAILR2; TRICK2A; TRICK2B; TRAIL-R2; KILLER/DR5 | tumor necrosis factor receptor superfamily member 10b | 8795 | 23006383 | 23069187 | 8p22-p21 |
| 87 | TNFRSF10A | DR4; AP02; CD261; TRAILR1; TRAILR-1 | tumor necrosis factor receptor superfamily member 10a | 8797 | 23191457 | 23225167 | 8p21 |
| 88 | CASP8 | CAP4; MACH; MCH5; FLICE; ALPS2B; Casp-8 | caspase 8 | 841 | 201233443 | 201287711 | 2q33-q34 |
| 89 | CASP10 | MCH4; ALPS2; FLICE2 | caspase 10 | 843 | 201182898 | 201229406 | 2q33-q34 |
| 90 | CASP3 | CPP32; SCA-1; CPP32B | caspase 3 | 836 | 184627696 | 184649475 | 4q34 |
| 91 | CASP6 | MCH2 | caspase 6 | 839 | 109688628 | 109713904 | 4q25 |
| 92 | CASP7 | MCH3; CMH-1; LICE2; CASP-7; ICE-LAP3 | caspase 7 | 840 | 113679162 | 113730909 | 10q25 |
| 93 | FADD | GIG3; MORT1 | Fas associated via death domain | 8772 | 70203163 | 70207402 | 11q13.3 |
| 94 | FAS | APT1; CD95; FAS1; APO-1; FASTM; ALPS1A; TNFRSF6 | Fas cell surface death receptor | 355 | 88969801 | 89017059 | 10q24.1 |
| 95 | TGFBRII | AAT3; FAA3; LDS2; MFS2; RIIC; LDS1B; LDS2B; TAAD2; TGFR-2; TGFbeta-RII | transforming growth factor beta receptor II | 7048 | 30606493 | 30694142 | 3p22 |

TABLE 8-continued

Target gene summary

| SEQ ID | Gene Symbol | Abbreviation | Name | NCBI number (GRCh38.p2) *AC010327.8 **GRCh38.p7 | Original Start | Original Stop | Location in genome |
|---|---|---|---|---|---|---|---|
| 96 | TGFBR1 | AAT5; ALK5; ESS1; LDS1; MSSE; SKR4; ALK-5; LDS1A; LDS2A; TGFR-1; ACVRLK4; tbetaR-I | transforming growth factor beta receptor I | 7046 | 99104038 | 99154192 | 9q22 |
| 97 | SMAD2 | JV18; MADH2; MADR2; JV18-1; hMAD-2; hSMAD2 | SMAD family member 2 | 4087 | 47833095 | 47931193 | 18q21.1 |
| 98 | SMAD3 | LDS3; LDS1C; MADH3; JV15-2; HSPC193; HsT17436 | SMAD family member 3 | 4088 | 67065627 | 67195195 | 15q22.33 |
| 99 | SMAD4 | JIP; DPC4; MADH4; MYHRS | SMAD family member 4 | 4089 | 51030213 | 51085042 | 18q21.1 |
| 100 | SKI | SGS; SKV | SKI proto-oncogene | 6497 | 2228695 | 2310213 | 1p36.33 |
| 101 | SKIL | SNO; SnoA; SnoI; SnoN | SKI-like proto-oncogene | 6498 | 170357678 | 170396849 | 3q26 |
| 102 | TGIF1 | HPE4; TGIF | TGFB induced factor homeobox 1 | 7050 | 3411927 | 3458411 | 18p11.3 |
| 103 | IL10RA | CD210; IL10R; CD210a; CDW210A; HIL-10R; IL-10R1 | interleukin 10 receptor subunit alpha | 3587 | 117986391 | 118001483 | 11q23 |
| 104 | IL10RB | CRFB4; CRF2-4; D21S58; D21S66; CDW210B; IL-10R2 | interleukin 10 receptor subunit beta | 3588 | 33266360 | 33297234 | 21q22.11 |
| 105 | HMOX2 | HO-2 | heme oxygenase 2 | 3163 | 4474703 | 4510347 | 16p13.3 |
| 106 | IL6R | IL6Q; gp80; CD126; IL6RA; IL6RQ; IL-6RA; IL-6R-1 | interleukin 6 receptor | 3570 | 154405193 | 154469450 | 1q21 |
| 107 | IL6ST | CD130; GP130; CDW130; IL-6RB | interleukin 6 signal transducer | 3572 | 55935095 | 55994993 | 5q11.2 |
| 108 | CSK | CSK | c-src tyrosine kinase | 1445 | 74782084 | 74803198 | 15q24.1 |
| 109 | PAG1 | CBP; PAG | phosphoprotein membrane anchor with glycosphingolipid microdomains 1 | 55824 | 80967810 | 81112068 | 8q21.13 |
| 110 | SIT1 | SIT1 | signaling threshold regulating transmembrane adaptor 1 | 27240 | 35649298 | 35650950 | 9p13-p12 |
| 111 | FOXP3 | JM2; AIID; IPEX; PIDX; XPID; DIETER | forkhead box P3 | 50943 | 49250436 | 49269727 | Xp11.23 |
| 112 | PRDM1 | BLIMP 1; PRDI-BF1 | PR domain 1 | 639 | 106086320 | 106109939 | 6q21 |
| 113 | BATF | SFA2; B-ATF; BATF1; SFA-2 | basic leucine zipper transcription factor, ATF-like | 10538 | 75522441 | 75546992 | 14q24.3 |
| 114 | GUCY1A2 | GC-5A2; GUC1A2 | guanylate cyclase 1, soluble, alpha 2 | 2977 | 106674012 | 107018445 | 11q21-q22 |

TABLE 8-continued

Target gene summary

| SEQ ID | Gene Symbol | Abbreviation | Name | NCBI number (GRCh38.p2) *AC010327.8 **GRCh38.p7 | Original Start | Original Stop | Location in genome |
|---|---|---|---|---|---|---|---|
| 115 | GUCY1 A3 | GUCA3; MYMY6; GC-SA3; GUC1A3; GUCSA3; GUCY1A1 | guanylate cyclase 1, soluble, alpha 3 | 2982 | 155666568 | 155737062 | 4q32.1 |
| 116 | GUCY1 B2 | GUCY1B2 | guanylate cyclase 1, soluble, beta 2 (pseudogene) | 2974 | 50994511 | 51066157 | 13q14.3 |
| 117 | GUCY1 B3 | GUCB3; GC-SB3; GUC1B3; GUCSB3; GUCY1B1; GC-S-beta-1 | guanylate cyclase 1, soluble, beta 3 | 2983 | 155758973 | 155807642 | 4q31.3-q33 |
| 118 | TRA | IMD7; TCRA; TCRD; TRAalpha; TRAC | T-cell receptor alpha locus | 6955 | 21621904 | 22552132 | 14q11.2 |
| 119 | TRB | TCRB; TRBbeta | T cell receptor beta locus | 6957 | 142299011 | 142813287 | 7q34 |
| 120 | EGLN1 | HPH2; PHD2; SM20; ECYT3; HALAH; HPH-2; HIFPH2; ZMYND6; C1orf12; HIF-PH2 | egl-9 family hypoxia-inducible factor 1 | 54583 | 231363751 | 231425044 | 1q42.1 |
| 121 | EGLN2 | EIT6; PHD1; HPH-1; HPH-3; HIFPH1; HIF-PH1 | egl-9 family hypoxia-inducible factor 2 | 112398 | 40799143 | 40808441 | 19q13.2 |
| 122 | EGLN3 | PHD3; HIFPH3; HIFP4H3 | egl-9 family hypoxia-inducible factor 3 | 112399 | 33924215 | 33951083 | 14q13.1 |
| 123 | PPP1R12 C** | p84; p85; LENG3; MBS85 | protein phosphatase 1 regulatory subunit 12C | 54776 | 55090913 | 55117600 | 19q13.42 |

A T cell can comprise one or more suppressed genes and one or more transgenes, such as a receptor. For example, one or more genes whose expression is suppressed can comprise any one of CD27, CD40, CD122, OX40, GITR, CD137, CD28, ICOS, A2AR, B7-H3, B7-H4, BTLA, CTLA-4, IDO, KIR, LAG3, PD-1, TIM-3, VISTA, CISH, and/or any combination thereof. For example, solely to illustrate various combinations, one or more genes whose expression is suppressed can comprise PD-1 and one or more transgenes comprise TCR. In another example, one or more genes whose expression is suppressed can also comprise CTLA-4, and one or more transgenes can comprise an exogenous TCR.

The insertion of transgene can be done with or without the disruption of a gene. A transgene can be inserted adjacent to, near, or within a gene such as CD27, CD40, CD122, OX40, GITR, CD137, CD28, ICOS, A2AR, B7-H3, B7-H4, BTLA, CTLA-4, IDO, KIR, LAG3, PD-1, TIM-3, VISTA, HPRT, AAVS SITE (E.G. AAVS1, AAVS2, ETC.), CCR5, or CISH to reduce or eliminate the activity or expression of the gene. For example, a cancer-specific TCR transgene can be inserted adjacent to, near, or within a gene (e.g., PD-1) to reduce or eliminate the activity or expression of the gene. The insertion of a transgene can be done at an endogenous TCR gene. In some cases, an endogenous TCR can be disrupted with a CRISPR system.

The disruption of genes can be of any particular gene. It is contemplated that genetic homologues (e.g., any mammalian version of the gene) of the genes within this applications are covered. For example, genes that are disrupted can exhibit a certain identity and/or homology to genes disclosed herein, e.g., CD27, CD40, CD122, OX40, GITR, CD137, CD28, ICOS, A2AR, B7-H3, B7-H4, BTLA, CTLA-4, IDO, KIR, LAG3, PD-1, TIM-3, VISTA, HPRT, CCR5, AAVS SITE (e.g. AAVS1, AAVS2, etc.), or CISH. Therefore, it is contemplated that a gene that exhibits or exhibits about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or 100% homology (at the nucleic acid or protein level) can be disrupted. It is also contemplated that a gene that exhibits or exhibits about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or 100% identity (at the nucleic acid or protein level) can be disrupted. Some genetic homologues are known in the art, however, in some cases, homologues are unknown. However, homologous genes between mammals can be found by comparing nucleic acid (DNA or RNA) sequences or protein sequences using publically available databases such as NCBI BLAST.

A gene that can be disrupted can be a member of a family of genes. For example, a gene that can be disrupted can improve therapeutic potential of cancer immunotherapy. In some instances, a gene can be CISH. A CISH gene can be a member of a cytokine-induced STAT inhibitor (CIS), also known as suppressor of cytokine signaling (SOCS) or STAT-induced STAT inhibitor (SSI), protein family (see e.g., Palmer et al., Cish actively silences TCR signaling in CD8+ T cells to maintain tumor tolerance. The Journal of Experimental Medicine 202(12), 2095-2113 (2015)). A gene can be part of a SOCS family of proteins that can form part of a classical negative feedback system that can regulate cytokine signal transduction. A gene to be disrupted can be CISH. CISH can be involved in negative regulation of cytokines that signal through the JAK-STATS pathway such as erythropoietin, prolactin or interleukin 3 (IL-3) receptor. A gene can inhibit STATS trans-activation by suppressing its tyrosine phosphorylation. CISH family members are known to be cytokine-inducible negative regulators of cytokine signaling. Expression of a gene can be induced by IL2, IL3, GM-CSF or EPO in hematopoietic cells. Proteasome-mediated degradation of a gene protein can be involved in the inactivation of an erythropoietin receptor. In some cases, a gene to be targeted can be expressed in tumor-specific T cells. A gene to be targeted can increase infiltration of an engineered cell into antigen-relevant tumors when disrupted. In some cases, a gene to be targeted can be CISH.

A gene that can be disrupted can be involved in attenuating TCR signaling, functional avidity, or immunity to cancer. In some cases, a gene to be disrupted is upregulated when a TCR is stimulated. A gene can be involved in inhibiting cellular expansion, functional avidity, or cytokine polyfunctionality. A gene can be involved in negatively regulating cellular cytokine production. For example, a gene can be involved in inhibiting production of effector cytokines, IFN-gamma and/or TNF for example A gene can also be involved in inhibiting expression of supportive cytokines such as IL-2 after TCR stimulation.

Gene suppression can also be done in a number of ways. For example, gene expression can be suppressed by knock out, altering a promoter of a gene, and/or by administering interfering RNAs. This can be done at an organism level or at a tissue, organ, and/or cellular level. If one or more genes are knocked down in a cell, tissue, and/or organ, the one or more genes can be suppressed by administrating RNA interfering reagents, e.g., siRNA, shRNA, or microRNA. For example, a nucleic acid which can express shRNA can be stably transfected into a cell to knockdown expression. Furthermore, a nucleic acid which can express shRNA can be inserted into the genome of a T cell, thus knocking down a gene within the T cell.

One or more genes in a T cell can be knocked out or disrupted using any method. For example, knocking out one or more genes can comprise deleting one or more genes from a genome of a T cell. Knocking out can also comprise removing all or a part of a gene sequence from a T cell. It is also contemplated that knocking out can comprise replacing all or a part of a gene in a genome of a T cell with one or more nucleotides. Knocking out one or more genes can also comprise inserting a sequence in one or more genes thereby disrupting expression of the one or more genes. For example, inserting a sequence can generate a stop codon in the middle of one or more genes. Inserting a sequence can also shift the open reading frame of one or more genes.

Delivery of Vector into a Cell Membrane

The nucleases and transcription factors, polynucleotides encoding same, and/or any transgene polynucleotides and compositions comprising the proteins and/or polynucleotides described herein can be delivered to a target cell by any suitable means.

Suitable cells can include but are not limited to eukaryotic and prokaryotic cells and/or cell lines. A suitable cell can be a human primary cell. A human primary cell can be an immune cell. An immune cell can be a T cell, B cell, NK cell, and/or TIL. Non-limiting examples of such cells or cell lines generated from such cells include COS, CHO (e.g., CHO-S, CHO-K1, CHO-DG44, CHO-DUXB11, CHO-DUKX, CHOK1SV), VERO, MDCK, WI38, V79, B14AF28-G3, BHK, HaK, NSO, SP2/0-Ag14, HeLa, HEK293 (e.g., HEK293-F, HEK293-H, HEK293-T), and perC6 cells as well as insect cells such as Spodopterafugiperda (Sf), or fungal cells such as *Saccharomyces*, *Pichia* and *Schizosaccharomyces*. In some cases, a cell line can be a CHO-K1, MDCK or HEK293 cell line. In some cases, suitable primary cells include peripheral blood mononuclear cells (PBMC), peripheral blood lymphocytes (PBL), and other blood cell subsets such as, but not limited to, T cell, a natural killer cell, a monocyte, a natural killer T cell, a monocyte-precursor cell, a hematopoietic stem cell or a non-pluripotent stem cell. In some cases, the cell can be any immune cells including any T-cell such as tumor infiltrating cells (TILs), such as CD3+ T-cells, CD4+ T-cells, CD8+ T-cells, or any other type of T-cell. The T cell can also include memory T cells, memory stem T cells, or effector T cells. The T cells can also be selected from a bulk population, for example, selecting T cells from whole blood. The T cells can also be expanded from a bulk population. The T cells can also be skewed towards particular populations and phenotypes. For example, the T cells can be skewed to phenotypically comprise, CD45RO(−), CCR7(+), CD45RA(+), CD62L(+), CD27(+), CD28(+) and/or IL-7Ra(+). Suitable cells can be selected that comprise one of more markers selected from a list comprising: CD45RO(−), CCR7(+), CD45RA(+), CD62L(+), CD27(+), CD28(+) and/or IL-7Ra(+). Suitable cells also include stem cells such as, by way of example, embryonic stem cells, induced pluripotent stem cells, hematopoietic stem cells, neuronal stem cells and mesenchymal stem cells. Suitable cells can comprise any number of primary cells, such as human cells, non-human cells, and/or mouse cells. Suitable cells can be progenitor cells. Suitable cells can be derived from the subject to be treated (e.g., subject). Suitable cells can be derived from a human donor. Suitable cells can be stem memory $T_{SCM}$ cells comprised of CD45RO (−), CCR7(+), CD45RA (+), CD62L+(L-selectin), CD27+, CD28+ and IL-7Ra+, stem memory cells can also express CD95, IL-2Rβ, CXCR3, and LFA-1, and show numerous functional attributes distinctive of stem memory cells. Suitable cells can be central memory $T_{CM}$ cells comprising L-selectin and CCR7, central memory cells can secrete, for example, IL-2, but not IFNγ or IL-4. Suitable cells can also be effector memory $T_{EM}$ cells comprising L-selectin or CCR7 and produce, for example, effector cytokines such as IFNγ and IL-4.

In some cases, CRISPR and AAV modified cells can be a stem memory $T_{SCM}$ cell comprised of CD45RO (−), CCR7 (+), CD45RA (+), CD62L+(L-selectin), CD27+, CD28+ and IL-7Ra+, stem memory cells can also express CD95, IL-2Rβ, CXCR3, and LFA-1, and show numerous functional attributes distinctive of stem memory cells. Engineered cells, such as CRISPR and AAV modified cells can also be central memory $T_{CM}$ cells comprising L-selectin and CCR7, where the central memory cells can secrete, for example, IL-2, but not IFNγ or IL-4. Engineered cells can also be effector memory $T_{EM}$ cells comprising L-selectin or CCR7 and produce, for example, effector cytokines such as IFNγ and IL-4. In some cases a population of cells can be introduced to a subject. For example, a population of cells can be a combination of T cells and NK cells. In other cases, a population can be a combination of naïve cells and effector cells.

A method of attaining suitable cells, such as human primary cells, can comprise selecting cells. In some cases, a cell can comprise a marker that can be selected for the cell. For example, such marker can comprise GFP, a resistance gene, a cell surface marker, an endogenous tag. Cells can be selected using any endogenous marker. Suitable cells can be selected using any technology. Such technology can comprise flow cytometry and/or magnetic columns. The selected cells can then be infused into a subject. The selected cells can also be expanded to large numbers. The selected cells can be expanded prior to infusion.

The transcription factors and nucleases as described herein can be delivered using vectors, for example containing sequences encoding one or more of the proteins. Transgenes encoding polynucleotides can be similarly delivered. Any vector systems can be used including, but not limited to, plasmid vectors, retroviral vectors, lentiviral vectors, adenovirus vectors, poxvirus vectors; herpesvirus vectors and adeno-associated virus vectors, etc. Furthermore, any of these vectors can comprise one or more transcription factor, nuclease, and/or transgene. Thus, when one or more CRISPR, TALEN, transposon-based, ZFN, meganuclease, or Mega-TAL molecules and/or transgenes are introduced into the cell, CRISPR, TALEN, transposon-based, ZFN, meganuclease, or Mega-TAL molecules and/or transgenes can be carried on the same vector or on different vectors. When multiple vectors are used, each vector can comprise a sequence encoding one or multiple CRISPR, TALEN, transposon-based, ZFN, meganuclease, or Mega-TAL molecules and/or transgenes.

Conventional viral and non-viral based gene transfer methods can be used to introduce nucleic acids encoding engineered CRISPR, TALEN, transposon-based, ZFN, meganuclease, or Mega-TAL molecules and/or transgenes in cells (e.g., mammalian cells) and target tissues. Such methods can also be used to administer nucleic acids encoding CRISPR, TALEN, transposon-based, ZFN, meganuclease, or Mega-TAL molecules and/or transgenes to cells in vitro. In some examples, nucleic acids encoding CRISPR, TALEN, transposon-based, ZFN, meganuclease, or Mega-TAL molecules and/or transgenes can be administered for in vivo or ex vivo immunotherapy uses. Non-viral vector delivery systems can include DNA plasmids, naked nucleic acid, and nucleic acid complexed with a delivery vehicle such as a liposome or poloxamer. Viral vector delivery systems can include DNA and RNA viruses, which have either episomal or integrated genomes after delivery to the cell.

Methods of non-viral delivery of nucleic acids include electroporation, lipofection, nucleofection, gold nanoparticle delivery, microinjection, biolistics, virosomes, liposomes, immunoliposomes, polycation or lipid: nucleic acid conjugates, naked DNA, mRNA, artificial virions, and agent-enhanced uptake of DNA. Sonoporation using, e.g., the Sonitron 2000 system (Rich-Mar) can also be used for delivery of nucleic acids. Additional exemplary nucleic acid delivery systems include those provided by AMAXA® Biosystems (Cologne, Germany), Life Technologies (Frederick, Md.), MAXCYTE, Inc. (Rockville, Md.), BTX Molecular Delivery Systems (Holliston, Mass.) and Copernicus Therapeutics Inc. (see for example U.S. Pat. No. 6,008,336). Lipofection reagents are sold commercially (e.g., TRANSFECTAM® and LIPOFECTIN®). Delivery can be to cells (ex vivo administration) or target tissues (in vivo administration). Additional methods of delivery include the use of packaging the nucleic acids to be delivered into EnGeneIC delivery vehicles (EDVs). These EDVs are specifically delivered to target tissues using bispecific antibodies where one arm of the antibody has specificity for the target tissue and the other has specificity for the EDV. The antibody brings the EDVs to the target cell surface and then the EDV is brought into the cell by endocytosis.

Vectors including viral and non-viral vectors containing nucleic acids encoding engineered CRISPR, TALEN, transposon-based, ZFN, meganuclease, or Mega-TAL molecules, transposon and/or transgenes can also be administered directly to an organism for transduction of cells in vivo. Alternatively, naked DNA or mRNA can be administered. Administration is by any of the routes normally used for introducing a molecule into ultimate contact with blood or tissue cells including, but not limited to, injection, infusion, topical application and electroporation. More than one route can be used to administer a particular composition. Pharmaceutically acceptable carriers are determined in part by the particular composition being administered, as well as by the particular method used to administer the composition.

In some cases, a vector encoding for an exogenous TCR can be shuttled to a cellular nuclease. For example, a vector can contain a nuclear localization sequence (NLS). A vector can also be shuttled by a protein or protein complex. In some cases, Cas9 can be used as a means to shuttle a minicircle vector. Cas can comprise a NLS. In some cases, a vector can be pre-complexed with a Cas protein prior to electroporation. A Cas protein that can be used for shuttling can be a nuclease-deficient Cas9 (dCas9) protein. A Cas protein that can be used for shuttling can be a nuclease-competent Cas9. In some cases, Cas protein can be pre-mixed with a guide RNA and a plasmid encoding an exogenous TCR.

Vectors can be delivered in vivo by administration to an individual subject, typically by systemic administration (e.g., intravenous, intraperitoneal, intramuscular, subdermal, or intracranial infusion) or topical application, as described below. Alternatively, vectors can be delivered to cells ex vivo, such as cells explanted from an individual subject (e.g., lymphocytes, T cells, bone marrow aspirates, tissue biopsy), followed by reimplantation of the cells into a subject, usually after selection for cells which have incorporated the vector. Prior to or after selection, the cells can be expanded.

A cell can be transfected with a mutant or chimeric adeno-associated viral vector encoding an exogenous TCR and a CRISPR system. An AAV vector concentration can be from 0.5 nanograms to 50 micrograms. In some cases, the amount of nucleic acid (e.g., ssDNA, dsDNA, RNA) that can be introduced into the cell by electroporation can be varied to optimize transfection efficiency and/or cell viability. In some cases, less than about 100 picograms of nucleic acid can be added to each cell sample (e.g., one or more cells being electroporated). In some cases, at least about 100 picograms, at least about 200 picograms, at least about 300 picograms, at least about 400 picograms, at least about 500 picograms, at least about 600 picograms, at least about 700 picograms, at least about 800 picograms, at least about 900 picograms, at least about 1 microgram, at least about 1.5 micrograms, at least about 2 micrograms, at least about 2.5 micrograms, at least about 3 micrograms, at least about 3.5 micrograms, at least about 4 micrograms, at least about 4.5 micrograms, at least about 5 micrograms, at least about 5.5 micrograms, at least about 6 micrograms, at least about 6.5 micrograms, at least about 7 micrograms, at least about 7.5 micrograms, at least about 8 micrograms, at least about 8.5 micrograms, at least about 9 micrograms, at least about 9.5 micrograms, at least about 10 micrograms, at least about 11 micrograms, at least about 12 micrograms, at least about 13 micrograms, at least about 14 micrograms, at least about 15 micrograms, at least about 20 micrograms, at least about 25 micrograms, at least about 30 micrograms, at least about 35 micrograms, at least about 40 micrograms, at least about 45 micrograms, or at least about 50 micrograms, of nucleic acid can be added to each cell sample (e.g., one or more cells being electroporated). For example, 1 microgram of dsDNA can be added to each cell sample for electroporation. In some cases, the amount of nucleic acid (e.g., dsDNA) required for optimal transfection efficiency and/or cell viability can be specific to the cell type. In some cases, the amount of nucleic acid (e.g., dsDNA) used for each sample can directly correspond to the transfection efficiency and/or cell viability.

The transfection efficiency of cells with any of the nucleic acid delivery platforms described herein, for example, nucleofection or electroporation, can be or can be about 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 99.5%, 99.9%, or more than 99.9%. In some embodiments, the transfection efficiency can be or can be about 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 99.5%, 99.9%, or more than 99.9% than the transfection efficiency of comparable cells using a control delivery platform (e.g., a delivery platform using a wild-type AAV). In some cases, a transfection or transduction efficiency can be quantified absent a cellular selection, sorting, or the like.

Vectors described herein, such as mutated and chimeric adeno-associated viral vectors, can be delivered by any suitable method, including transfection, electroporation, liposome delivery, membrane fusion techniques, high velocity DNA-coated pellets, viral infection and protoplast fusion. The methods used to construct any embodiment of this invention are known to those with skill in nucleic acid manipulation and include genetic engineering, recombinant engineering, and synthetic techniques. See, e.g., Sambrook et al, Molecular Cloning: A Laboratory Manual, Cold Spring Harbor Press, Cold Spring Harbor, N.Y. Electroporation using, for example, the Neon® Transfection System (ThermoFisher Scientific) or the AMARA® Nucleofector (AMARA® Biosystems) can also be used for delivery of nucleic acids into a cell. Electroporation parameters can be adjusted to optimize transfection efficiency and/or cell viability. Electroporation devices can have multiple electrical wave form pulse settings such as exponential decay, time constant and square wave. Every cell type has a unique optimal Field Strength (E) that is dependent on the pulse parameters applied (e.g., voltage, capacitance and resistance). Application of optimal field strength causes electropermeabilization through induction of transmembrane voltage, which allows nucleic acids to pass through the cell membrane. In some cases, the electroporation pulse voltage, the electroporation pulse width, number of pulses, cell density, and tip type can be adjusted to optimize transfection efficiency and/or cell viability.

In some cases, electroporation pulse voltage can be varied to optimize transfection efficiency and/or cell viability. In some cases, the electroporation voltage can be less than about 500 volts. In some cases, the electroporation voltage can be at least about 500 volts, at least about 600 volts, at least about 700 volts, at least about 800 volts, at least about 900 volts, at least about 1000 volts, at least about 1100 volts, at least about 1200 volts, at least about 1300 volts, at least about 1400 volts, at least about 1500 volts, at least about 1600 volts, at least about 1700 volts, at least about 1800 volts, at least about 1900 volts, at least about 2000 volts, at least about 2100 volts, at least about 2200 volts, at least about 2300 volts, at least about 2400 volts, at least about 2500 volts, at least about 2600 volts, at least about 2700 volts, at least about 2800 volts, at least about 2900 volts, or at least about 3000 volts. In some cases, the electroporation pulse voltage required for optimal transfection efficiency and/or cell viability can be specific to the cell type. For example, an electroporation voltage of 1900 volts can optimal (e.g., provide the highest viability and/or transfection efficiency) for macrophage cells. In another example, an electroporation voltage of about 1350 volts can optimal (e.g., provide the highest viability and/or transfection efficiency) for Jurkat cells or primary human cells such as T cells. In some cases, a range of electroporation voltages can be optimal for a given cell type. For example, an electroporation voltage between about 1000 volts and about 1300 volts can optimal (e.g., provide the highest viability and/or transfection efficiency) for human 578T cells.

In some cases, electroporation pulse width can be varied to optimize transfection efficiency and/or cell viability. In some cases, the electroporation pulse width can be less than about 5 milliseconds. In some cases, the electroporation width can be at least about 5 milliseconds, at least about 6 milliseconds, at least about 7 milliseconds, at least about 8 milliseconds, at least about 9 milliseconds, at least about 10 milliseconds, at least about 11 milliseconds, at least about 12 milliseconds, at least about 13 milliseconds, at least about 14 milliseconds, at least about 15 milliseconds, at least about 16 milliseconds, at least about 17 milliseconds, at least about 18 milliseconds, at least about 19 milliseconds, at least about 20 milliseconds, at least about 21 milliseconds, at least about 22 milliseconds, at least about 23 milliseconds, at least about 24 milliseconds, at least about 25 milliseconds, at least about 26 milliseconds, at least about 27 milliseconds, at least about 28 milliseconds, at least about 29 milliseconds, at least about 30 milliseconds, at least about 31 milliseconds, at least about 32 milliseconds, at least about 33 milliseconds, at least about 34 milliseconds, at least about 35 milliseconds, at least about 36 milliseconds, at least about 37 milliseconds, at least about 38 milliseconds, at least about 39 milliseconds, at least about 40 milliseconds, at least about 41 milliseconds, at least about 42 milliseconds, at least about 43 milliseconds, at least about 44 milliseconds, at least about 45 milliseconds, at least about 46 milliseconds, at least about 47 milliseconds, at least about 48 milliseconds, at least about 49 milliseconds, or at least about 50 milliseconds. In some cases, the electroporation pulse width required for optimal transfection efficiency and/or cell viability can be specific to the cell type. For example, an electroporation pulse width of 30 milliseconds can optimal (e.g., provide the highest viability and/or transfection efficiency) for macrophage cells. In another example, an electroporation width of about 10 milliseconds can optimal (e.g., provide the highest viability and/or transfection efficiency) for Jurkat cells. In some cases, a range of electroporation widths can be optimal for a given cell type. For example, an electroporation width between about 20 milliseconds and about 30 milliseconds can optimal (e.g., provide the highest viability and/or transfection efficiency) for human 578T cells.

In some cases, the number of electroporation pulses can be varied to optimize transfection efficiency and/or cell viability. In some cases, electroporation can comprise a single pulse. In some cases, electroporation can comprise more than one pulse. In some cases, electroporation can comprise 2 pulses, 3 pulses, 4 pulses, 5 pulses 6 pulses, 7 pulses, 8 pulses, 9 pulses, or 10 or more pulses. In some cases, the number of electroporation pulses required for optimal transfection efficiency and/or cell viability can be specific to the cell type. For example, electroporation with a single pulse can be optimal (e.g., provide the highest viability and/or transfection efficiency) for macrophage cells. In another example, electroporation with a 3 pulses can be optimal (e.g., provide the highest viability and/or transfection efficiency) for primary cells. In some cases, a range of electroporation widths can be optimal for a given cell type. For example, electroporation with between about 1 to about 3 pulses can be optimal (e.g., provide the highest viability and/or transfection efficiency) for human cells.

In some cases, the starting cell density for electroporation can be varied to optimize transfection efficiency and/or cell viability. In some cases, the starting cell density for electroporation can be less than about $1\times10^5$ cells. In some cases, the starting cell density for electroporation can be at least about $1\times10^5$ cells, at least about $2\times10^5$ cells, at least about $3\times10^5$ cells, at least about $4\times10^5$ cells, at least about $5\times10^5$ cells, at least about $6\times10^5$ cells, at least about $7\times10^5$ cells, at least about $8\times10^5$ cells, at least about $9\times10^5$ cells, at least about $1\times10^6$ cells, at least about $1.5\times10^6$ cells, at least about $2\times10^6$ cells, at least about $2.5\times10^6$ cells, at least about $3\times10^6$ cells, at least about $3.5\times10^6$ cells, at least about $4\times10^6$ cells, at least about $4.5\times10^6$ cells, at least about $5\times10^6$ cells, at least about $5.5\times10^6$ cells, at least about $6\times10^6$ cells, at least about $6.5\times10^6$ cells, at least about $7\times10^6$ cells, at least about $7.5\times10^6$ cells, at least about $8\times10^6$ cells, at least about $8.5\times10^6$ cells, at least about $9\times10^6$ cells, at least about $9.5\times10^6$ cells, at least about $1\times10^7$ cells, at least about $1.2\times10^7$ cells, at least about $1.4\times10^7$ cells, at least about $1.6\times10^7$ cells, at least about $1.8\times10^7$ cells, at least about $2\times10^7$ cells, at least about $2.2\times10^7$ cells, at least about $2.4\times10^7$ cells, at least about $2.6\times10^7$ cells, at least about $2.8\times10^7$ cells, at least about $3\times10^7$ cells, at least about $3.2\times10^7$ cells, at least about $3.4\times10^7$ cells, at least about $3.6\times10^7$ cells, at least about $3.8\times10^7$ cells, at least about $4\times10^7$ cells, at least about $4.2\times10^7$ cells, at least about $4.4\times10^7$ cells, at least about $4.6\times10^7$ cells, at least about $4.8\times10^7$ cells, or at least about $5\times10^7$ cells. In some cases, the starting cell density for electroporation required for optimal transfection efficiency and/or cell viability can be specific to the cell type. For example, a starting cell density for electroporation of $1.5\times10^6$ cells can optimal (e.g., provide the highest viability and/or transfection efficiency) for macrophage cells. In another example, a starting cell density for electroporation of $5\times10^6$ cells can optimal (e.g., provide the highest viability and/or transfection efficiency) for human cells. In some cases, a range of starting cell densities for electroporation can be optimal for a given cell type. For example, a starting cell density for electroporation between of $5.6\times10^6$ and $5\times10^7$ cells can optimal (e.g., provide the highest viability and/or transfection efficiency) for human cells such as T cells.

The efficiency of integration of a nucleic acid sequence encoding an exogenous TCR into a genome of a cell with, for example, a CRISPR system, can be or can be about 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99%, 99.5%, 99.9%, or more than 99.9%.

Integration of an exogenous polynucleic acid, such as a TCR, can be measured using any technique. For example, integration can be measured by flow cytometry, surveyor nuclease assay, tracking of indels by decomposition (TIDE), junction PCR, or any combination thereof. A representative TIDE analysis is shown for percent gene editing efficiency as show for PD-1 and CTLA-4 guide RNAs. In other cases, transgene integration can be measured by PCR. A TIDE analysis can also be performed on cells engineered to express an exogenous TCR by AAV transduction followed by CRISPR knock out of an endogenous checkpoint gene.

Ex vivo cell transfection can also be used for diagnostics, research, or for gene therapy (e.g., via re-infusion of the transfected cells into the host organism). In some cases, cells are isolated from the subject organism, transfected with a nucleic acid (e.g., gene or cDNA), and re-infused back into the subject organism (e.g., subject).

The amount of CRISPR and AAV modified cells that can be necessary to be therapeutically effective in a subject can vary depending on the viability of the cells, and the efficiency with which the cells have been genetically modified (e.g., the efficiency with which a transgene has been integrated into one or more cells). In some cases, the product (e.g., multiplication) of the viability of cells post genetic modification and the efficiency of integration of a transgene can correspond to the therapeutic aliquot of cells available for administration to a subject. In some cases, an increase in the viability of cells post genetic modification can correspond to a decrease in the amount of cells that are necessary for administration to be therapeutically effective in a subject. In some cases, an increase in the efficiency with which a transgene has been integrated into one or more cells can correspond to a decrease in the amount of cells that are necessary for administration to be therapeutically effective in a subject. In some cases, determining an amount of cells that are necessary to be therapeutically effective can comprise determining a function corresponding to a change in the viability of cells over time. In some cases, determining an amount of cells that are necessary to be therapeutically effective can comprise determining a function corresponding to a change in the efficiency with which a transgene can be integrated into one or more cells with respect to time dependent variables (e.g., cell culture time, electroporation time, cell stimulation time).

As described herein, viral particles, such as AAV, can be used to deliver a viral vector comprising a gene of interest or a transgene, such as an exogenous TCR, into a cell ex vivo or in vivo. In some embodiments, a mutated or chimeric adeno-associated viral vector as disclosed herein can be measured as pfu (plaque forming units). In some cases, the pfu of recombinant virus or mutated or chimeric adeno-associated viral vector of the compositions and methods of the disclosure can be about $10^8$ to about $5\times10^{10}$ pfu. In some cases, recombinant viruses of this disclosure are at least about $1\times10^8$, $2\times10^8$, $3\times10^8$, $4\times10^8$, $5\times10^8$, $6\times10^8$, $7\times10^8$, $8\times10^8$, $9\times10^8$, $1\times10^9$, $2\times10^9$, $3\times10^9$, $4\times10^9$, $5\times10^9$, $6\times10^9$, $7\times10^9$, $8\times10^9$, $9\times10^9$, $1\times10^{10}$, $2\times^{10}$, $3\times^{10}$, $4\times^{10}$, and $5\times10^{10}$ pfu. In some cases, recombinant viruses of this disclosure are at most about $1\times10^8$, $2\times10^8$, $3\times10^8$, $4\times10^8$, $5\times10^8$, $6\times10^8$, $7\times10^8$, $8\times10^8$, $9\times10^8$, $1\times10^9$, $2\times10^9$, $3\times10^9$, $4\times10^9$, $5\times10^9$, $6\times10^9$, $7\times10^9$, $8\times10^9$, $9\times10^9$, $1\times10^{10}$, $2\times10^{10}$, $3\times10^{10}$, $4\times10^{10}$, and $5\times10^{10}$ pfu. In some aspects, a mutated or chimeric adeno-associated viral vector of the disclosure can be measured as vector genomes. In some cases, recombinant viruses of this disclosure are $1\times10^{10}$ to $3\times10^{12}$ vector genomes, or $1\times10^9$ to $3\times10^{13}$ vector genomes, or $1\times10^8$ to $3\times10^{14}$ vector genomes, or at least about $1\times10^1$, $1\times10^2$, $1\times10^3$, $1\times10^4$, $1\times10^5$, $1\times10^6$, $1\times10^7$, $1\times10^8$, $1\times10^9$, $1\times10^{10}$, $1\times10^{11}$, $1\times10^{12}$, $1\times10^{13}$, $1\times10^{14}$, $1\times10^{15}$, $1\times10^{16}$, $1\times10^{17}$, and $1\times10^{18}$ vector genomes, or are $1\times10^8$ to $3\times10^{14}$ vector genomes, or are at most about $1\times10^1$, $1\times10^2$, $1\times10^3$, $1\times10^4$, $1\times10^5$, $1\times10^6$, $1\times10^7$, $1\times10^8$, $1\times10^9$, $1\times10^{10}$, $1\times10^{11}$, $1\times10^{12}$, $1\times10^{13}$, $1\times10^{14}$, $1\times10^{15}$, $1\times10^{16}$, $1\times10^{17}$, and $1\times10^{18}$ vector genomes.

In some cases, a mutated or chimeric adeno-associated viral vector of the disclosure can be measured using multiplicity of infection (MOI). In some cases, MOI can refer to the ratio, or multiple of vector or viral genomes to the cells to which the nucleic can be delivered. In some cases, the MOI can be $1\times10^6$ GC/mL. In some cases, the MOI can be $1\times10^5$ GC/mL to $1\times10^7$ GC/mL. In some cases, the MOI can be $1\times10^4$ GC/mL to $1\times10^8$ GC/mL. In some cases, recombinant viruses of the disclosure are at least about $1\times10^1$ GC/mL, $1\times10^2$ GC/mL, $1\times10^3$ GC/mL, $1\times10^4$ GC/mL, $1\times10^5$ GC/mL, $1\times10^6$ GC/mL, $1\times10^7$ GC/mL, $1\times10^8$ GC/mL, $1\times10^9$ GC/mL, $1\times10^{10}$ GC/mL, $1\times10^{11}$ GC/mL, $1\times10^{12}$ GC/mL, $1\times10^{13}$ GC/mL, $1\times10^{14}$ GC/mL, $1\times10^{15}$ GC/mL, $1\times10^{16}$ GC/mL, $1\times10^{17}$ GC/mL, and $1\times10^{18}$ GC/mL MOI. In some cases, a mutated or chimeric adeno-associated viruses of this disclosure are from about $1\times10^8$ GC/mL to about $3\times10^{14}$ GC/mL MOI, or are at most about $1\times10^1$ GC/mL, $1\times10^2$ GC/mL, $1\times10^3$ GC/mL, $1\times10^4$ GC/mL, $1\times10^5$ GC/mL, $1\times10^6$ GC/mL, $1\times10^7$ GC/mL, $1\times10^8$ GC/mL, $1\times10^9$ GC/mL, $1\times10^{10}$ GC/mL, $1\times10^{11}$ GC/mL, $1\times10^{12}$ GC/mL, $1\times10^{13}$ GC/mL, $1\times10^{14}$ GC/mL, $1\times10^{15}$ GC/mL, $1\times10^{16}$ GC/mL, $1\times10^{17}$ GC/mL, and $1\times10^{18}$ GC/mL MOI. In some cases, the viral vectors of the present disclosure are more effective and may have lower off-target effects during transduction of cells as compared to unmodified vectors. For example, a lower MOI of a modified virus may result in fewer off-target transgene insertions as compared to transducing a comparable cell with an unmodified vector.

In some aspects, a non-viral vector or nucleic acid can be delivered without the use of a mutated or chimeric adeno-associated viral vector and can be measured according to the quantity of nucleic acid. Generally, any suitable amount of nucleic acid can be used with the compositions and methods of this disclosure. In some cases, nucleic acid can be at least about 1 pg, 10 pg, 100 pg, 1 pg, 10 pg, 100 pg, 200 pg, 300 pg, 400 pg, 500 pg, 600 pg, 700 pg, 800 pg, 900 pg, 1 µg, 10 µg, 100 µg, 200 µg, 300 µg, 400 µg, 500 µg, 600 µg, 700 µg, 800 µg, 900 µg, 1 ng, 10 ng, 100 ng, 200 ng, 300 ng, 400 ng, 500 ng, 600 ng, 700 ng, 800 ng, 900 ng, 1 mg, 10 mg, 100 mg, 200 mg, 300 mg, 400 mg, 500 mg, 600 mg, 700 mg, 800 mg, 900 mg, 1 g, 2 g, 3 g, 4 g, or 5 g. In some cases, nucleic acid can be at most about 1 pg, 10 pg, 100 pg, 1 pg, 10 pg, 100 pg, 200 pg, 300 pg, 400 pg, 500 pg, 600 pg, 700 pg, 800 pg, 900 pg, 1 µg, 10 µg, 100 µg, 200 µg, 300 µg, 400 µg, 500 µg, 600 µg, 700 µg, 800 µg, 900 µg, 1 ng, 10 ng, 100 ng, 200 ng, 300 ng, 400 ng, 500 ng, 600 ng, 700 ng, 800 ng, 900 ng, 1 mg, 10 mg, 100 mg, 200 mg, 300 mg, 400 mg, 500 mg, 600 mg, 700 mg, 800 mg, 900 mg, 1 g, 2 g, 3 g, 4 g, or 5 g.

Cells (e.g., engineered cells or engineered primary T cells) before, after, and/or during transplantation can be functional. For example, transplanted cells can be functional for at least or at least about 1, 2, 3, 4, 5, 6, 7, 8, 9, 10, 11, 12, 13, 14, 15, 16, 17, 18, 19, 20, 21, 22, 23, 24, 25, 6, 27, 28, 29, 30, 40, 50, 60, 70, 80, 90, or 100 days after transplantation. Transplanted cells can be functional for at least or at least about 1, 2, 3, 4, 5, 6, 7, 8, 9, 10, 11, or 12 months after transplantation. Transplanted cells can be functional for at least or at least about 1, 2, 3, 4, 5, 6, 7, 8, 9, 10, 15, 20, 25, or 30 years after transplantation. In some cases, transplanted cells can be functional for up to the lifetime of a recipient.

Further, transplanted cells can function at 100% of its normal intended operation. Transplanted cells can also function 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99% of its normal intended operation.

Transplanted cells can also function over 100% of its normal intended operation. For example, transplanted cells can function 110, 120, 130, 140, 150, 160, 170, 180, 190, 200, 250, 300, 400, 500, 600, 700, 800, 900, 1000 or more % of its normal intended operation.

One or more cytokines can be introduced with cells of the invention. Cytokines can be utilized to boost cytotoxic T lymphocytes (including adoptively transferred tumor-specific cytotoxic T lymphocytes) to expand within a tumor microenvironment. In some cases, IL-2 can be used to facilitate expansion of the cells described herein. Cytokines such as IL-15 can also be employed. Other relevant cytokines in the field of immunotherapy can also be utilized, such as IL-2, IL-7, IL-12, IL-15, IL-21, or any combination thereof.

In some cases, IL-2 can be administered beginning within 24 hours of cell infusion and continuing for up to about 4 days (maximum 12 doses). In some cases, IL-2 can be administered for up to about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40 days after an initial administration.

Doses of IL-2 can be administered every eight hours. In some cases, IL-2 can be administered from about every 1, 2, 3, 4, 5, 6, 7, 8, 9, 10, 11, 12, 13, 14, 15, 16, 17, 18, 19, 20, 21, 22, 23, 24 hours after an initial administration. In some cases, IL-2 dosing can be stopped if toxicities are detected. In some cases, doses can be delayed or stopped if subjects reach Grade 3 or Grade 4 toxicity due to aldesleukin except for the reversible Grade 3 toxicities common to Aldesleukin such as diarrhea, nausea, vomiting, hypotension, skin changes, anorexia, mucositis, dysphagia, or constitutional symptoms and laboratory changes. In some cases, if these toxicities can be easily reversed within 24 hours by supportive measures, then additional doses can be given. In addition, dosing can be held or stopped at the discretion of a treating physician.

Pharmaceutical Compositions and Formulations

The compositions described throughout can be formulation into a pharmaceutical medicament and be used to treat a human or mammal, in need thereof, diagnosed with a disease, e.g., cancer. These medicaments can be co-administered with one or more T cells (e.g., engineered T cells) to a human or mammal, together with one or more chemotherapeutic agent or chemotherapeutic compound.

A "chemotherapeutic agent" or "chemotherapeutic compound" and their grammatical equivalents as used herein, can be a chemical compound useful in the treatment of cancer. The chemotherapeutic cancer agents that can be used in combination with the disclosed T cell include, but are not limited to, mitotic inhibitors (vinca alkaloids). These include vincristine, vinblastine, vindesine and Navelbine™ (vinorelbine, 5'-noranhydroblastine). In yet other cases, chemotherapeutic cancer agents include topoisomerase I inhibitors, such as camptothecin compounds. As used herein, "camptothecin compounds" include Camptosar™ (irinotecan HCL), Hycamtin™ (topotecan HCL) and other compounds derived from camptothecin and its analogues. Another category of chemotherapeutic cancer agents that can be used in the methods and compositions disclosed herein can be podophyllotoxin derivatives, such as etoposide, teniposide and mitopodozide. The present disclosure further encompasses other chemotherapeutic cancer agents known as alkylating agents, which alkylate the genetic material in tumor cells. These include without limitation cisplatin, cyclophosphamide, nitrogen mustard, trimethylene thiophosphoramide, carmustine, busulfan, chlorambucil, belustine, uracil mustard, chlomaphazin, and dacarbazine. The disclosure encompasses antimetabolites as chemotherapeutic agents. Examples of these types of agents include cytosine arabinoside, fluorouracil, methotrexate, mercaptopurine, azathioprime, and procarbazine. An additional category of chemotherapeutic cancer agents that can be used in the methods and compositions disclosed herein includes antibiotics. Examples include without limitation doxorubicin, bleomycin, dactinomycin, daunorubicin, mithramycin, mitomycin, mytomycin C, and daunomycin. There are numerous liposomal formulations commercially available for these compounds. The present disclosure further encompasses other chemotherapeutic cancer agents including without limitation anti-tumor antibodies, dacarbazine, azacytidine, amsacrine, melphalan, ifosfamide and mitoxantrone.

The disclosed T cell herein can be administered in combination with other anti-tumor agents, including cytotoxic/antineoplastic agents and anti-angiogenic agents. Cytotoxic/anti-neoplastic agents can be defined as agents who attack and kill cancer cells. Some cytotoxic/anti-neoplastic agents can be alkylating agents, which alkylate the genetic material in tumor cells, e.g., cis-platin, cyclophosphamide, nitrogen mustard, trimethylene thiophosphoramide, carmustine, busulfan, chlorambucil, belustine, uracil mustard, chlomaphazin, and dacabazine. Other cytotoxic/anti-neoplastic agents can be antimetabolites for tumor cells, e.g., cytosine arabinoside, fluorouracil, methotrexate, mercaptopuirine, azathioprime, and procarbazine. Other cytotoxic/anti-neoplastic agents can be antibiotics, e.g., doxorubicin, bleomycin, dactinomycin, daunorubicin, mithramycin, mitomycin, mytomycin C, and daunomycin. There are numerous liposomal formulations commercially available for these compounds. Still other cytotoxic/anti-neoplastic agents can be mitotic inhibitors (vinca alkaloids). These include vincristine, vinblastine and etoposide. Miscellaneous cytotoxic/anti-neoplastic agents include taxol and its derivatives, L-asparaginase, anti-tumor antibodies, dacarbazine, azacytidine, amsacrine, melphalan, VM-26, ifosfamide, mitoxantrone, and vindesine.

Anti-angiogenic agents can also be used. Suitable anti-angiogenic agents for use in the disclosed methods and compositions include anti-VEGF antibodies, including humanized and chimeric antibodies, anti-VEGF aptamers and antisense oligonucleotides. Other inhibitors of angiogenesis include angiostatin, endostatin, interferons, interleukin 1 (including α and β) interleukin 12, retinoic acid, and tissue inhibitors of metalloproteinase-1 and -2. (TIMP-1 and -2) Small molecules, including topoisomerases such as razoxane, a topoisomerase II inhibitor with anti-angiogenic activity, can also be used.

Other anti-cancer agents that can be used in combination with the disclosed T cell include, but are not limited to: acivicin; aclarubicin; acodazole hydrochloride; acronine; adozelesin; aldesleukin; altretamine; ambomycin; ametantrone acetate; aminoglutethimide; amsacrine; anastrozole; anthramycin; asparaginase; asperlin; avastin; azacitidine; azetepa; azotomycin; batimastat; benzodepa; bicalutamide; bisantrene hydrochloride; bisnafide dimesylate; bizelesin; bleomycin sulfate; brequinar sodium; bropirimine; busulfan; cactinomycin; calusterone; caracemide; carbetimer; carboplatin; carmustine; carubicin hydrochloride; carzelesin; cedefingol; chlorambucil; cirolemycin; cisplatin; cladribine; crisnatol mesylate; cyclophosphamide; cytarabine; dacarbazine; dactinomycin; daunorubicin hydrochloride; decitabine; dexormaplatin; dezaguanine; dezaguanine mesylate; diaziquone; docetaxel; doxorubicin; doxorubicin hydrochloride; droloxifene; droloxifene citrate; dromostanolone propionate; duazomycin; edatrexate; eflornithine hydrochloride; elsamitrucin; enloplatin; enpromate; epipropidine; epirubicin hydrochloride; erbulozole; esorubicin hydrochloride; estramustine; estramustine phosphate sodium; etanidazole; etoposide; etoposide phosphate; etoprine; fadrozole hydrochloride; fazarabine; fenretinide; floxuridine; fludarabine phosphate; fluorouracil; flurocitabine; fosquidone; fostriecin sodium; gemcitabine; gemcitabine hydrochloride; hydroxyurea; idarubicin hydrochloride; ifosfamide; ilmofosine; interleukin II (including recombinant interleukin II, or rIL2), interferon alfa-2a; interferon alfa-2b; interferon alfa-n1; interferon alfa-n3; interferon beta-Ia; interferon gamma-I b; iproplatin; irinotecan hydrochloride; lanreotide acetate; letrozole; leuprolide acetate; liarozole hydrochloride; lometrexol sodium; lomustine; losoxantrone hydrochloride; masoprocol; cantansine; mechlorethamine hydrochloride; megestrol acetate; melengestrol acetate; melphalan; menogaril; mercaptopurine; methotrexate; methotrexate sodium; metoprine; meturedepa; mitindomide; mitocarcin; mitocromin; mitogillin; mitomalcin; mitomycin; mitosper; mitotane; mitoxantrone hydrochloride; mycophenolic acid; nocodazole; nogalamycin; ormaplatin; oxisuran; paclitaxel; pegaspargase; peliomycin; pentamustine; peplomycin sulfate; perfosfamide; pipobroman; piposulfan; piroxantrone hydrochloride; plicamycin; plomestane; porfimer sodium; porfiromycin; prednimustine; procarbazine hydrochloride; puromycin; puromycin hydrochloride; pyrazofurin; riboprine; rogletimide; safingol; safingol hydrochloride; semustine; simtrazene; sparfosate sodium; sparsomycin; spirogermanium hydrochloride; spiromustine; spiroplatin; streptonigrin; streptozocin; sulofenur; talisomycin; tecogalan sodium; tegafur; teloxantrone hydrochloride; temoporfin; teniposide; teroxirone; testolactone; thiamiprine; thioguanine; thiotepa; tiazofurin; tirapazamine; toremifene citrate; trestolone acetate; triciribine phosphate; trimetrexate; trimetrexate glucuronate; triptorelin; tubulozole hydrochloride; uracil mustard; uredepa; vapreotide; verteporfin; vinblastine sulfate; vincristine sulfate; vindesine; vindesine sulfate; vinepidine sulfate; vinglycinate sulfate; vinleurosine sulfate; vinorelbine tartrate; vinrosidine sulfate; vinzolidine sulfate; vorozole; zeniplatin; zinostatin; zorubicin hydrochloride. Other anti-cancer drugs include, but are not limited to: 20-epi-1,25 dihydroxyvitamin D3; 5-ethynyluracil; abiraterone; aclarubicin; acylfulvene; adecypenol; adozelesin; aldesleukin; ALL-TK antagonists; altretamine; ambamustine; amidox; amifostine; aminolevulinic acid; amrubicin; amsacrine; anagrelide; anastrozole; andrographolide; angiogenesis inhibitors; antagonist D; antagonist G; antarelix; anti-dorsalizing morphogenetic protein-1; antiandrogen, prostatic carcinoma; antiestrogen; antineoplaston; antisense oligonucleotides; aphidicolin glycinate; apoptosis gene modulators; apoptosis regulators; apurinic acid; ara-CDP-DL-PTBA; arginine deaminase; asulacrine; atamestane; atrimustine; axinastatin 1; axinastatin 2; axinastatin 3; azasetron; azatoxin; azatyrosine; baccatin III derivatives; balanol; batimastat; BCR/ABL antagonists; benzochlorins; benzoylstaurosporine; beta lactam derivatives; beta-alethine; betaclamycin B; betulinic acid; bFGF inhibitor; bicalutamide; bisantrene; bisaziridinylspermine; bisnafide; bistratene A; bizelesin; breflate; bropirimine; budotitane; buthionine sulfoximine; calcipotriol; calphostin C; camptothecin derivatives; canarypox IL-2; capecitabine; carboxamide-amino-triazole; carboxyamidotriazole; CaRest M3; CARN 700; cartilage derived inhibitor; carzelesin; casein kinase inhibitors (ICOS); castanospermine; cecropin B; cetrorelix; chlorins; chloroquinoxaline sulfonamide; cicaprost; cis-porphyrin; cladribine; clomifene analogues; clotrimazole; collismycin A; collismycin B; combretastatin A4; combretastatin analogue; conagenin; crambescidin 816; crisnatol; cryptophycin 8; cryptophycin A derivatives; curacin A; cyclopentanthraquinones; cycloplatam; cypemycin; cytarabine ocfosfate; cytolytic factor; cytostatin; dacliximab; decitabine; dehydrodidemnin B; deslorelin; dexamethasone; dexifosfamide; dexrazoxane; dexverapamil; diaziquone; didemnin B; didox; diethylnorspermine; dihydro-5-azacytidine; dihydrotaxol, 9-; dioxamycin; diphenyl spiromustine; docetaxel; docosanol; dolasetron; doxifluridine; droloxifene; dronabinol; duocarmycin SA; ebselen; ecomustine; edelfosine; edrecolomab; eflornithine; elemene; emitefur; epirubicin; episteride; estramustine analogue; estrogen agonists; estrogen antagonists; etanidazole; etoposide phosphate; exemestane; fadrozole; fazarabine; fenretinide; filgrastim; finasteride; flavopiridol; flezelastine; fluasterone; fludarabine; fluorodaunorunicin hydrochloride; forfenimex; formestane; fostriecin; fotemustine; gadolinium texaphyrin; gallium nitrate; galocitabine; ganirelix; gelatinase inhibitors; gemcitabine; glutathione inhibitors; hepsulfam; heregulin; hexamethylene bisacetamide; hypericin; ibandronic acid; idarubicin; idoxifene; idramantone; ilmofosine; ilomastat; imidazoacridones; imiquimod; immunostimulant peptides; insulin-like growth factor-1 receptor inhibitor; interferon agonists; interferons; interleukins; iobenguane; iododoxorubicin; ipomeanol, 4-; iroplact; irsogladine; isobengazole; isohomohalicondrin B; itasetron; jasplakinolide; kahalalide F; lamellarin-N triacetate; lanreotide; leinamycin; lenograstim; lentinan sulfate; leptolstatin; letrozole; leukemia inhibiting factor; leukocyte alpha interferon; leuprolide+estrogen+progesterone; leuprorelin; levamisole; liarozole; linear polyamine analogue; lipophilic disaccharide peptide; lipophilic platinum compounds; lissoclinamide 7; lobaplatin; lombricine; lometrexol; lonidamine; losoxantrone; lovastatin; loxoribine; lurtotecan; lutetium texaphyrin; lysofylline; lytic peptides; maitansine; mannostatin A; marimastat; masoprocol; maspin; matrilysin inhibitors; matrix metalloproteinase inhibitors; menogaril; merbarone; meterelin; methioninase; metoclopramide; MIF inhibitor; mifepristone; miltefosine; mirimostim; mismatched double stranded RNA; mitoguazone; mitolactol; mitomycin analogues; mitonafide; mitotoxin fibroblast growth factor-saporin; mitoxantrone; mofarotene; molgramostim; monoclonal antibody, human chorionic gonadotrophin; monophosphoryl lipid A+myobacterium cell wall sk; mopidamol; multiple drug resistance gene inhibitor; multiple tumor suppressor 1-based therapy; mustard anticancer agent; mycaperoxide B; mycobacterial cell wall extract; myriaporone; N-acetyldinaline; N-substituted benzamides; nafarelin; nagrestip; naloxone+pentazocine; napavin; naphterpin; nartograstim; nedaplatin; nemorubicin; neridronic acid; neutral endopeptidase; nilutamide; nisamycin; nitric oxide modulators; nitroxide antioxidant; nitrullyn; 06-benzylguanine; octreotide; okicenone; oligonucleotides; onapristone; ondansetron; ondansetron; oracin; oral cytokine inducer; ormaplatin; osaterone; oxaliplatin; oxaunomycin; paclitaxel; paclitaxel analogues; paclitaxel derivatives; palauamine; palmitoylrhizoxin; pamidronic acid; panaxytriol; panomifene; parabactin; pazelliptine; pegaspargase; peldesine; pentosan polysulfate sodium; pentostatin; pentrozole; perflubron; perfosfamide; perillyl alcohol; phenazinomycin; phenylacetate; phosphatase inhibitors; picibanil; pilocarpine hydrochloride; pirarubicin; piritrexim; placetin A; placetin B; plasminogen activator inhibitor; platinum complex; platinum compounds; platinum-triamine complex; porfimer sodium; porfiromycin; prednisone; propyl bis-acridone; prostaglandin J2; proteasome inhibitors; protein A-based immune modulator; protein kinase C inhibitor; protein kinase C inhibitors, microalgal; protein tyrosine phosphatase inhibitors; purine nucleoside phosphorylase inhibitors; purpurins; pyrazoloacridine; pyridoxylated hemoglobin polyoxyethylene conjugate; raf antagonists; raltitrexed; ramosetron; ras farnesyl protein transferase inhibitors; ras inhibitors; ras-GAP inhibitor; retelliptine demethylated; rhenium Re 186 etidronate; rhizoxin; ribozymes; RII retinamide; rogletimide; rohitukine; romurtide; roquinimex; rubiginone B1; ruboxyl; safingol; saintopin; SarCNU; sarcophytol A; sargramostim; Sdi 1 mimetics; semustine; senescence derived inhibitor 1; sense oligonucleotides; signal transduction inhibitors; signal transduction modulators; single chain antigen binding protein; sizofiran; sobuzoxane; sodium borocaptate; sodium phenylacetate; solverol; somatomedin binding protein; sonermin; sparfosic acid; spicamycin D; spiromustine; splenopentin; spongistatin 1; squalamine; stem cell inhibitor; stem-cell division inhibitors; stipiamide; stromely sin inhibitors; sulfinosine; superactive vasoactive intestinal peptide antagonist; suradista; suramin; swainsonine; synthetic glycosaminoglycans; tallimustine; tamoxifen methiodide; tauromustine; tazarotene; tecogalan sodium; tegafur; tellurapyrylium; telomerase inhibitors; temoporfin; temozolomide; teniposide; tetrachlorodecaoxide; tetrazomine; thaliblastine; thiocoraline; thrombopoietin; thrombopoietin mimetic; thymalfasin; thymopoietin receptor agonist; thymotrinan; thyroid stimulating hormone; tin ethyl etiopurpurin; tirapazamine; titanocene bichloride; topsentin; toremifene; totipotent stem cell factor; translation inhibitors; tretinoin; triacetyluridine; triciribine; trimetrexate; triptorelin; tropisetron; turosteride; tyrosine kinase inhibitors; tyrphostins; UBC inhibitors; ubenimex; urogenital sinus-derived growth inhibitory factor; urokinase receptor antagonists; vapreotide; variolin B; vector system, erythrocyte gene therapy; velaresol; veramine; verdins; verteporfin; vinorelbine; vinxaltine; vitaxin; vorozole; zanoterone; zeniplatin; zilascorb; and zinostatin stimalamer. In one embodiment, the anti-cancer drug is 5-fluorouracil, taxol, or leucovorin.

In some cases, for example, in the compositions, formulations and methods of treating cancer, the unit dosage of the composition or formulation administered can be 5, 10, 15, 20, 25, 30, 35, 40, 45, 50, 55, 60, 65, 70, 75, 80, 85, 90, 95 or 100 mg. In some cases, the total amount of the composition or formulation administered can be 0.1, 0.2, 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5, 10, 11, 12, 13, 14, 15, 16, 17, 18, 19, 20, 25, 30, 40, 50, 60, 70, 80, 90, or 100 g.

In some cases, the present invention provides a pharmaceutical composition comprising a T cell can be administered either alone or together with a pharmaceutically acceptable carrier or excipient, by any routes, and such administration can be carried out in both single and multiple dosages. More particularly, the pharmaceutical composition can be combined with various pharmaceutically acceptable inert carriers in the form of tablets, capsules, lozenges, troches, hand candies, powders, sprays, aqueous suspensions, injectable solutions, elixirs, syrups, and the like. Such carriers include solid diluents or fillers, sterile aqueous media and various non-toxic organic solvents, etc. Moreover, such oral pharmaceutical formulations can be suitably sweetened and/or flavored by means of various agents of the type commonly employed for such purposes.

For example, CRISPR and AAV modified cells can be administered to a subject in conjunction with (e.g., before, simultaneously, or following) any number of relevant treatment modalities, including but not limited to treatment with agents such as antiviral therapy, cidofovir and interleukin-2, or Cytarabine (also known as ARA-C). In some cases, the engineered cells can be used in combination with chemotherapy, radiation, immunosuppressive agents, such as cyclosporin, azathioprine, methotrexate, mycophenolate, and FK506, antibodies, or other immunoablative agents such as CAMPATH, anti-CD3 antibodies or other antibody therapies, cytoxin, fludarabine, cyclosporin, FK506, rapamycin, mycoplienolic acid, steroids, FR901228, cytokines, and irradiation. The engineered cell composition can also be administered to a subject in conjunction with (e.g., before, simultaneously or following) bone marrow transplantation, T cell ablative therapy using either chemotherapy agents such as, fludarabine, external-beam radiation therapy (XRT), cyclophosphamide, or antibodies such as OKT3 or CAMPATH. In some cases, the engineered cell compositions of the present invention can be administered following B-cell ablative therapy such as agents that react with CD20, e.g., Rituxan. For example, subjects can undergo standard treatment with high dose chemotherapy followed by peripheral blood stem cell transplantation. In certain cases, following the transplant, subjects can receive an infusion of the engineered cells, e.g., expanded engineered cells, of the present invention. Additionally, expanded CRISPR and AAV modified cells can be administered before or following surgery. The engineered cells obtained by any one of the methods described herein can be used in a particular aspect of the invention for treating subjects in need thereof against Host versus Graft (HvG) rejection and Graft versus Host Disease (GvHD). Therefore, a method of treating subjects in need thereof against Host versus Graft (HvG) rejection and Graft versus Host Disease (GvHD) comprising treating a subject by administering to a subject an effective amount of engineered cells comprising inactivated TCR alpha and/or TCR beta genes is contemplated.

In some cases, lymphocyte reduction can be performed to minimize immune-mediated engineered cell rejection. For example, a subject can be treated with cyclophosphamide (Cy) followed by fludarabine (Flu) lymphocyte reduction treatment. A dose of a chemotherapeutic such as Cy can be from about 1 mg/kg to about 200 mg/kg. A dose of Cy can be from about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78 79 80, 81, 82, 83, 84, 85, 86, 87, 88, 89, 90, 95, 100, 110, 120, 130, 140, 150, 160, 170, 180, 190, or up to about 200 mg/kg of a subject. Alternatively, an exemplary dose and regimen for Cy treatment can be from about 0.5-5 g/m$^2$/day, preferably 0.6-3 g/m$^2$/d, more preferably 1-2 g/m$^2$/day, for 1-3 days, preferably 1-2 days;

A dose of Flu can be from about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78 79 80, 81, 82, 83, 84, 85, 86, 87, 88, 89, 90, 95, 100, 110, 120, 130, 140, 150, 160, 170, 180, 190, or up to about 200 mg/m$^2$ of a subject. Alternatively, an exemplary dose and regimen for fludarabine treatment can be from about 20~80 mg/m$^2$/day, preferably 25-70 mg/m$^2$/day or 25-30 mg/m$^2$/day, for 2-10, 3-8 or 4, 5, 6 or 7 days;

In some cases, combined use of Cy and Flu can be applied. For example, initial dose of Flu in the range of about 10~60 mg/m$^2$/day or 15~50 mg/m$^2$/day or 20~30 mg/m$^2$/day for 2-8 days or 3-6 days, is followed by Cy in the amount of about 0.2-1 mg/m$^2$/day or 0.3~0.8 mg/m$^2$/day or 0.4~0.6 g/m$^2$/day for 1-5 or 2-3 days.

Cells can be extracted from a human as described herein. Cells can be genetically altered ex vivo and used accordingly. These cells can be used for cell-based therapies. These cells can be used to treat disease in a recipient (e.g., a human). For example, these cells can be used to treat cancer.

Described herein is a method of treating a disease (e.g., cancer) in a recipient comprising transplanting to the recipient one or more cells (including organs and/or tissues) comprising engineered cells. Cells prepared by intracellular genomic transplant can be used to treat cancer.

Described herein is a method of treating a disease (e.g., cancer) in a recipient comprising transplanting to the recipient one or more CRISPR and AAV modified cells (including organs and/or tissues). Generally, CRISPR and AAV modified cells described herein can be expanded by contact with a surface having attached thereto an agent that can stimulate a CD3 TCR complex associated signal and a ligand that can stimulate a co-stimulatory molecule on the surface of the T cells. In particular, T cell populations can be stimulated in vitro such as by contact with an anti-CD3 antibody or antigen-binding fragment thereof, or an anti-CD2 antibody immobilized on a surface, or by contact with a protein kinase C activator (e.g., bryostatin) sometimes in conjunction with a calcium ionophore. For co-stimulation of an accessory molecule on the surface of CRISPR and AAV modified cells, a ligand that binds the accessory molecule can be used. For example, a population of T cells can be contacted with an anti-CD3 antibody and an anti-CD28 antibody, under conditions that can stimulate proliferation of the T cells. In some cases, 4-1BB can be used to stimulate cells. For example, cells can be stimulated with 4-1BB and IL-21 or another cytokine. In some cases $5 \times 10^{10}$ cells will be administered to a subject. In other cases, $5 \times 10^{11}$ cells will be administered to a subject.

In some embodiments, about $5 \times 10^{10}$ cells are administered to a subject. In some embodiments, about $5 \times 10^{10}$ cells represent the median amount of cells administered to a subject. In some embodiments, about $5 \times 10^{10}$ cells are necessary to affect a therapeutic response in a subject. In some embodiments, at least about at least about $1 \times 10^7$ cells, at least about $2 \times 10^7$ cells, at least about $3 \times 10^7$ cells, at least about $4 \times 10^7$ cells, at least about $5 \times 10^7$ cells, at least about $6 \times 10^7$ cells, at least about $6 \times 10^7$ cells, at least about $8 \times 10^7$ cells, at least about $9 \times 10^7$ cells, at least about $1 \times 10^8$ cells, at least about $2 \times 10^8$ cells, at least about $3 \times 10^8$ cells, at least about $4 \times 10^8$ cells, at least about $5 \times 10^8$ cells, at least about $6 \times 10^8$ cells, at least about $6 \times 10^8$ cells, at least about $8 \times 10^8$ cells, at least about $9 \times 10^8$ cells, at least about $1 \times 10^9$ cells, at least about $2 \times 10^9$ cells, at least about $3 \times 10^9$ cells, at least about $4 \times 10^9$ cells, at least about $5 \times 10^9$ cells, at least about $6 \times 10^9$ cells, at least about $6 \times 10^9$ cells, at least about $8 \times 10^9$ cells, at least about $9 \times 10^9$ cells, at least about $1 \times 10^{10}$ cells, at least about $2 \times 10^{10}$ cells, at least about $3 \times 10^{10}$ cells, at least about $4 \times 10^{10}$ cells, at least about $5 \times 10^{10}$ cells, at least about $6 \times 10^{10}$ cells, at least about $6 \times 10^{10}$ cells, at least about $8 \times 10^{10}$ cells, at least about $9 \times 10^{10}$ cells, at least about $1 \times 10^{11}$ cells, at least about $2 \times 10^{11}$ cells, at least about $3 \times 10^{11}$ cells, at least about $4 \times 10^{11}$ cells, at least about $5 \times 10^{11}$ cells, at least about $6 \times 10^{11}$ cells, at least about $6 \times 10^{11}$ cells, at least about $8 \times 10^{11}$ cells, at least about $9 \times 10^{11}$ cells, or at least about $1 \times 10^{12}$ cells. For example, about $5 \times 10^{11}$ cells can be administered to a subject. In another example, starting with $3 \times 10^6$ cells, the cells can be expanded to about $5 \times 10^{10}$ cells and administered to a subject. In some cases, cells are expanded to sufficient numbers for therapy. For example, $5 \times 10^7$ cells can undergo rapid expansion to generate sufficient numbers for therapeutic use. In some cases, sufficient numbers for therapeutic use can be $5 \times 10^{10}$. Any number of cells can be infused for therapeutic use. For example, a subject can be infused with a number of cells between $1 \times 10^6$ to $5 \times 10^{12}$ inclusive. A subject can be infused with as many cells that can be generated for them. In some cases, cells that are infused into a subject are not all engineered. For example, at least 90% of cells that are infused into a subject can be engineered. In other instances, at least 40% of cells that are infused into a subject can be engineered.

In some embodiments, a method of the present disclosure comprises calculating and/or administering to a subject an amount of CRISPR and AAV modified cells necessary to affect a therapeutic response in the subject. In some embodiments, calculating the amount of engineered cells necessary to affect a therapeutic response comprises the viability of the cells and/or the efficiency with which a transgene has been integrated into the genome of a cell. In some embodiments, in order to affect a therapeutic response in a subject, CRISPR and AAV modified cells that can be administered to a subject can be viable. In some embodiments, in order to effect a therapeutic response in a subject, at least about 95%, at least about 90%, at least about 85%, at least about 80%, at least about 75%, at least about 70%, at least about 65%, at least about 60%, at least about 55%, at least about 50%, at least about 45%, at least about 40%, at least about 35%, at least about 30%, at least about 25%, at least about 20%, at least about 15%, at least about 10% of the cells are viable cells. In some embodiments, in order to affect a therapeutic response in a subject, the CRISPR and AAV modified cells administered to a subject can be cells that have had one or more transgenes, such as an exogenous TCR, successfully integrated into the genome of the cell. In some embodiments, in order to effect a therapeutic response in a subject, at least about 95%, at least about 90%, at least about 85%, at least about 80%, at least about 75%, at least about 70%, at least about 65%, at least about 60%, at least about 55%, at least about 50%, at least about 45%, at least about 40%, at least about 35%, at least about 30%, at least about 25%, at least about 20%, at least about 15%, at least about 10% of the cells have had one or more transgenes successfully integrated into the genome of the cell.

The methods disclosed herein can be used for treating or preventing disease including, but not limited to, cancer, cardiovascular diseases, lung diseases, liver diseases, skin diseases, or neurological diseases by administering to a subject in need thereof. CRISPR and AAV modified cells encoding an exogenous TCR.

Transplanting can be by any type of transplanting. Sites can include, but not limited to, liver subcapsular space, splenic subcapsular space, renal subcapsular space, omentum, gastric or intestinal submucosa, vascular segment of small intestine, venous sac, testis, brain, spleen, or cornea. For example, transplanting can be subcapsular transplanting. Transplanting can also be intramuscular transplanting. Transplanting can be intraportal transplanting.

Transplanting can be of one or more cells from a human. For example, the one or more cells can be from an organ, which can be a brain, heart, lungs, eye, stomach, pancreas, kidneys, liver, intestines, uterus, bladder, skin, hair, nails, ears, glands, nose, mouth, lips, spleen, gums, teeth, tongue, salivary glands, tonsils, pharynx, esophagus, large intestine, small intestine, rectum, anus, thyroid gland, thymus gland, bones, cartilage, tendons, ligaments, suprarenal capsule, skeletal muscles, smooth muscles, blood vessels, blood, spinal cord, trachea, ureters, urethra, hypothalamus, pituitary, pylorus, adrenal glands, ovaries, oviducts, uterus, vagina, mammary glands, testes, seminal vesicles, penis, lymph, lymph nodes or lymph vessels. The one or more cells can also be from a brain, heart, liver, skin, intestine, lung, kidney, eye, small bowel, or pancreas. The one or more cells can be from a pancreas, kidney, eye, liver, small bowel, lung, or heart. The one or more cells can be from a pancreas. The one or more cells can be pancreatic islet cells, for example, pancreatic β cells. The one or more cells can be any blood cells, such as peripheral blood mononuclear cell (PBMC), lymphocytes, monocytes or macrophages. The one or more cells can be any immune cells such as lymphocytes, B cells, or T cells.

The method disclosed herein can also comprise transplanting one or more cells, where the one or more cells can be can be any types of cells. For example, the one or more cells can be epithelial cells, fibroblast cells, neural cells, keratinocytes, hematopoietic cells, melanocytes, chondrocytes, lymphocytes (B and T), macrophages, monocytes, mononuclear cells, cardiac muscle cells, other muscle cells, granulosa cells, cumulus cells, epidermal cells, endothelial cells, pancreatic islet cells, blood cells, blood precursor cells, bone cells, bone precursor cells, neuronal stem cells, primordial stem cells, hepatocytes, keratinocytes, umbilical vein endothelial cells, aortic endothelial cells, microvascular endothelial cells, fibroblasts, liver stellate cells, aortic smooth muscle cells, cardiac myocytes, neurons, Kupffer cells, smooth muscle cells, Schwann cells, and epithelial cells, erythrocytes, platelets, neutrophils, lymphocytes, monocytes, eosinophils, basophils, adipocytes, chondrocytes, pancreatic islet cells, thyroid cells, parathyroid cells, parotid cells, tumor cells, glial cells, astrocytes, red blood cells, white blood cells, macrophages, epithelial cells, somatic cells, pituitary cells, adrenal cells, hair cells, bladder cells, kidney cells, retinal cells, rod cells, cone cells, heart cells, pacemaker cells, spleen cells, antigen presenting cells, memory cells, T cells, B cells, plasma cells, muscle cells, ovarian cells, uterine cells, prostate cells, vaginal epithelial cells, sperm cells, testicular cells, germ cells, egg cells, leydig cells, peritubular cells, sertoli cells, lutein cells, cervical cells, endometrial cells, mammary cells, follicle cells, mucous cells, ciliated cells, nonkeratinized epithelial cells, keratinized epithelial cells, lung cells, goblet cells, columnar epithelial cells, dopamiergic cells, squamous epithelial cells, osteocytes, osteoblasts, osteoclasts, dopaminergic cells, embryonic stem cells, fibroblasts and fetal fibroblasts. Further, the one or more cells can be pancreatic islet cells and/or cell clusters or the like, including, but not limited to pancreatic α cells, pancreatic β cells, pancreatic δ cells, pancreatic F cells (e.g., PP cells), or pancreatic ε cells.

In one instance, the one or more cells can be pancreatic α cells. In another instance, the one or more cells can be pancreatic β cells.

Donor can be at any stage of development including, but not limited to, fetal, neonatal, young and adult. For example, donor T cells can be isolated from an adult human. Donor human T cells can be under the age of 10, 9, 8, 7, 6, 5, 4, 3, 2, or 1 year(s). For example, T cells can be isolated from a human under the age of 6 years. T cells can also be isolated from a human under the age of 3 years. A donor can be older than 10 years.

Kits

Disclosed herein can be kits comprising compositions. Disclosed herein can also be kits for the treatment or prevention of a cancer, pathogen infection, immune disorder or allogeneic transplant. In one embodiment, a kit can include a therapeutic or prophylactic composition containing an effective amount of a composition of CRISPR and AAV modified cells in unit dosage form. In some embodiments, a kit comprises a sterile container which can contain a therapeutic composition of engineered T cells; such containers can be boxes, ampules, bottles, vials, tubes, bags, pouches, blister-packs, or other suitable container forms known in the art. Such containers can be made of plastic, glass, laminated paper, metal foil, or other materials suitable for holding medicaments. In some cases, CRISPR and AAV modified cells, can be provided together with instructions for administering the cells to a subject having or at risk of developing a cancer, pathogen infection, immune disorder or allogeneic transplant. Instructions can generally include information about the use of the composition for the treatment or prevention of cancer, pathogen infection, immune disorder or allogeneic transplant. In some cases, a kit can include from about $1 \times 10^4$ cells to about $1 \times 10^{12}$ cells. In some cases a kit can include at least about $1 \times 10^5$ cells, at least about $1 \times 10^6$ cells, at least about $1 \times 10^7$ cells, at least about $4 \times 10^7$ cells, at least about $5 \times 10^7$ cells, at least about $6 \times 10^7$ cells, at least about $6 \times 10^7$ cells, at least about $8 \times 10^7$ cells, at least about $9 \times 10^7$ cells, at least about $1 \times 10^8$ cells, at least about $2 \times 10^8$ cells, at least about $3 \times 10^8$ cells, at least about $4 \times 10^8$ cells, at least about $5 \times 10^8$ cells, at least about $6 \times 10^8$ cells, at least about $6 \times 10^8$ cells, at least about $8 \times 10^8$ cells, at least about $9 \times 10^8$ cells, at least about $1 \times 10^9$ cells, at least about $2 \times 10^9$ cells, at least about $3 \times 10^9$ cells, at least about $4 \times 10^9$ cells, at least about $5 \times 10^9$ cells, at least about $6 \times 10^9$ cells, at least about $6 \times 10^9$ cells, at least about $8 \times 10^9$ cells, at least about $9 \times 10^9$ cells, at least about $1 \times 10^{10}$ cells, at least about $2 \times 10^{10}$ cells, at least about $3 \times 10^{10}$ cells, at least about $4 \times 10^{10}$ cells, at least about $5 \times 10^{10}$ cells, at least about $6 \times 10^{10}$ cells, at least about $6 \times 10^{10}$ cells, at least about $8 \times 10^{10}$ cells, at least about $9 \times 10^{10}$ cells, at least about $1 \times 10^{11}$ cells, at least about $2 \times 10^{11}$ cells, at least about $3 \times 10^{11}$ cells, at least about $4 \times 10^{11}$ cells, at least about $5 \times 10^{11}$ cells, at least about $6 \times 10^{11}$ cells, at least about $6 \times 10^{11}$ cells, at least about $8 \times 10^{11}$ cells, at least about $9 \times 10^{11}$ cells, or at least about $1 \times 10^{12}$ cells. For example, about $5 \times 10^{11}$ cells can be included in a kit. In another example, a kit can include $3 \times 10^6$ cells; the cells can be expanded to about $5 \times 10^{10}$ cells and administered to a subject.

In some cases, a kit can include allogenic cells. In some cases, a kit can include cells that can comprise a genomic modification. In some cases, a kit can comprise "off-the-shelf" cells. In some cases, a kit can include cells that can be expanded for clinical use. In some cases, a kit can contain contents for a research purpose.

In some cases, the instructions include at least one of the following: description of the therapeutic agent; dosage schedule and administration for treatment or prevention of a neoplasia, pathogen infection, immune disorder or allogeneic transplant or symptoms thereof; precautions; warnings; indications; counter-indications; overdosage information; adverse reactions; animal pharmacology; clinical studies; and/or references. The instructions can be printed directly on the container (when present), or as a label applied to the container, or as a separate sheet, pamphlet, card, or folder supplied in or with the container. In some cases, instructions provide procedures for administering CRISPR and AAV modified cells at least about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or up to 2 days, 3 days, 4 days, 5 days, 6 days, or 7 days after administering a chemotherapeutic agent. In some cases, instructions provide procedures for administering engineered T cells at least 24 hours after administering a chemotherapeutic agent. CRISPR and AAV modified cells can be formulated for intravenous injection. CRISPR and AAV modified cells can be formulated for infusion. In some cases a kit can contain products at a pediatric dosage.

EXAMPLES

Example 1: AAV/CRISPR Genomic Modification of Human T Cells

Day-3: Revival and Stimulation

10% human serum was added to X-VIVO15 media and pre-warmed at 37° C. Human PBMCs were thawed in a water bath Immediately after thawing cells were resuspended and spun at 300 g for 5-10 minutes. Cells were washed with PBS and counted via a hemocytometer. Cells were then resuspended at one million cells per ml in X-VIVO15+10% Human Serum+300 U/ml IL-2+5 ng/ml IL-7 and IL-15. Anti-CD3 and anti-CD28 Dynabeads were added for stimulation at a ratio of cells: beads of about 1 to 2. Cells were cultured for 3 days.

Day 0: Removal of Beads, Transfection, and Transduction

Cells were washed with PBS and placed into a DynaMag15 for about 1 minute. Beads were washed off 2 times and then cells pelleted at resuspended in X-VIVO15+Serum+IL-2+IL-7+IL-15 at one million cells per ml. Cells were then cultured at 37° C. for 2 hours before transfection.

Figure 7A:
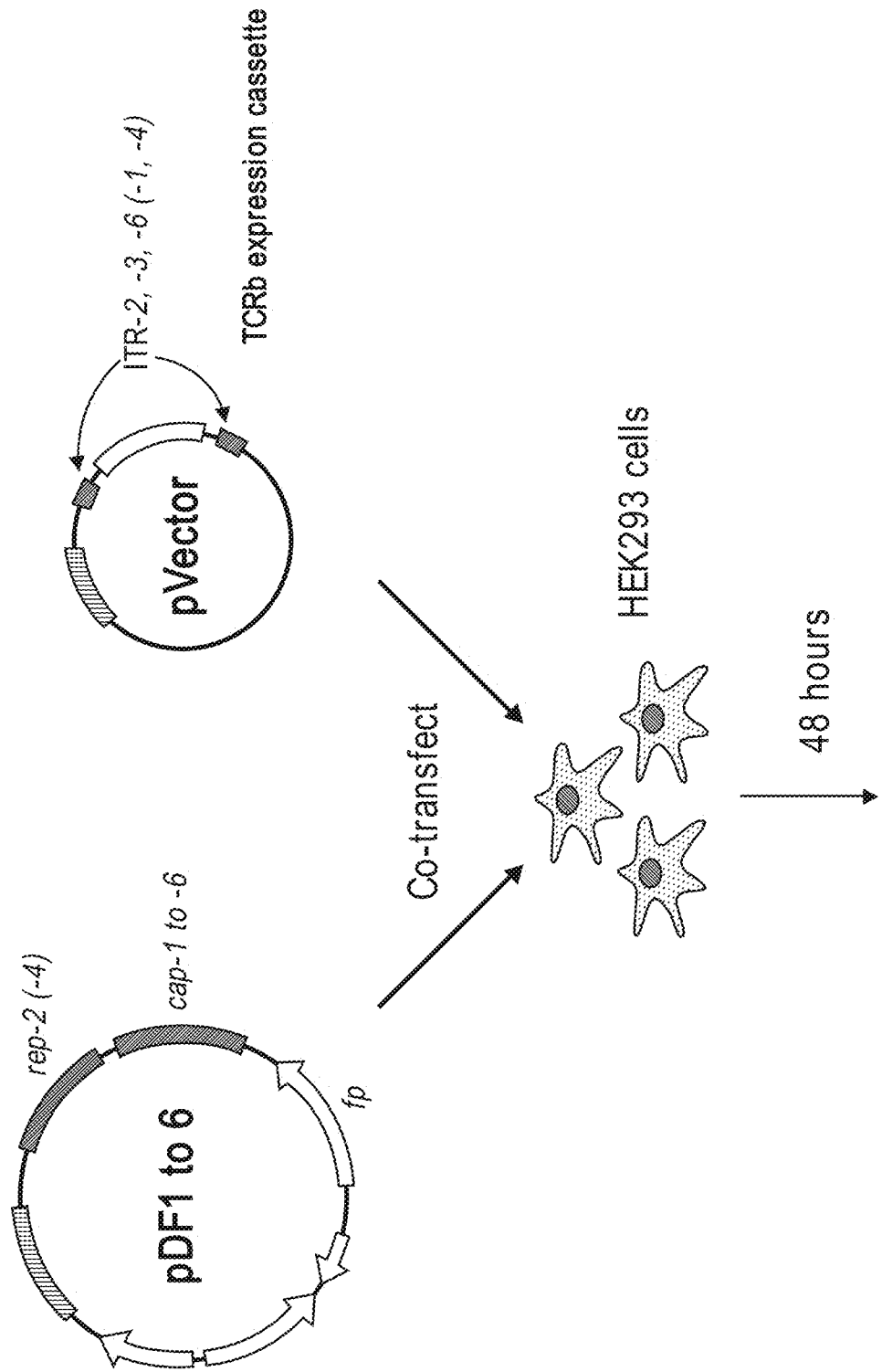
FIG. 7A shows a transfection schematic of AAV viral particles into 293 T cells to generate viral supernatant.
Figure 7B:
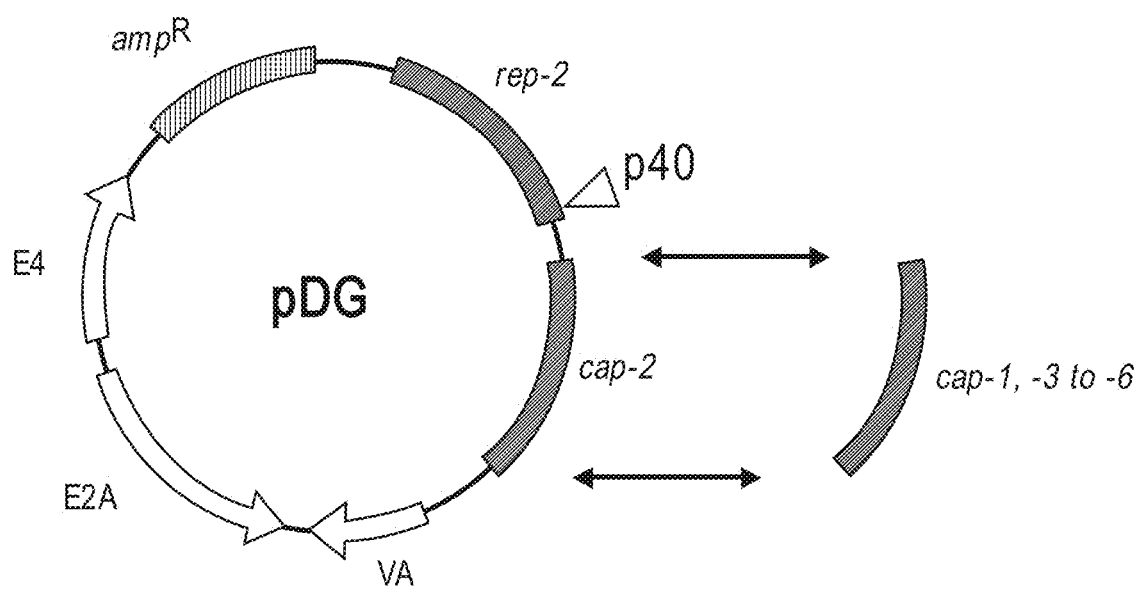
FIG. 7B shows a pDG6-AAV6 helper-free packaging plasmid.
Figure 14A:
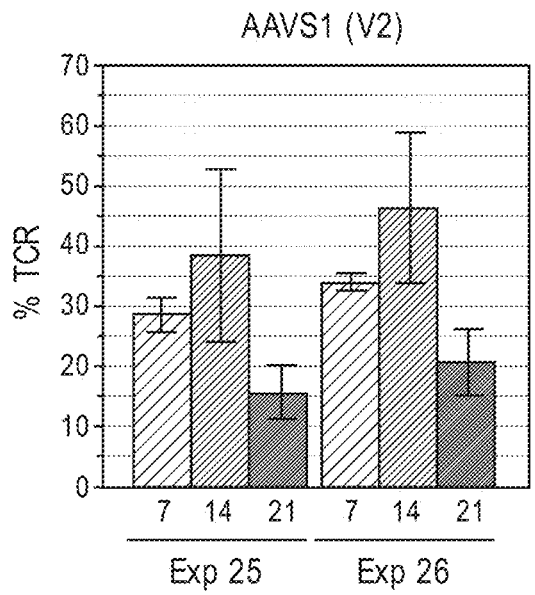
FIG. 14A shows average percent TCR expression on days 7, 14, and 21 post-transduction of a single donor done in triplicate to assess variability in percent TCR expression at different genomic targets. Cells were transduced with a VP1 F.129L mutant AAV virus encoding a TCR and also genomically edited with a CRISPR system specific for disrupting the AAVS1 gene.
Figure 14B:
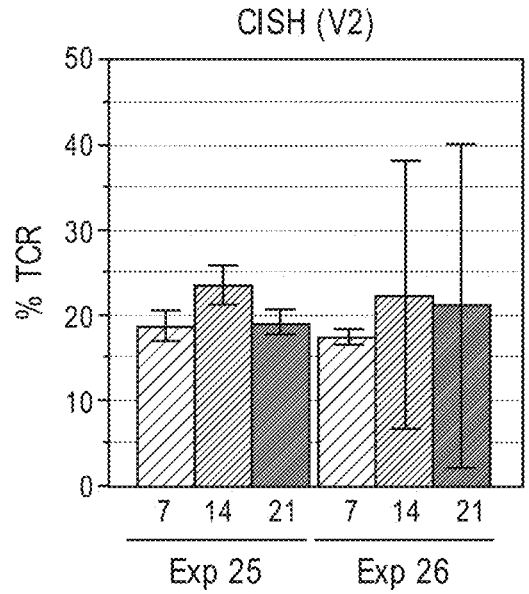
FIG. 14B shows average percent TCR expression on days 7, 14, and 21 post-transduction cellular single donor done in triplicate transduced with VP1 F129L mutant AAV virus encoding a TCR and also genomically edited with a CRISPR system specific for disrupting the CISH gene.
Figure 14C:
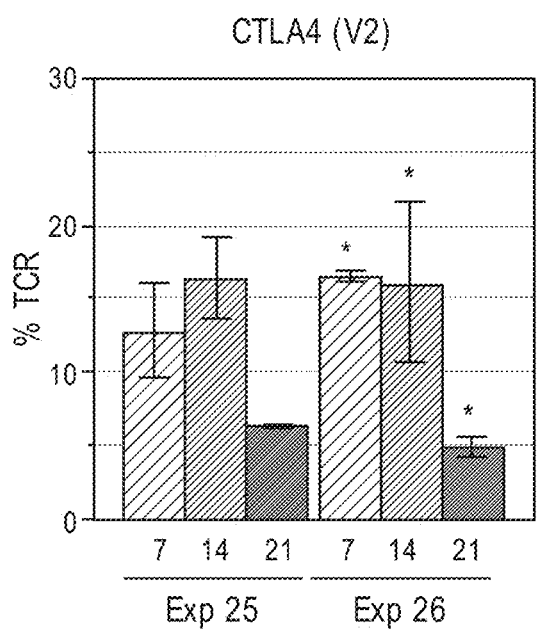
FIG. 14C shows average percent TCR expression on days 7, 14, and 21 post-transduction of a single donor done in triplicate. Cells were transduced with F129L mutant AAV virus encoding a TCR and also genomically edited with a CRISPR system specific for disrupting the CTLA-4 gene.
Figure 14D:
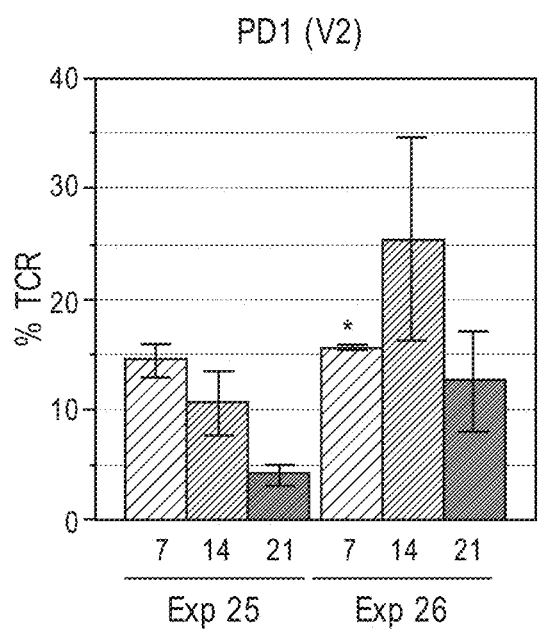
FIG. 14D shows average percent TCR expression on days 7, 14, and 21 post-transduction of a single donor done in duplicate. Cells were transduced with VP1 F129L mutant AAV virus encoding a TCR and also genomically edited with a CRISPR system specific for disrupting the PD-1 gene.

For transfections cells were washed with PBS and pelleted. The cellular pellet was resuspended in T buffer. The required volume of cells (see Table 9) was added into sterile microcentrifuge tubes with Cas9 mRNA and gRNA. Cells, cas9 mRNA and gRNA were mixed by gentle pipetting. The cell solution was taken up into a Neon tip carefully, ensuring no bubbles were present. Cells were zapped with programmed conditions. After transfection, cells were cultured at 30° C. for 2 hours before addition of AAV virus. A schematic of a transfection protocol, FIG. 7A and a representative vector, FIG. 7B. A schematic of a transgene cassettes utilizing a triple vector transfection are shown in FIG. 14A-FIG. 14C.

TABLE 9

Conditions for electroporation with Neon System

| | 10 ul tip | 100 ul tip |
|---|---|---|
| Electrolytic buffer | E | E2 |
| Cell number | $2 \times 10^5$ | $3 \times 10^6$ |

TABLE 9-continued

Conditions for electroporation with Neon System

|  | 10 ul tip | 100 ul tip |
|---|---|---|
| Volume for resuspension | ~10 ul per sample | ~100 ul per sample |
| Optimal volume in microcentrifuge tube | 12 ul | 115 ul |
| Mass of Cas9 mRNA (L-7206) | 1.5 ug | 15 ug |
| Mass of gRNA | 1 ug | 10 ug |
| Mass of GFP mRNA/TCR mRNA | 1.5 ug | 15 ug |
| Volume of media | 200 ul | 3 ml |
| Plate size | flat bottom 96 wp (or 48 wp) | 6 wp |

TABLE 10

Pulsing conditions

| Pulse voltage | Pulse width | Pulse number |
|---|---|---|
| 1400 | 10 ms | 3 |

Cells were transduced with an MOI of 1e6 of AAV virus and cultured at 30° C. overnight.

Figure 11A:
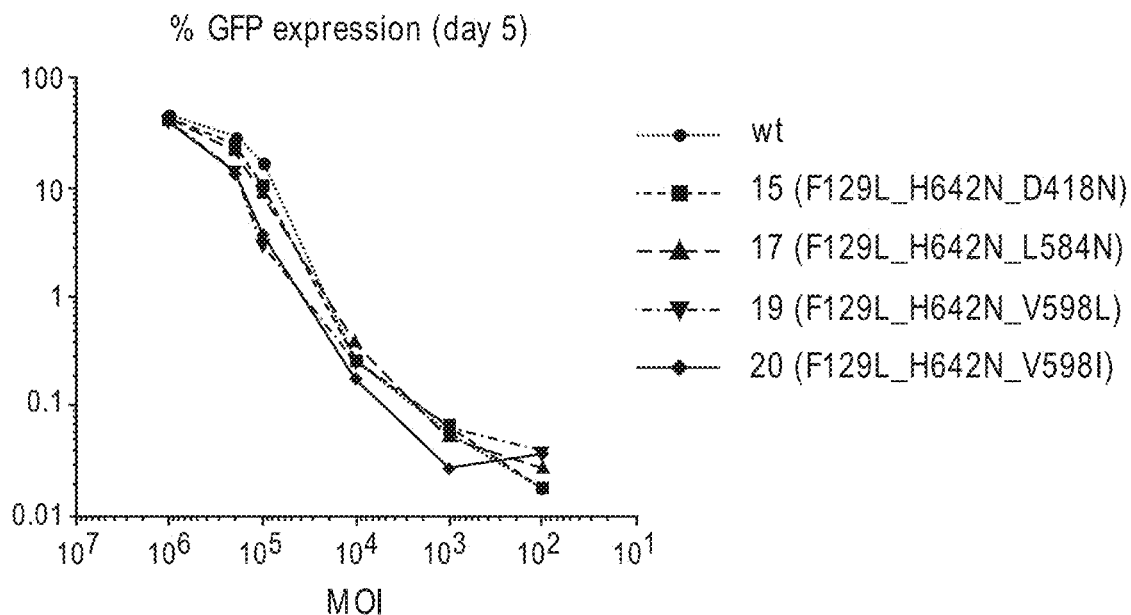
FIG. 11A shows percent GFP expression on day 5 post genomic modification with triple mutant AAV variants 15, 17, 19, and 20 as compared to WT AAV.
Figure 11B:
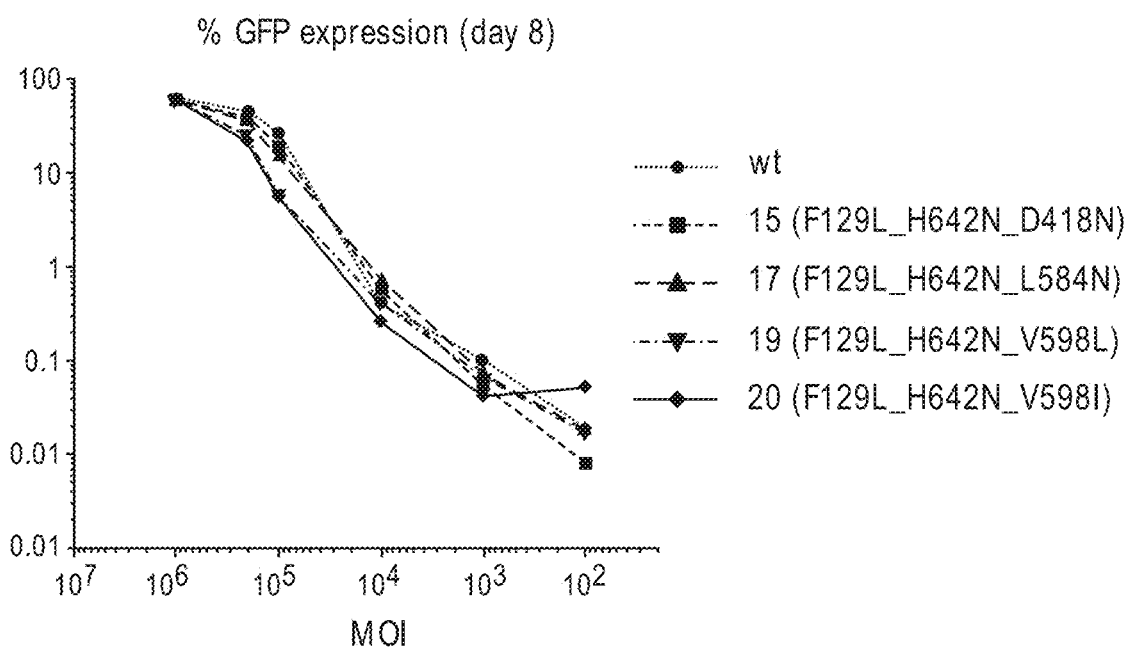
FIG. 11B shows percent GFP expression on day 8 post genomic modification with triple mutant AAV variants 15, 17, 19, and 20 as compared to WT AAV.

Day 1: Media Change 24 hrs. post transduction, cells were removed from the transducing media and transferred into media with phenol red and gentamycin (red media)—with serum and IL-2+IL-7+IL-15. Cells were cultured at 37° C. A representative protocol schematic, FIG. 11.

Example 2: Expression of TCR Determination by Flow Cytometry

On day 3 and onwards (typically day 3, 7 and 14) post electroporation with CRISPR at CTLA-4, PD-1, AAVS1, and CISH and post transduction with rAAV6, cells were evaluated for expression of the TCR transgene by flow cytometry. An aliquot of cells were collected from the culture, washed, pelleted, and resuspended in diluted Ab (eBioscience Anti-Mouse TCR beta PE) $^{1}/_{100}$ in PBS+0.5% FBS-50-100 ul per sample. Resuspended cells were in about 50 to 100 ul of Ab. Cell were incubated at 4° C. for 30 minutes. Viability dye eFluor780 or SYTOX Blue viability stain was also added according to manufacturer's instructions. Post incubation, cells were washed twice in PBS and resuspended in 100 to 200 ul PBS for analysis.

Figure 5A:
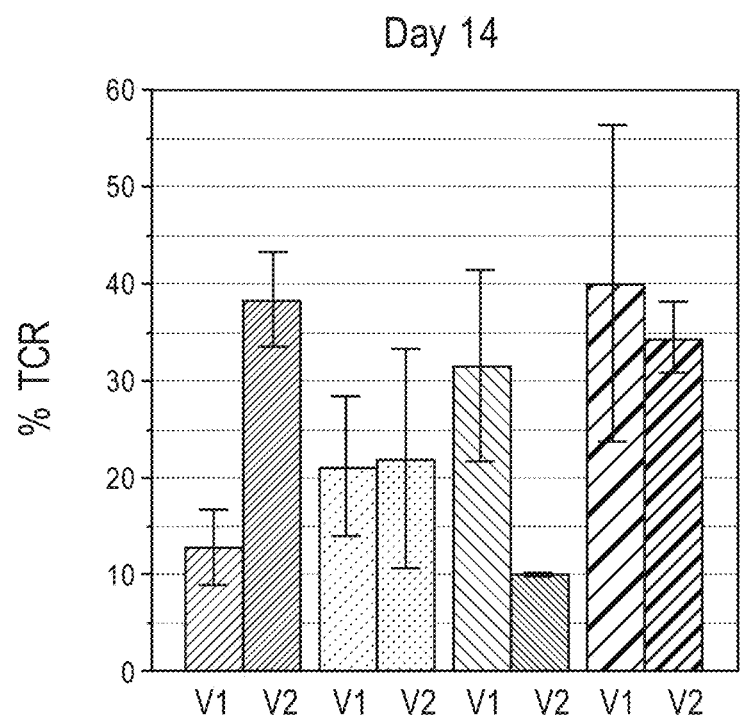
FIG. 5A shows percent receptor expression on day 14 post genomic modification with CRISPR at the target genes and transduction with AAV V1 (WT) or F129L (V2).
Figure 5B:
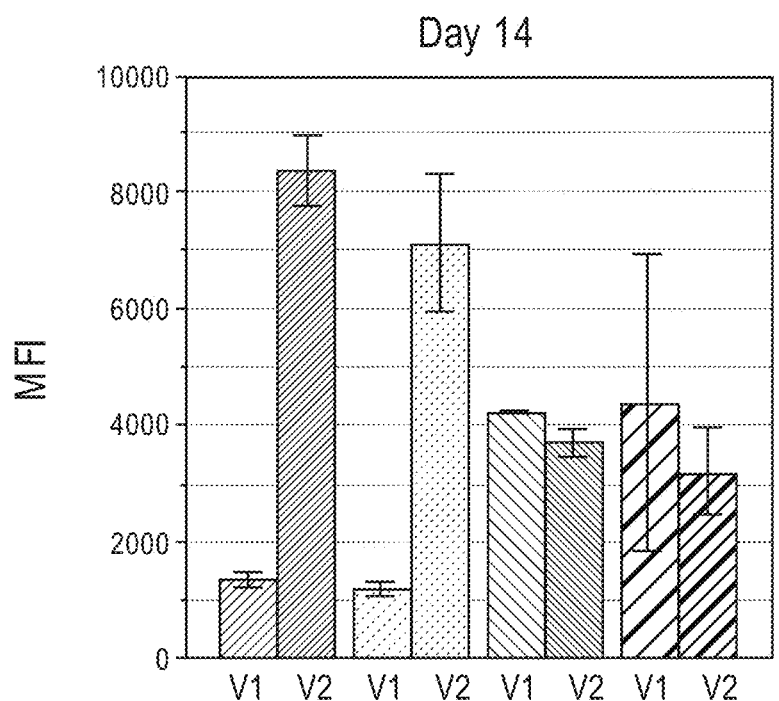
FIG. 5B shows mean fluorescence intensity (MFI) on day 14 post genomic modification with CRISPR at target genes and transduction with AAV V1 (WT) or F129L (V2).
Figure 6A:
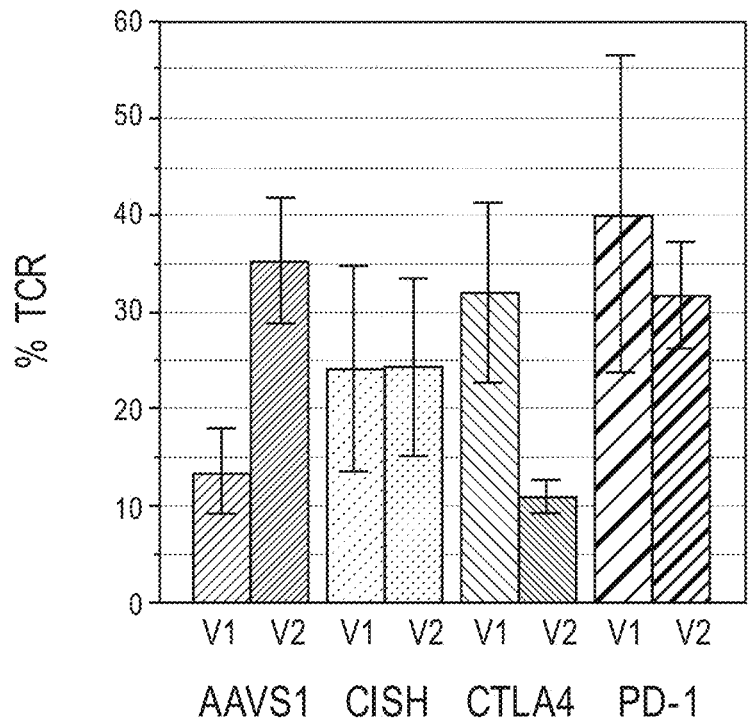
FIG. 6A shows percent receptor expression on days 13 or 14 post genomic modification with CRISPR at target genes and transduction with a high titer (MOI of $1 \times 10^6$ GC/mL) AAV V1 (WT) or F129L (V2).
Figure 6B:
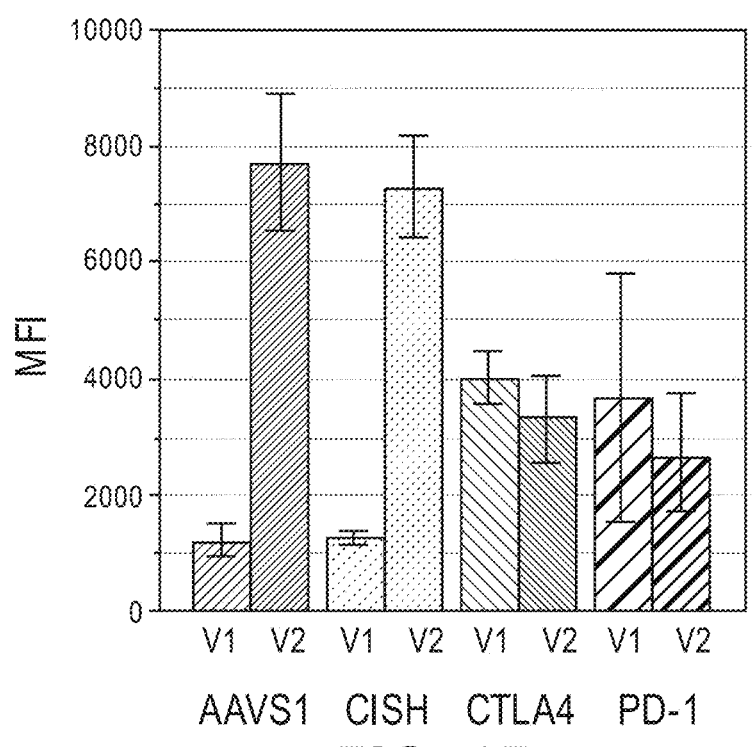
FIG. 6B shows mean fluorescence intensity (MFI) on days 13 or 14 post genomic modification with CRISPR at target genes AAVS1, CISH, CTLA4, or PD-1 and transduction with a high titer (MOI of $1 \times 10^6$ GC/mL) AAV V1 or V2.
Figure 12:
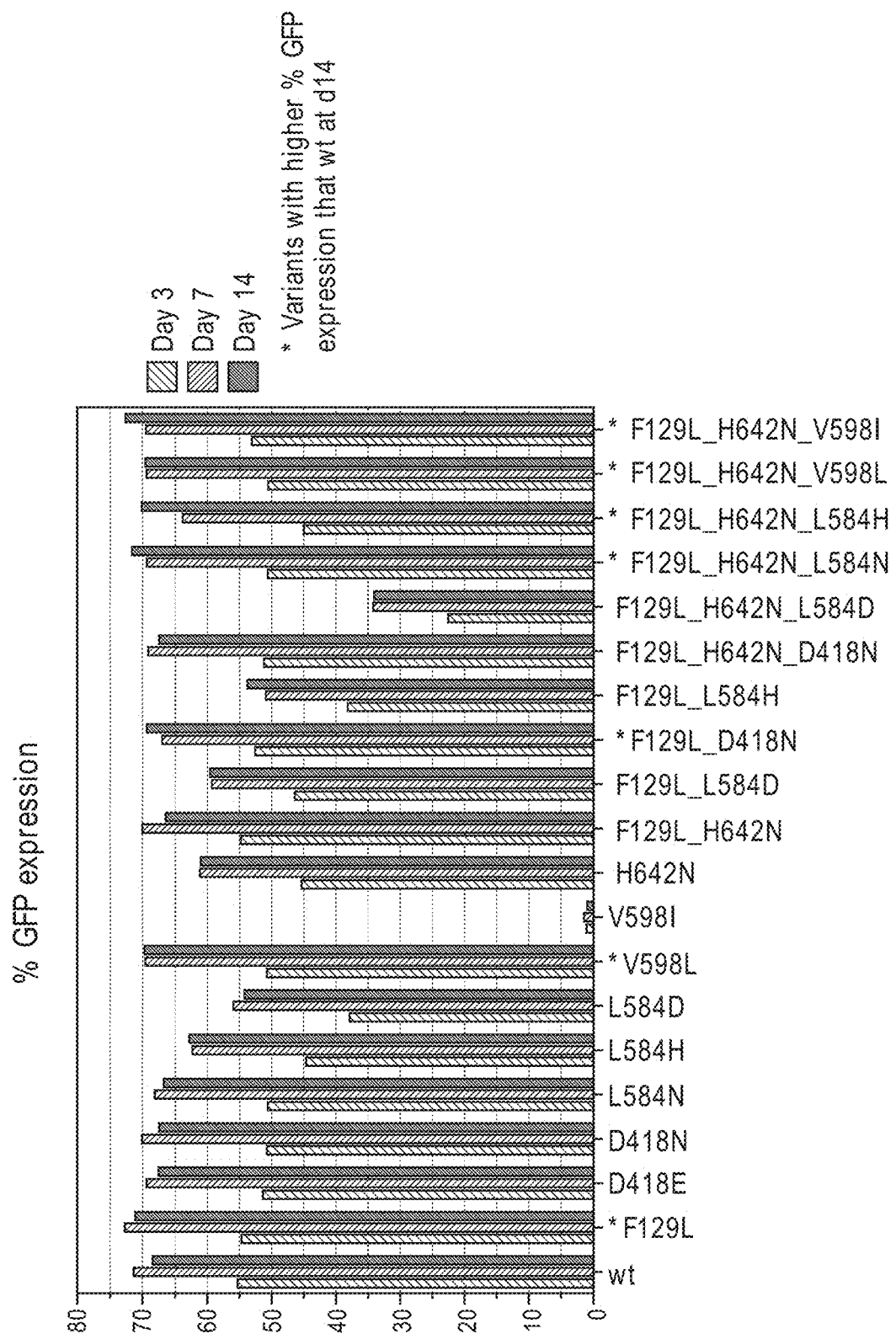
FIG. 12 shows percent GFP expression on days 3, 7, and 14 post genomic modification of single, double, and triple AAV mutants as compared to WT AAV.

On days 3, 7, and 14, cells that were modified with CRISPR at CTLA-4, PD-1, AAVS1, and CISH and transduced with WT AAV6 or F129L-mutant AAV6 (the F129L mutation being in VP1) and 2 encoding an exogenous TCR were evaluated by flow cytometry for TCR expression, FIG. 2, FIG. 3A, FIG. 3B, and FIG. 4. On day 14, the mean fluorescence intensity of the TCR was quantified, FIG. 5B and FIG. 6B, as well as the TCR expression, FIG. 5A and FIG. 6A. A representative flow cytometry assay, FIG. 11. On day 21, the percent TCR expression, FIG. 12A, and a summary of TCR expression from day 3 to 21, FIG. 12B.

Example 2: AAV Targeting Vector Construction and Virus Production

Figure 8:
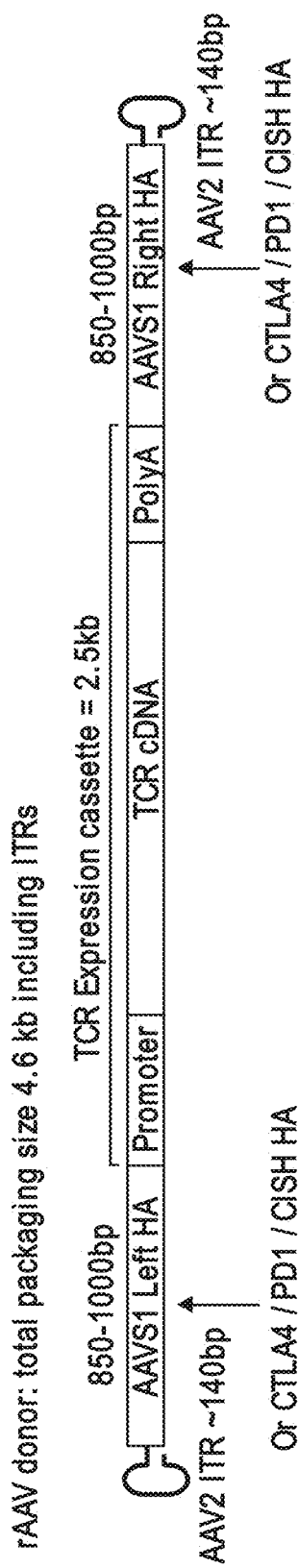
FIG. 8 shows an AAVS1-specific transgene donor encoding an exogenous TCR with flanking AAV2 inverted terminal repeats.
Figure 9:
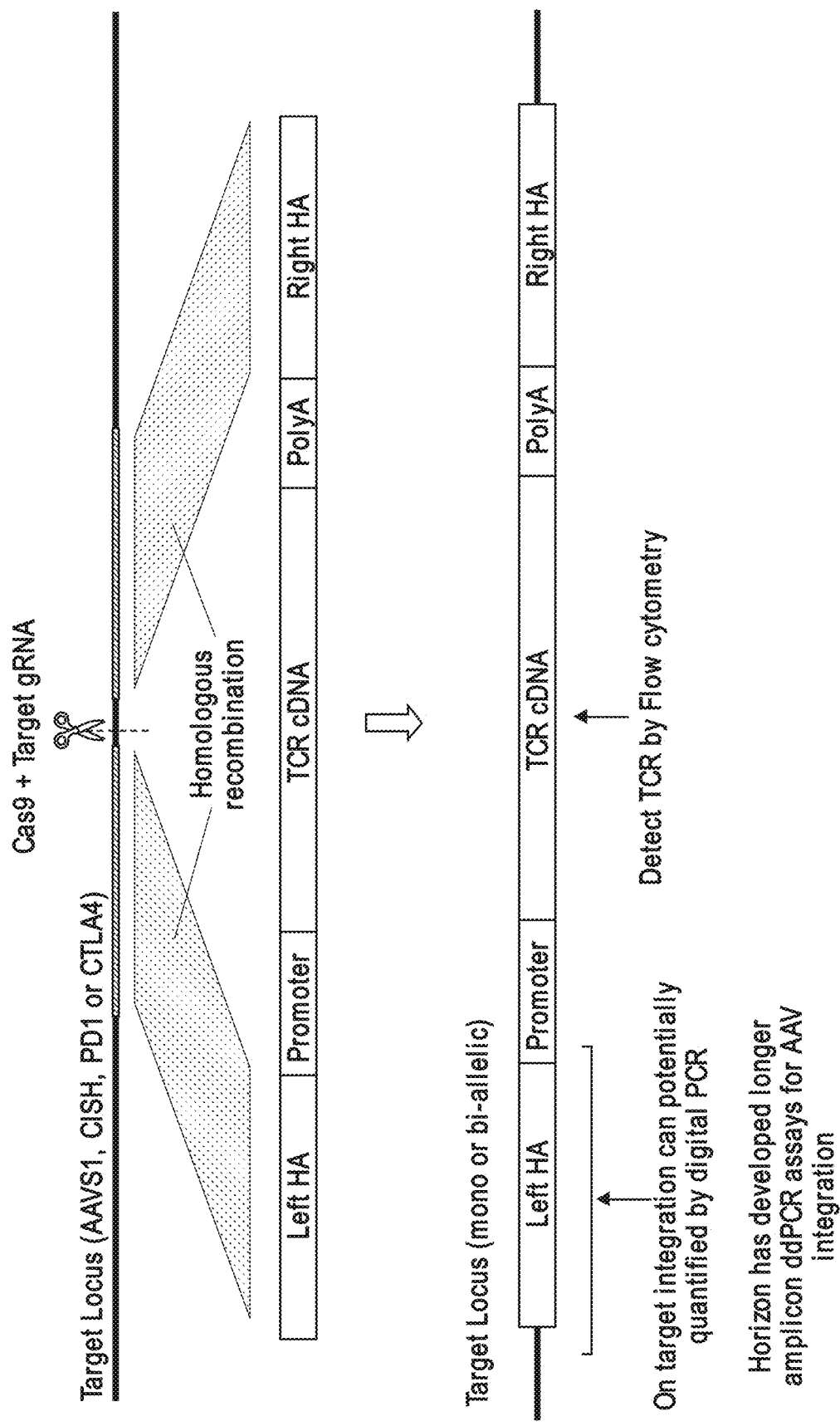
FIG. 9 shows a schematic of AAV mediated homologous recombination of a transgene donor encoding an exogenous TCR with homology arms to any one of AAVS1, CISH, PD1, or CTLA4.
Figure 10:
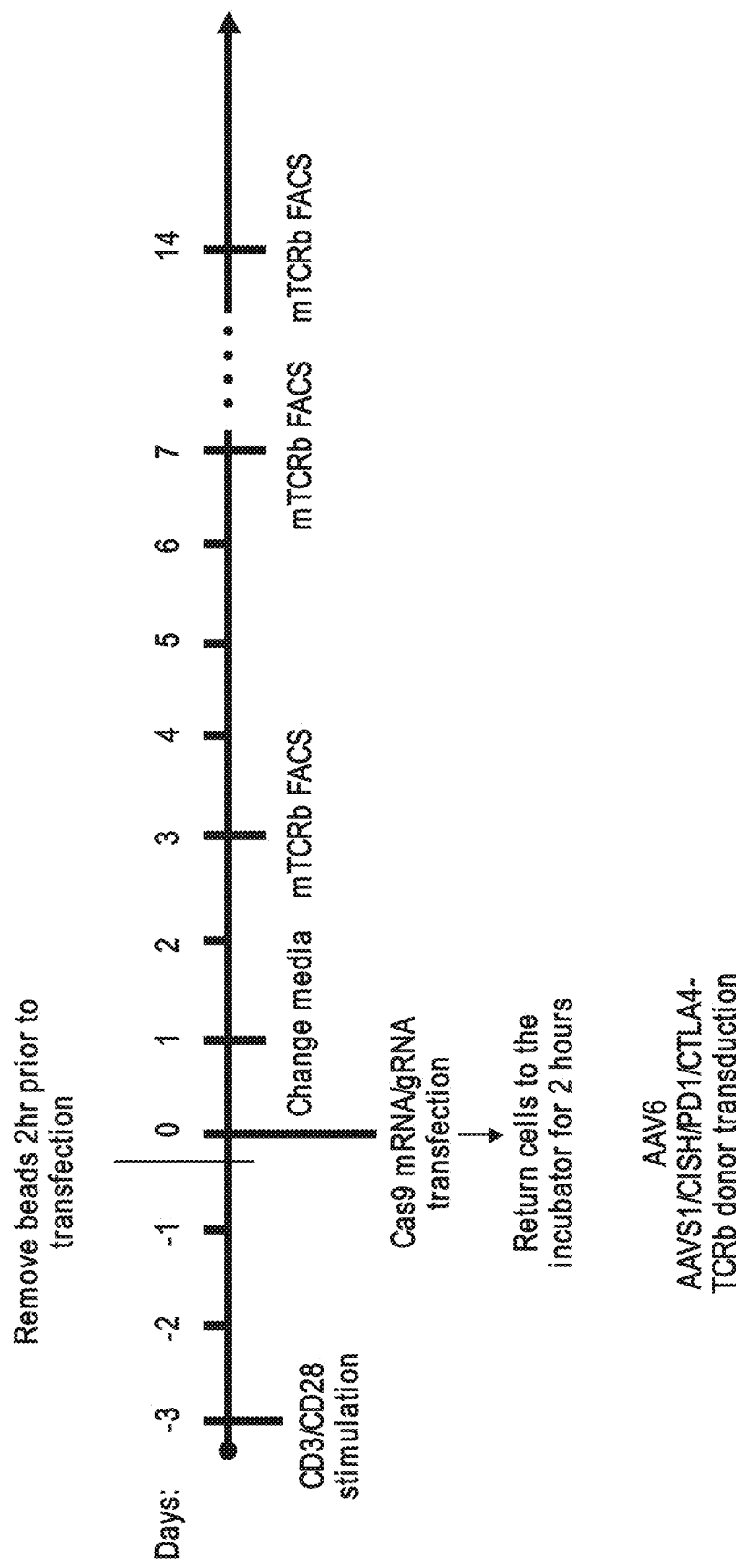
FIG. 10 shows a lymphocyte CRISPR and AAV modification timeline.

Targeting vectors were generated by DNA synthesis of the homology arms and PCR amplification of the mTCR expression cassette. The synthesized fragments and mTCR cassette were cloned by restriction enzyme digestion and ligation into the pAAV-MCS backbone plasmid (Agilent) between the two copies of the AAV2 inverted terminal repeat (ITR) sequences to facilitate viral packaging, FIG. 8. Ligated plasmids were transformed into One Shot TOP10 Chemically Competent *E. coli* (Thermo fisher). 1 mg of plasmid DNA for each vector was purified from the bacteria using the EndoFree Plasmid Maxi Kit (Qiagen) and sent to Vigene Biosciences, MD USA, for production of infectious AAV. The titer of the purified virus, exceeding $1 \times 10^{13}$ viral genome copies per ml, was determined, Table 11, and frozen stocks were made.

TABLE 11 recombinant AAV6 Virus titers

| Virus | Titer (GC/mL) |
|---|---|
| 1 (WT) | 7.7E+09 |
| 2 | 3.87E+09 |
| 3 | 6.95E+09 |
| 4 | 6.30E+09 |
| 5 | 8.58E+08 |
| 6 | 4.89E+09 |
| 7 | 1.04E+10 |
| 8 | 2.69E+10 |
| 9 | 9.32E+09 |
| 10 | 6.65E+09 |
| 11 | 9.55E+08 |
| 12 | 3.48E+08 |
| 13 | 4.18E+09 |
| 14 | 1.88E+09 |
| 15 | 2.84E+09 |
| 16 | 2.54E+09 |
| 17 | 2.39E+09 |
| 18 | 1.39E+09 |
| 19 | 1.63E+09 |
| 20 | 3.75E+09 |

Example 3: Clinical Expansion of AAV Modified-T Cells

In order to generate a large number of transduced T cells, the T cells are induced to proliferate using a rapid expansion protocol (REP). Prior to being used in REPs, T cells are started in culture with anti-CD3, anti-CD28 and IL-2 and transduced on the second day after the initiation of culture as detailed above. The cells are cultured in a 75 cm$^2$ flask at 37° C. and 5% CO$_2$. The cells are counted and suspended at a concentration of $0.5 \times 10^6$ cells/mL in fresh T cell medium with 300 IU/mL of IL-2 every two days for the remainder of the time they will be kept in culture.

Example 4: AAV Screen: GFP Titration

In order to identify and isolate putative AAV mutants and chimeras that when introduced into cells confer increased transduction and resulting expression a screen was performed. Four AAV6 mutants were generated: F129L, H642N, and D418N; F129L, H642N, and L584N; F129L, H462N, or V598L; and F129L, H462N, or V598I. OKT3 and anti-CD28 activated human T cells were genomically modified with CRISPR/Cas9 to knock out the AAVS1 gene. Two hours after CRISPR modification, viral supernatant from each mutant was used to transduce the knockout cells at an MOI of $1 \times 10^6$ GC/mL down to 200 GC/mL.

On days 5 and 8 post transduction, cells were collected and analyzed by flow cytometry for expression of GFP, FIG.

13A and FIG. 13B. A summary of percent GFP expression across different mutations from day 3 to 14, FIG. 11A and FIG. 11B.

Example 5: Clinical Trial

Subjects with evaluable cancer undergo apheresis to isolate peripheral blood mononuclear cells. Lymphocytes are isolated, virally transduced with recombinant AAV6 encoding an exogenous TCR, expanded, and aliquots taken for immunologic testing. On days −7 and −6 before T cell administration, subjects undergo a preparative regime of cyclophosphamide at 60 mg/kg/day×2 days IV over 1 hr. On days −7 and −3 before cellular administration, subjects undergo a preparative regime of fludarabine 25 mg/m$^2$/day IVPB daily over 30 minutes for 5 days. During the preparative regimen, subjects undergo daily complete blood count (CBC) testing.

In the first part of a phase I study a dose escalation is initiated utilizing one subject per group starting at $10^9$ engineered T cells per subject. Individual subjects are treated at half log increments. Thus the following doses will be utilized: $10^9$, $3 \times 10^9$ cells, $10^{10}$ cells, $3 \times 10^{10}$ cells, and up to $1 \times 10^{11}$ cells. Autologous T cells are administered intravenously over 20 to 30 minutes via non-filtered tubing.

All subjects return to the clinic for evaluation 6 weeks following administration of the cellular product.

Example 6: Quantitative PCR

Quantitative PCR (qPCR) is used to quantify AAV integrands for recombinant AAV6 and CRISPR modified T lymphocytes by detecting the TCR transgene in PBMCs collected before and at different time points after T cell infusion. After DNA extraction with the QIAamp DNA Blood Mini Kit (Qiagen), DNA is amplified in triplicate with primers and TaqMan probes (Applied Biosystems) specific for the γδTCR transgene, using the ABI PRISM 7900HT Sequence Detection System (Applied Biosystems). The baseline range is set at cycles 6-15, with the threshold at 10 SDs above the baseline fluorescence. To generate DNA standards, serial dilution of DNA plasmids encoding TCR transgene cassettes are used.

Example 7: Quality Control Assays for Modified Recombinant AAV6 Virus

Recombinant AAV6 virus was produced from 109 Hek293 cells and purified by Iodixanol gradient ultracentrifugation. Resultant virus was concentrated to 500 μl with virus titer no less than 1013vp/ml. Quality control assays were performed: physical titer (vg/ml) as determined by qPCR and silver stain to assess virus titer and purity. AAV particles were stored in F68/PBS

TABLE 12

AAV6 Mutant Plasmid vector sequences

| SEQ ID NO | Construct | Sequence |
|---|---|---|
| 195 | 17AALHUC_ AAV6_WT_ pAAV-DJ | ccgccatgccggggttttacgagattgtgattaaggtccccagcgacctt gacgagcatctgcccggcatttctgacagctttgtgaactgggtggccga gaaggaatgggagttgccgccagattctgacatggatctgaatctgattg agcaggcaccctgaccgtggccgagaagctgcagcgcgactttctgacg gaatggcgccgtgtgagtaaggccccggaggccctttctctttgtgcaatt tgagaagggagagagctacttccacatgcacgtgctcgtggaaaccaccg gggtgaaatccatggttttgggacgtttcctgagtcagattcgcgaaaaa ctgattcagagaatttaccgcgggatcgagccgactttgccaaactggtt cgcggtcacaaagaccagaaatggcgccggaggcgggaacaaggtggtgg atgagtgctacatccccaattacttgctccccaaaacccagcctgagctc cagtgggcgtggactaatatgaacagtatttaagcgcctgtttgaatct cacggagcgtaaacggttggtggcgcagcatctgacgcacgtgtcgcaga cgcaggagcagaacaaagagaatcagaatcccaattctgatgcgccggtg atcagatcaaaaacttcagccaggtacatggagctggtcgggtggctcgt ggacaaggggattacctcggagaagcagtggatccaggaggaccaggcct catacatctccttcaatgcggcctccaactcgcggtcccaaatcaaggct gccttggacaatgcgggaaagattatgagcctgactaaaaccgcccccga ctacctggtgggccagcagcccgtggaggacatttccagcaatcggattt ataaaattttggaactaaacgggtacgatccccaatatgcggcttccgtc tttctgggatgggccacgaaaaagttcggcaagaggaacaccatctggct gtttgggcctgcaactaccgggaagaccaacatcgcggaggccatagccc acactgtgcccttctacgggtgcgtaaactggaccaatgagaactttccc ttcaacgactgtgtcgacaagatggtgatctggtgggaggaggggaagat gaccgccaaggtcgtggagtcggccaaagccattctcggagggaagcaagg tgccgctggaccagaaatgcaagtcctcggcccagatagaccccgactcc gtgatcgtcacctccaacaccaacatgtgcgccgtgattgacgggaactc aacgaccttcgaacaccagcagccgttgcaagaccggatgttcaaatttg aactcaccgccgtctggatcatgacttgggaaggtcaccaagcaggaa gtcaaagacttttccggtgggcaaaggatcacgtggttgaggtggagca tgaattctacgtcaaaaagggtggagccaagaaaagaccccccccagtg acgcagatataagtgagcccaaacgggtgcgcgagtcagttgcgcagcca tcgacgtcagacgcggaagcttcgatcaactacgcagacaggtaccaaaa caaatgttctcgtcacgtgggcatgaatctgatgctgtttccctgcagac aatgcgagagaatgaatcagaattcaaatatctgcttcactcacggacag aaagactgtttagagtgctttcccgtgtcagaatctcaacccgtttctgt cgtcaaaaaggcgtatcagaaactgtgctacattcatcatatcatgggaa aggtgccagacgcttgcactgcctgcgatctggtcaatgtggatttggat gactgcatctttgaacaataaatgatttaaatcaggtatggctgccgatg gttatcttccagattggctcgaggacaacctctctgagggcattcgcgag |

TABLE 12-continued

AAV6 Mutant Plasmid vector sequences

| SEQ ID NO | Construct | Sequence |
|---|---|---| tggtgggacttgaaacctggagccccgaaacccaaagccaaccagcaaaa
gcaggacgacggccggggtctggtgcttcctggctacaagtacctcggac
ccttcaacggactcgacaaggggagcccgtcaacgcggcggatgcagcg
gccctcgagcacgacaaggcctacgaccagcagctcaaagcgggtgacaa
tccgtacctgcggtataaccacgccgacgccgagtttcaggagcgtctgc
aagaagatacgtcttttgggggcaacctcgggcgagcagtcttccaggcc
aagaagagggttctcgaaccttttggtctggttgaggaaggtgctaagac
ggctcctggaaagaaacgtccggtagagcagtcgccacaagagccagact
cctcctcgggcattggcaagacaggccagcagcccgctaaaaagagactc
aattttggtcagactggcgactcagagtcagtccccgacccacaacctct
cggagaacctccagcaaccccccgctgctgtgggacctactacaatggctt
caggcggtggcgcaccaatggcagacaataacgaaggcgccgacggagtg
ggtaatgcctcaggaaattggcattgcgattccacatggctgggcgacag
agtcatcaccaccagcacccgaacatgggccttgcccacctataacaacc
acctctacaagcaaatctccagtgcttcaacggggccagcaacgacaac
cactacttcggctacagcacccctgggggtattttgatttcaacagatt
ccactgccatttctcaccacgtgactggcagcgactcatcaacaacaatt
ggggattccggcccaagagactcaacttcaagctcttcaacatccaagtc
aaggaggtcacgacgaatgatggcgtcacgaccatcgctaataaccttac
cagcacggttcaagtcttctcggactcggagtaccagttgccgtacgtcc
tcggctctgcgcaccagggctgcctccctccgttcccggcggacgtgttc
atgattccgcagtacggctacctaacgctcaacaatggcagcaggcagt
gggacggtcatccttttactgcctggaatatttcccatcgcagatgctga
gaacgggcaataactttaccttcagctacaccttcgaggacgtgccttt
cacagcagctacgcgcacagccagagcctggaccggctgatgaatcctct
catcgaccagtacctgtattacctgaacagaactcagaatcagtccggaa
gtgcccaaaacaaggacttgctgtttagccggggggtctccagctggcatg
tctgttcagcccaaaaactggctacctggaccctgttaccggcagcagcg
cgtttctaaaacaaaaacagacaacaacaacagcaactttacctggactg
gtgcttcaaaatataaccttaatgggcgtgaatctataatcaaccctggc
actgctatggcctcacacaaagacgacaaagacaagttctttcccatgag
cggtgtcatgattttttggaaaggagagcgccggagcttcaaacactgcat
tggacaatgtcatgatcacagacgaagaggaaatcaaagccactaacccc
gtggccaccgaaagatttgggactgtggcagtcaatctccagagcagcag
cacagaccctgcgaccggagatgtgcatgttatgggagccttacctggaa
tggtgtggcaagacagagacgtatacctgcagggtcctatttgggccaaa
attcctcacacggatggacactttcacccgtctcctctcatgggcggctt
tggacttaagcacccgcctcctcagatcctcatcaaaaacacgcctgttc
ctgcgaatcctccggcagagttttcggctacaaagtttgcttcattcatc
acccagtattccacaggacaagtgagcgtggagattgaatgggagctgca
gaaagaaaacagcaaacgctggaatcccgaagtgcagtatacatctaact
atgcaaaatctgccaacgttgatttcactgtggacaacaatggactttat
actgagcctcgcccattggcacccgttacctcacccgtcccctgtaatt
gtgtgttaatcaataaaccggttgattcgtttcagttgaactttggtctc
tgcgaagggcgaattcgtttaaacctgcaggactagaggtcctgtattag
aggtcacgtgagtgttttgcgacattttgcgacaccatgtggtcacgctg
ggtatttaagcccgagtgagcacgcagggtctccattttgaagcgggagg
tttgaacgcgcagccgccaagccgaattctgcagatatccatcacactgg
cggccgctcgactagagcggccgccaccgcggtggagctccagcttttgt
tccctttagtgagggttaattgcgcgcttggcgtaatcatggtcatagct
gtttcctgtgtgaaattgttatccgctcacaattccacacaacatacgag
ccgaagcataaagtgtaaagcctggggtgcctaatgagtgagctaactc
acattaattgcgttgcgctcactgcccgctttccagtcgggaaacctgtc
gtgccagctgcattaatgaatcggccaacgcgcggggagaggcggtttgc
gtattgggcgctcttccgcttcctcgctcactgactcgctgcgctcggtc
gttcggctgcggcgagcggtatcagctcactcaaaggcggtaatacggtt
atccacagaatcaggggataacgcaggaaagaacatgtgagcaaaaggcc
agcaaaaggccaggaaccgtaaaaaggccgcgttgctggcgtttttccat
aggctccgcccccctgacgagcatcacaaaaatcgacgctcaagtcagag
gtggcgaaacccgacaggactataaagataccaggcgtttccccctggaa
gctccctcgtgcgctctcctgttccgaccctgccgcttaccggatacctg
tccgcctttctcccttcgggaagcgtggcgctttctcatagctcacgctg
taggtatctcagttcggtgtaggtcgttcgctccaagctgggctgtgtgc
acgaaccccccgttcagcccgaccgctgcgccttatccggtaactatcgt
cttgagtccaacccggtaagcacgacttatcgccactggcagcagccac
tggtaacaggattagcagagcgaggtatgtaggcggtgctacagagttct
tgaagtggtggcctaactacggctacactagaagaacagtatttggtatc
tgcgctctgctgaagccagttaccttcggaaaaagagttggtagctcttg
atccggcaaacaaaccaccgctggtagcggtggtttttttgtttgcaagc
agcagattacgcgcagaaaaaaaggatctcaagaagatcctttgatcttt
tctacggggtctgacgctcagtggaacgaaaactcacgttaagggatttt
ggtcatgagattatcaaaaaggatcttcacctagatccttttaaattaaa
aatgaagttttaaatcaatctaaagtatatatgagtaaacttggtctgac
agttaccaatgcttaatcagtgaggcacctatctcagcgatctgtctatt

TABLE 12-continued

AAV6 Mutant Plasmid vector sequences

| SEQ ID NO | Construct | Sequence |
|---|---|---|
| | | tcgttcatccatagttgcctgactcccgtcgtgtagataactacgatac
gggagggcttaccatctggcccccagtgctgcaatgataccgcgagaccca
cgctcaccggctccagatttatcagcaataaaccagccagccggaagggc
cgagcgcagaagtggtcctgcaactttatccgcctccatccagtctatta
attgttgccgggaagctagagtaagtagttcgccagttaatagtttgcgc
aacgttgttgccattgctacaggcatcgtggtgtcacgctcgtcgtttgg
tatggcttcattcagctccggttcccaacgatcaaggcgagttacatgat
cccccatgttgtgcaaaaaagcggttagctccttcggtcctccgatcgtt
gtcagaagtaagttggccgcagtgttatcactcatggttatggcagcact
gcataattctcttactgtcatgccatccgtaagatgcttttctgtgactg
gtgagtactcaaccaagtcattctgagaatagtgtatgcggcgaccgagt
tgctcttgcccggcgtcaatacgggataataccgcgccacatagcagaac
tttaaaagtgctcatcattggaaaacgttcttcggggcgaaaactctcaa
ggatcttaccgctgttgagatccagttcgatgtaacccactcgtgcaccc
aactgatcttcagcatcttttactttcaccagcgtttctgggtgagcaaa
aacaggaaggcaaaatgccgcaaaaaagggaataagggcgacacggaaat
gttgaatactcatactcttcctttttcaatattattgaagcatttatcag
ggttattgtctcatgagcggatacatatttgaatgtatttagaaaaataa
acaaataggggttccgcgcacatttccccgaaaagtgccacctaaattgt
aagcgttaatattttgttaaaattcgcgttaaattttgttaaatcagct
cattttttaaccaataggccgaaatcggcaaaatcccttataaatcaaaa
gaatagaccgagatagggttgagtgttgttccagtttggaacaagagtcc
actattaaagaacgtggactccaacgtcaaagggcgaaaaaccgtctatc
agggcgatggcccactacgtgaaccatcaccctaatcaagttttttgggg
tcgaggtgccgtaaagcactaaatcggaaccctaaagggagcccccgatt
tagagcttgacggggaaagccggcgaacgtggcgagaaaggaagggaaga
aagcgaaaggagcgggcgctagggcgctggcaagtgtagcggtcacgctg
cgcgtaaccaccacacccgccgcgcttaatgcgccgctacagggcgcgtc
ccattcgccattcaggctgcgcaactgttgggaagggcgatcggtgcggg
cctcttcgctattacgccagctggcgaaaggggatgtgctgcaaggcga
ttaagttgggtaacgccagggttttcccagtcacgacgttgtaaaacgac
ggccagtgagcgcgcgtaatacgactcactatagggcgaattgggtaccg
ggccccccctcgatcgaggtcgacggtatcggggggagctcgcagggtctc
cattttgaagcgggaggtttgaacgcgcag |
| 196 | 17AALHVC_ AAV6_F129L_ pAAV-DJ | ccgccatgccggggttttacgagattgtgattaaggtccccagcgaccttt
gacgagcatctgcccggcatttctgacagctttgtgaactgggtggccga
gaaggaatgggagttgccgccagattctgcatggatctgaatctgattg
agcaggcaccccctgaccgtggccgagaagctgcagcgcgactttctgacg
gaatggcgccgtgtgagtaaggccccggaggccctttctttgtgcaatt
tgagaagggagagagctacttccacatgcacgtgctcgtggaaaccaccg
gggtgaaatccatggttttgggacgtttcctgagtcagattcgcgaaaaa
ctgattcagagaatttaccgcgggatcgagccgactttgccaaactggtt
cgcggtcacaaagaccagaaatggcgccggaggcgggaacaaggtggtgg
atgagtgctacatccccaattacttgctccccaaaacccagcctgagctc
cagtgggcgtggactaatatggaacagtatttaagcgcctgtttgaatct
cacggagcgtaaacggttggtggcgcagcatctgacgcacgtgtcgcaga
cgcaggagcagaacaaagagaatcagaatcccaattctgatgcgccggtg
atcagatcaaaaacttcagccaggtacatggagctggtcgggtggctcgt
ggacaaggggattacctcggagaagcagtggatccaggaggaccaggcct
catacatctccttcaatgcggcctccaactcgcggtcccaaatcaaggct
gccttggacaatgcgggaaagattatgagcctgactaaaaccgcccccga
ctacctggtgggccagcagcccgtggaggacatttccagcaatcggattt
ataaaattttggaactaaacgggtacgatcccaatatgcggcttccgtc
tttctgggatggccacgaaaaagttcggcaagaggaacaccatctggct
gtttgggcctgcaactaccgggaagaccaacatcgcggaggccatagccc
acactgtgcccttctacgggtgcgtaaactggaccaatgagaactttccc
ttcaacgactgtgtcgacaagatggtgatctggtgggaggaggggaagat
gaccgccaaggtcgtggagtcggccaaagccattctcggaggaagcaagg
tgcgcgtggaccagaaatgcaagtcctcggcccagatagacccgactccc
gtgatcgtcacctccaacaccaacatgtgcgccgtgattgacgggaactc
aacgaccttcgaacaccagcagccgttgcaagaccggatgttcaaatttg
aactcacccgccgtctggatcatgactttgggaaggtcaccaagcaggaa
gtcaaagacttttttccggtgggcaaggatcacgtggttgaggtggagca
tgaattctacgtcaaaaagggtggagccaagaaaagaccccgccccagtg
acgcagatataagtgagcccaaacgggtgcgcgagtcagttgcgcagcca
tcgacgtcagacgcggaagcttcgatcaactacgcagacaggtaccaaaa
caaatgttctcgtcacgtgggcatgaatctgatgctgtttcctgcagac
aatgcgagagaatgaatcagaattcaaatatctgcttcactcacggacag
aaagactgtttagagtgctttcccgtgtcagaatctcaacccgtttctgt
cgtcaaaaaggcgtatcagaaactgtgctacattcatcatatcatgggaa
aggtgccagacgcttgcactgcctgcgatctggtcaatgtggatttggat
gactgcatctttgaacaataaaatgatttaaatcaggtatggctgccgatg
gttatcttccagattggctcgaggacaacctctctgagggcattcgcgag |

TABLE 12-continued

AAV6 Mutant Plasmid vector sequences

| SEQ ID NO | Construct | Sequence |
|---|---|---|
| | | tggtgggacttgaaacctggagccccgaaacccaaagccaaccagcaaaa
gcaggacgacggccggggtctggtgcttcctggctacaagtacctcggac
ccttcaacggactcgacaagggggagcccgtcaacgcggcggatgcagcg
gccctcgagcacgacaaggcctacgaccagcagctcaaagcgggtgacaa
tccgtacctgcggtataaccacgccgacgccgagtttcaggagcgtctgc
aagaagatacgtcttttgggggcaacctcgggcgagcagtcttccaggcc
aagaagagggttctcgaacctttaggtctggttgaggaaggtgctaagac
ggctcctggaaagaaacgtccggtagagcagtcgccacaagagccagact
cctcctcgggcattggcaagacaggccagcagcccgctaaaaagagactc
aattttggtcagactggcgactcagagtcagtcccgacccacaacctct
cggagaacctccagcaaccccgctgctgtgggacctactacaatggctt
caggcggtggcgcaccaatggcagacaataacgaaggcgccgacggagtg
ggtaatgcctcaggaaattggcattgcgattccacatggctgggcgacag
agtcatcaccaccagcacccgaacatgggccttgcccacctataacaacc
acctctacaagcaaatctccagtgcttcaacgggggccagcaacgacaac
cactacttcggctacagcaccccctgggggtattttgatttcaacagatt
ccactgccatttctcaccacgtgactggcagcgactcatcaacaacaatt
ggggattccggcccaagagactcaacttcaagctcttcaacatccaagtc
aaggaggtcacgacgaatgatggcgtcacgaccatcgctaataaccttac
cagcacggttcaagtcttctcggactcggagtaccagttgccgtacgtcc
tcggctctgcgcaccagggctgcctccctccgttcccggcggacgtgttc
atgattccgcagtacggctacctaacgctcaacaatggcagcaggcagt
gggacggtcatccttttactgcctggaatatttcccatcgcagatgctga
gaacgggcaataactttaccttcagctacaccttcgaggacgtgcctttc
cacagcagctacgcgcacagccagagcctggaccggctgatgaatcctct
catcgaccagtcctgtattacctgaacagaactcagaatcagtccggaa
gtgcccaaaacaaggacttgctgtttagccgggggtctccagctggcatg
tctgttcagcccaaaaactggctacctggaccctgttaccggcagcagcg
cgtttctaaaacaaaaacagacaacaacaacagcaactttacctggactg
gtgcttcaaaatataaccttaatgggcgtgaatctataatcaaccctggc
actgctatggcctcacacaaagacgacaaagacaagttctttcccatgag
cggtgtcatgattttttggaaaggagagcgccggagcttcaaacactgcat
tggacaatgtcatgatcacagacgaagaggaaatcaaagccactaacccc
gtggccaccgaaagatttgggactgtggcagtcaatctccagagcagcag
cacagaccctgcgaccggagatgtgcatgttatgggagccttacctggaa
tggtgtggcaagacagagacgtatacctgcagggtcctattgggccaaa
attcctcacacggatggacactttcacccgtctcctctcatgggcggctt
tggacttaagcacccgcctcctcagatcctcatcaaaaacacgcctgttc
ctgcgaatcctccggcagagttttcggctacaaagtttgcttcattcatc
acccagtattccacaggacaagtgagcgtggagattgaatgggagctgca
gaaagaaaacagcaaacgctggaatcccgaagtgcagtatacatctaact
atgcaaaatctgccaacgttgatttcactgtggacaacaatggactttat
actgagcctcgcccattggcacccgttacctcacccgtccctgtaatt
gtgtgttaatcaataaaccggttgattcgtttcagttgaactttggtctc
tgcgaagggcgaattcgtttaaacctgcaggactagaggtcctgtattag
aggtcacgtgagtgttttgcgacattttgcgacaccatgtggtcacgctg
ggtatttaagcccgagtgagcacgcagggtctccattttgaagcgggagg
tttgaacgcgcagccgccaagccgaattctgcagatatccatcacactgg
cggccgctcgactagagcggccgccaccgcggtggagctccagcttttgt
tcccttttagtgagggttaattgcgcgcttggcgtaatcatggtcatagct
gtttcctgtgtgaaattgttatccgctcacaattccacacaacatacgag
ccggaagcataaagtgtaaagcctggggtgcctaatgagtgagctaactc
acattaattgcgttgcgctcactgcccgctttccagtcgggaaacctgtc
gtgccagctgcattaatgaatcggccaacgcgcggggagaggcggtttgc
gtattgggcgctcttccgcttcctcgctcactgactcgctgcgctcggtc
gttcggctgcggcgagcggtatcagctcactcaaaggcggtaatacggtt
atccacagaatcaggggataacgcaggaaagaacatgtgagcaaaaggcc
agcaaaaggccaggaaccgtaaaaaggccgcgttgctggcgtttttccat
aggctccgcccccctgacgagcatcacaaaaatcgacgctcaagtcagag
gtggcgaaacccgacaggactataaagataccaggcgtttccccctggaa
gctccctcgtgcgctctcctgttccgaccctgccgcttaccggatacctg
tccgcctttctcccttcgggaagcgtggcgctttctcatagctcacgctg
taggtatctcagttcggtgtaggtcgttcgctccaagctgggctgtgtgc
acgaaccccccgttcagcccgaccgctgcgccttatccggtaactatcgt
cttgagtccaacccggtaagacacgacttatcgccactggcagcagccac
tggtaacaggattagcagagcgaggtatgtaggcggtgctacagagttct
tgaagtggtggcctaactacggctacactagaagaacagtatttggtatc
tgcgctctgctgaagccagttaccttcggaaaaagagttggtagctcttg
atccggcaaacaaaccaccgctggtagcggtggtttttttgtttgcaagc
agcagattacgcgcagaaaaaaaggatctcaagaagatcctttgatcttt
tctacggggtctgacgctcagtggaacgaaaactcacgttaagggattttt
ggtcatgagattatcaaaaaggatcttcacctagatccttttaaattaaa
aatgaagttttaaatcaatctaaagtatatatgagtaaacttggtctgac
agttaccaatgcttaatcagtgaggcacctatctcagcgatctgtctatt |

TABLE 12-continued

AAV6 Mutant Plasmid vector sequences

| SEQ ID NO | Construct | Sequence |
|---|---|---|
| | | tcgttcatccatagttgcctgactcccgtcgtgtagataactacgatac<br>gggagggcttaccatctggcccagtgctgcaatgataccgcgagaccca<br>cgctcaccggctccagatttatcagcaataaaccagccagccggaagggc<br>cgagcgcagaagtggtcctgcaactttatccgcctccatccagtctatta<br>attgttgccgggaagctagagtaagtagttcgccagttaatagtttgcgc<br>aacgttgttgccattgctacaggcatcgtggtgtcacgctcgtcgtttgg<br>tatggcttcattcagctccggttcccaacgatcaaggcgagttacatgat<br>cccccatgttgtgcaaaaaagcggttagctccttcggtcctccgatcgtt<br>gtcagaagtaagttggccgcagtgttatcactcatggttatggcagcact<br>gcataattctcttactgtcatgccatccgtaagatgcttttctgtgactg<br>gtgagtactcaaccaagtcattctgagaatagtgtatgcggcgaccgagt<br>tgctcttgcccggcgtcaatacgggataataccgcgccacatagcagaac<br>tttaaaagtgctcatcattggaaaacgttcttcggggcgaaaactctcaa<br>ggatcttaccgctgttgagatccagttcgatgtaacccactcgtgcaccc<br>aactgatcttcagcatcttttactttcaccagcgtttctgggtgagcaaa<br>aacaggaaggcaaaatgccgcaaaaaagggaataagggcgacacggaaat<br>gttgaatactcatactcttcctttttcaatattattgaagcatttatcag<br>ggttattgtctcatgagcggatacatatttgaatgtatttagaaaaataa<br>acaaatagggtccgcgcacatttccccgaaaagtgccacctaaattgt<br>aagcgttaatattttgttaaaattcgcgttaaattttgttaaatcagct<br>catttttaaccaataggccgaaatcggcaaaatcccttataaatcaaaa<br>gaatagaccgagatagggttgagtgttgttccagtttggaacaagagtcc<br>actattaaagaacgtggactccaacgtcaaagggcgaaaaaccgtctatc<br>agggcgatggcccactacgtgaaccatcaccctaatcaagttttttgggg<br>tcgaggtgccgtaaagcactaaatcggaaccctaaagggagcccccgatt<br>tagagcttgacggggaaagccggcgaacgtggcgagaaaggaagggaaga<br>aagcgaaaggagcgggcgctagggcgctggcaagtgtagcggtcacgctg<br>cgcgtaaccaccacacccgccgcgcttaatgcgccgctacagggcgcgtc<br>ccattcgccattcaggctgcgcaactgttgggaagggcgatcggtgcggg<br>cctcttcgctattacgccagctggcgaaaggggatgtgctgcaaggcga<br>ttaagttgggtaacgccagggttttcccagtcacgacgttgtaaaacgac<br>ggccagtgagcgcgcgtaatacgactcactatagggcgaattgggtaccg<br>ggccccccctcgatcgaggtcgacggtatcggggggagctcgcagggtctc<br>catttttgaagcgggaggtttgaacgcgcag |
| 197 | 17AALHWC_<br>AAV6_D418E_<br>pAAV-DJ | ccgccatgccggggttttacgagattgtgattaaggtccccagcgaccbtt<br>gacgagcatctgcccggcatttctgacagctttgtgaactgggtggccga<br>gaaggaatgggagttgccgccagattctgcatggatctgaatctgattg<br>agcaggcacccctgaccgtggccgagaagctgcagcgcgactttctgacg<br>gaatggcgccgtgtgagtaaggcccccggaggccctttctttgtgcaatt<br>tgagaagggagagagctacttccacatgcacgtgctcgtggaaaccaccg<br>gggtgaaatccatggttttgggacgtttcctgagtcagattcgcgaaaaa<br>ctgattcagagaatttaccgcgggatcgagccgactttgccaaactggtt<br>cgcggtcacaaagaccagaaatggcgccggaggcgggaacaaggtggtgg<br>atgagtgctacatccccaattacttgctcccccaaaacccagcctgagctc<br>cagtgggcgtggactaatatggaacagtatttaagcgcctgtttgaatct<br>cacggagcgtaaacggttggtggcgcagcatctgacgcacgtgtcgcaga<br>cgcaggagcagaacaaagagaatcagaatcccaattctgatgcgccggtg<br>atcagatcaaaaacttcagccaggtacatggagctggtcgggtggctcgt<br>ggacaaggggattacctcggagaagcagtggatccaggaggaccaggcct<br>catacatctccttcaatgcggcctccaactcgcggtcccaaatcaaggct<br>gccttggacaatgcgggaaagattatgagcctgactaaaaccgcccccga<br>ctacctggtgggccagcagcccgtggaggacatttccagcaatcggattt<br>ataaaattttggaactaaacgggtacgatccccaatatgcggcttccgtc<br>tttctgggatgggccacgaaaaagttcggcaagaggaacaccatctggct<br>gtttgggcctgcaactaccgggaagaccaacatcgcggaggccatagccc<br>acactgtgccctctactggtgcgtaaactggaccaatgagaactttccc<br>ttcaacgactgtgtcgacaagatggtgatctggtgggaggaggggaagat<br>gaccgccaaggtcgtggagtcggccaaagccattctcggaggaagcaagg<br>tgcgcgtggaccagaaatgcaagtcctcggcccagatagaccccgactccc<br>gtgatcgtcacctccaacaccaacatgtgcgccgtgattgacgggaactc<br>aacgacctcgaacaccagcagccgttgcaagaccggatgttcaaatttg<br>aactcacccgccgtctggatcatgactttgggaaggtcaccaagcaggaa<br>gtcaaagacttttccggtgggcaaaggatcacgtggttgaggtggagca<br>tgaattctacgtcaaaaagggtggagccaagaaaagacccgcccccagtg<br>acgcagatataagtgagcccaaacgggtgcgcgagtcagttgcgcagcca<br>tcgacgtcagacgcggaagcttcgatcaactacgcagacaggtaccaaaa<br>caaatgttctcgtcacgtgggcatgaatctgatgctgtttccctgcagac<br>aatgcgagagaatgaatcagaattcaaatatctgcttcactcacgacag<br>aaagactgtttagagtgcttccccgtgtcagaatctcaacccgtttctgt<br>cgtcaaaaagcgtatcagaaactgtgctacattcatcatatcatgggaa<br>aggtgccagacgcttgcactgcctgcgatctggtcaatgtggatttggat<br>gactgcatctttgaacaataaatgatttaaatcaggtatggctgccgatg<br>gttatcttccagattggctcgaggacaacctctctgagggcattcgcgag |

TABLE 12-continued

AAV6 Mutant Plasmid vector sequences

| SEQ ID NO | Construct | Sequence |
|---|---|---|
| | | tggtgggacttgaaacctggagccccgaaacccaaagccaaccagcaaaa gcaggacgacggccggggtctggtgcttcctggctacaagtacctcggac ccttcaacggactcgacaaggggggagcccgtcaacgcggcggatgcagcg gccctcgagcacgacaaggcctacgaccagcagctcaaagcgggtgacaa tccgtacctgcggtataaccacgccgacgccgagtttcaggagcgtctgc aagaagatacgtcttttggggcaacctcgggcgagcagtcttccaggcc aagaagagggttctcgaacctttggtctggttgaggaaggtgctaagac ggctcctggaaagaaacgtccggtagagcagtcgccacaagagccagact cctcctcgggcattggcaagacaggccagcagcccgctaaaaagagactc aatttggtcagactggcgactcagagtcagtccccgacccacaacctct cggagaacctccagcaacccccgctgctgtgggacctactacaatggctt caggcggtggcgcaccaatggcagacaataacgaaggcgccgacggagtg ggtaatgcctcaggaaattggcattgcgattccacatggctgggcgacag agtcatcaccaccagcacccgaacatgggccttgcccacctataacaacc acctctacaagcaaatctccagtgcttcaacggggccagcaacgacaac cactacttcggctacagcaccccctgggggtattttgatttcaacagatt ccactgccatttctcaccacgtgactggcagcgactcatcaacaacaatt ggggattccggcccaagagactcaacttcaagctcttcaacatccaagtc aaggaggtcacgacgaatgatggcgtcacgaccatcgctaataaccttac cagcacggttcaagtcttctcggactcggagtaccagttgccgtacgtcc tcggctctgcgcaccagggctgcctccctccgttcccggcggacgtgttc atgattccgcagtacggctacctaacgctcaacaatggcagccaggcagt gggacggtcatccttttactgcctggaatatttcccatcgcagatgctga gaacgggcaataactttaccttcagctacaccttcgaggaggtgccttc cacagcagctacgcgcacagccagagcctggaccggctgatgaatcctct catcgaccagtacctgtattacctgaacagaactcagaatcagtccggaa gtgcccaaaacaaggacttgctgtttagccgggggtctccagctggcatg tctgttcagcccaaaaactggctacctggaccctgttaccggcagcagcg cgtttctaaaacaaaaacagacaacaacaacagcaactttacctggactg gtgcttcaaaatataaccttaatgggcgtgaatctataatcaaccctggc actgctatggcctcacacaaagacgacaaagacaagttctttcccatgag cggtgtcatgattttggaaaggagagcgccggagcttcaaacactgcat tggacaatgtcatgatcacagacgaagaggaaatcaaagccactaacccc gtggccaccgaaagatttgggactgtggcagtcaatctccagagcagcag cacagaccctgcgaccggagatgtgcatgttatgggagccttacctggaa tggtgtggcaagacagagacgtatacctgcagggtcctattgggccaaa attcctcacacggatggacacttcacccgtctcctctcatgggcggctt tggacttaagcacccgcctcctcagatcctcatcaaaaacacgctgttc ctgcgaatcctccggcagagttttcggctacaaagtttgcttcattcatc acccagtattccacaggacaagtgagcgtggagattgaatgggagctgca gaaagaaaacagcaaacgctggaatcccgaagtgcagtatacatctaact atgcaaaatctgccaacgttgatttcactgtggacaacaatggacttat actgagcctcgccccattggcacccgttacctcacccgtcccctgtaatt gtgtgttaatcaataaaccggttgattcgtttcagttgaactttggtctc tgcgaagggcgaattcgtttaaacctgcaggactagaggtcctgtattag aggtcacgtgagtgttttgcgacattttgcgacaccatgtggtcacgctg ggtatttaagcccgagtgagcacgcagggtctccatttgaagcgggagg tttgaacgcgcagccgccaagccgaattctgcagatatccatcacactgg cggccgctcgactagagcggccgccaccgcggtggagctccagcttttgt tccctttagtgagggttaattgcgcgcttggcgtaatcatggtcatagct gtttcctgtgtgaaattgttatccgctcacaattccacacaacatacgag ccggaagcataaagtgtaaagcctggggtgcctaatgagtgagctaactc acattaattgcgttgcgctcactgcccgctttccagtcgggaaacctgtc gtgccagctgcattaatgaatcggccaacgcgcggggagaggcggtttgc gtattgggcgctcttccgcttcctcgctcactgactcgctgcgctcggtc gttcggctgcggcgagcggtatcagctcactcaaaggcggtaatacggtt atccacagaatcaggggataacgcaggaaagaacatgtgagcaaaaggcc agcaaaaggccaggaaccgtaaaaaggccgcgttgctggcgtttttccat aggctccgcccccctgacgagcatcacaaaaatcgacgctcaagtcagag gtggcgaaacccgacaggactataaagataccaggcgtttccccctggaa gctccctcgtgcgctctcctgttccgaccctgccgcttaccggatacctg tccgcctttctcccttcgggaagcgtggcgctttctcatagctcacgctg taggtatctcagttcggtgtaggtcgttcgctccaagctgggctgtgtgc acgaaccccccgttcagcccgaccgctgcgccttatccggtaactatcgt cttgagtccaacccggtaagacacgacttatcgccactggcagcagccac tggtaacaggattagcagagcgaggtatgtaggcggtgctacagagttct tgaagtggtggcctaactacggctacactagaagaacagtatttggtatc tgcgctctgctgaagccagttaccttcggaaaaagagttggtagctcttg atccggcaaacaaaccaccgctggtagcggtggtttttttgtttgcaagc agcagattacgcgcagaaaaaaaggatctcaagaagatcctttgatcttt tctacggggtctgacgctcagtggaacgaaaactcacgttaagggatttt ggtcatgagattatcaaaaaggatcttcacctagatccttttaaattaaa aatgaagttttaaatcaatctaaagtatatatgagtaaacttggtctgac agttaccaatgcttaatcagtgaggcacctatctcagcgatctgtctatt |

TABLE 12-continued

AAV6 Mutant Plasmid vector sequences

| SEQ ID NO | Construct | Sequence |
|---|---|---|
| | | tcgttcatccatagttgcctgactcccgtcgtgtagataactacgatac<br>gggagggcttaccatctggcccagtgctgcaatgataccgcgagaccca<br>cgctcaccggctccagatttatcagcaataaaccagccagccggaagggc<br>cgagcgcagaagtggtcctgcaactttatccgcctccatccagtctatta<br>attgttgccgggaagctagagtaagtagttcgccagttaatagtttgcgc<br>aacgttgttgccattgctacaggcatcgtggtgtcacgctcgtcgtttgg<br>tatggcttcattcagctccggttcccaacgatcaaggcgagttacatgat<br>cccccatgttgtgcaaaaaagcggttagctccttcggtcctccgatcgtt<br>gtcagaagtaagttggccgcagtgttatcactcatggttatggcagcact<br>gcataattctcttactgtcatgccatccgtaagatgcttttctgtgactg<br>gtgagtactcaaccaagtcattctgagaatagtgtatgcggcgaccgagt<br>tgctcttgcccggcgtcaatacgggataataccgcgccacatagcagaac<br>tttaaaagtgctcatcattggaaaacgttcttcggggcgaaaactctcaa<br>ggatcttaccgctgttgagatccagttcgatgtaacccactcgtgcaccc<br>aactgatcttcagcatcttttactttcaccagcgtttctgggtgagcaaa<br>aacaggaaggcaaaatgccgcaaaaaagggaataagggcgacacggaaat<br>gttgaatactcatactcttccttttcaatattattgaagcatttatcag<br>ggttattgtctcatgagcggatacatatttgaatgtatttagaaaaataa<br>acaaataggggttccgcgcacatttccccgaaaagtgccacctaaattgt<br>aagcgttaatattttgttaaaattcgcgttaaattttgttaaatcagct<br>cattttttaaccaataggccgaaatcggcaaaatcccttataaatcaaaa<br>gaatagaccgagatagggttgagtgttgttccagtttggaacaagagtcc<br>actattaaagaacgtggactccaacgtcaaagggcgaaaaaccgtctatc<br>agggcgatggcccactacgtgaaccatcaccctaatcaagttttttgggg<br>tcgaggtgccgtaaagcactaaatcggaaccctaaagggagcccccgatt<br>tagagcttgacggggaaagccggcgaacgtggcgagaaaggaagggaaga<br>aagcgaaaggagcgggcgctagggcgctggcaagtgtagcggtcacgctg<br>cgcgtaaccaccacacccgccgcgcttaatgcgccgctacagggcgcgtc<br>ccattcgccattcaggctgcgcaactgttgggaagggcgatcggtgcggg<br>cctcttcgctattacgccagctggcgaaaggggatgtgctgcaaggcga<br>ttaagttgggtaacgccagggttttcccagtcacgacgttgtaaaacgac<br>ggccagtgagcgcgcgtaatacgactcactatagggcgaattgggtaccg<br>ggccccccctcgatcgaggtcgacggtatcggggggagctcgcagggtctc<br>cattttgaagcgggaggtttgaacgcgcag |
| 198 | 17AALHXC_<br>AAV6_D418N_<br>pAAV-DJ | ccgccatgccggggttttacgagattgtgattaaggtccccagcgaccttt<br>gacgagcatctgcccggcatttctgacagctttgtgaactgggtggccga<br>gaaggaatgggagttgccgccagattctgcatggatctgaatctgattg<br>agcaggcaccctgaccgtggccgagaagctgcagcgcgactttctgacg<br>gaatggcgccgtgtgagtaaggcccggaggccctttctttgtgcaatt<br>tgagaagggagagagctacttccacatgcacgtgctcgtggaaaccaccg<br>gggtgaaatccatggttttgggacgtttcctgagtcagattcgcgaaaaa<br>ctgattcagagaatttaccgcgggatcgagccgactttgccaaactggtt<br>cgcggtcacaaagaccagaaatggcgccggaggcgggaacaaggtggtgg<br>atgagtgctacatccccaattacttgctccccaaaacccagcctgagctc<br>cagtgggcgtggactaatatggaacagtatttaagcgcctgtttgaatct<br>cacggagcgtaaacggttggtggcgcagcatctgacgcacgtgtcgcaga<br>cgcaggagcagaacaaagagaatcagaatcccaattctgatgcgccggtg<br>atcagatcaaaaacttcagccaggtacatggagctggtcgggtggctcgt<br>ggacaaggggattacctcggagaagcagtggatccaggaggaccaggcct<br>catacatctccttcaatgcggcctccaactcgcggtcccaaatcaaggct<br>gccttggacaatgcgggaaagattatgagcctgactaaaaccgcccccga<br>ctacctggtgggccagcagcccgtggaggacatttccagcaatcggattt<br>ataaaattttggaactaaacgggtacgatccccaatatgcggcttccgtc<br>tttctgggatgggccacgaaaaagttcggcaagaggaacaccatctggct<br>gtttgggcctgcaactaccgggaagaccaacatcgcggaggccatagccc<br>acactgtgcccttctacgggtgcgtaaactggaccaatgagaactttccc<br>ttcaacgactgtgtcgacaagatggtgatctggtgggaggaggggaagat<br>gaccgccaaggtcgtggagtcggccaaagccattctcggaggaagcaagg<br>tgcgcgtggaccagaaatgcaagtcctcggcccagatagacccgactccc<br>gtgatcgtcacctccaacaccaacatgtgcgccgtgattgacgggaactc<br>aacgaccttcgaacaccagcagccgttgcaagaccggatgttcaaatttg<br>aactcacccgccgtctggatcatgactttgggaaggtcaccaagcaggaa<br>gtcaaagacttttttccggtgggcaaaggatcacgtggttgaggtggagca<br>tgaattctacgtcaaaaagggtggagccaagaaaaagaccccgccccagtg<br>acgcagatataagtgagcccaaacgggtgcgcgagtcagttgcgcagcca<br>tcgacgtcagacgcggaagcttcgatcaactacgcagacaggtaccaaaa<br>caaatgttctcgtcacgtgggcatgaatctgatgctgtttccctgcagac<br>aatgcgagagaatgaatcagaattcaaatatctgcttcactcacggacag<br>aaagactgtttagagtgctttcccgtgtcagaatctcaacccgtttctgt<br>cgtcaaaaaggcgtatcagaaactgtgctacattcatcatatcatgggaa<br>aggtgccagacgcttgcactgcctgcgatctggtcaatgtggatttggat<br>gactgcatctttgaacaataaaatgatttaaatcaggtatggctgccgatg<br>gttatcttccagattggctcgaggacaacctctctgagggcattcgcgag |

TABLE 12-continued

AAV6 Mutant Plasmid vector sequences

| SEQ ID NO | Construct | Sequence |
|---|---|---|
| | | tggtgggacttgaaacctggagccccgaaacccaaagccaaccagcaaaa
gcaggacgacggccggggtctggtgcttcctggctacaagtacctcggac
ccttcaacggactcgacaaggggggagcccgtcaacgcggcggatgcagcg
gccctcgagcacgacaaggcctacgaccagcagctcaaagcgggtgacaa
tccgtacctgcggtataaccacgccgacgccgagtttcaggagcgtctgc
aagaagatacgtcttttgggggcaacctcgggcgagcagtcttccaggcc
aagaagagggttctcgaacctttggtctggttgaggaaggtgctaagac
ggctcctggaaagaaacgtccggtagagcagtcgccacaagagccagact
cctcctcgggcattggcaagacaggccagcagcccgctaaaaagagactc
aatttggtcagactggcgactcagagtcagtccccgacccacaacctct
cggagaacctccagcaaccccgctgctgtgggacctactacaatggctt
caggcggtggcgcaccaatggcagacaataacgaaggcgccgacggagtg
ggtaatgcctcaggaaattggcattgcgattccacatggctgggcgacag
agtcatcaccaccagcacccgaacatgggccttgcccacctataacaacc
acctctacaagcaaatctccagtgcttcaacgggggccagcaacgacaac
cactacttcggctacagcaccccctgggggtattttgatttcaacagatt
ccactgccatttctcaccacgtgactggcagcgactcatcaacaacaatt
ggggattccggcccaagagactcaacttcaagctcttcaacatccaagtc
aaggaggtcacgacgaatgatggcgtcacgaccatcgctaataaccttac
cagcacggttcaagtcttctcggactcggagtaccagttgccgtacgtcc
tcggctctgcgcaccagggctgcctccctccgttcccggcggacgtgttc
atgattccgcagtacggctacctaacgctcaacaatggcagccaggcagt
gggacggtcatccttttactgcctggaatatttcccatcgcagatgctga
gaacgggcaataactttaccttcagctacaccttcgagaacgtgcctttc
cacagcagctacgcgcacagccagagcctggaccggctgatgaatcctct
catcgaccagtcctgtattacctgaacagaactcagaatcagtccggaa
gtgcccaaaacaaggacttgctgtttagccgggggtctccagctggcatg
tctgttcagcccaaaaactggctacctggaccctgttaccggcagcagcg
cgtttctaaaacaaaaacagacaacaacaacagcaactttacctggactg
gtgcttcaaaatataaccttaatgggcgtgaatctataatcaaccctggc
actgctatggcctcacacaaagacgacaaagacaagttctttcccatgag
cggtgtcatgatttttggaaaggagagcgccggagcttcaaacactgcat
tggacaatgtcatgatcacagacgaagaggaaatcaaagccactaacccc
gtggccaccgaaagatttgggactgtggcagtcaatctccagagcagcag
cacagaccctgcgaccggagatgtgcatgttatgggagccttacctggaa
tggtgtggcaagacagagacgtatacctgcagggtcctattttgggccaaa
attcctcacacggatggacactttcacccgtctcctctcatgggcggctt
tggacttaagcacccgcctcctcagatcctcatcaaaaacacgcctgttc
ctgcgaatcctccggcagagttttcggctacaaagtttgcttcattcatc
acccagtattccacaggacaagtgagcgtggagattgaatgggagctgca
gaaagaaaacagcaaacgctggaatcccgaagtgcagtatacatctaact
atgcaaaatctgccaacgttgatttcactgtggacaacaatggactttat
actgagcctcgccccattggcacccgttacctcacccgtccctgtaatt
gtgtgttaatcaataaaccggttgattcgtttcagttgaactttggtctc
tgcgaagggcgaattcgtttaaacctgcaggactagaggtcctgtattag
aggtcacgtgagtgttttgcgacattttgcgacaccatgtggtcacgctg
ggtatttaagcccgagtgagcacgcagggtctccattttgaagcgggagg
tttgaacgcgcagccgccaagccgaattctgcagatatccatcacactgg
cggccgctcgactagagcggccgccaccgcggtggagctccagcttttgt
tccctttagtgagggttaattgcgcgcttggcgtaatcatggtcatagct
gtttcctgtgtgaaattgttatccgctcacaattccacacaacatacgag
ccggaagcataaagtgtaaagcctggggtgcctaatgagtgagctaactc
acattaattgcgttgcgctcactgcccgctttccagtcgggaaacctgtc
gtgccagctgcattaatgaatcggccaacgcgcggggagaggcggtttgc
gtattgggcgctcttccgcttcctcgctcactgactcgctgcgctcggtc
gttcggctgcggcgagcggtatcagctcactcaaaggcggtaatacggtt
atccacagaatcaggggataacgcaggaaagaacatgtgagcaaaaggcc
agcaaaaggccaggaaccgtaaaaaggccgcgttgctggcgttttccat
aggctccgcccccctgacgagcatcacaaaaatcgacgctcaagtcagag
gtggcgaaacccgacaggactataaagataccaggcgtttccccctggaa
gctccctcgtgcgctctcctgttccgaccctgccgcttaccggatacctg
tccgcctttctcccttcgggaagcgtggcgctttctcatagctcacgctg
taggtatctcagttcggtgtaggtcgttcgctccaagctgggctgtgtgc
acgaacccccgttcagcccgaccgctgcgccttatccggtaactatcgt
cttgagtccaacccggtaagacacgacttatcgccactggcagcagccac
tggtaacaggattagcagagcgaggtatgtaggcggtgctacagagttct
tgaagtggtggcctaactacggctacactagaagaacagtatttggtatc
tgcgctctgctgaagccagttaccttcggaaaaagagttggtagctcttg
atccggcaaacaaaccaccgctggtagcggtggtttttttgttgcaagc
agcagattacgcgcagaaaaaaaggatctcaagaagatcctttgatctt
tctacggggtctgacgctcagtggaacgaaaactcacgttaagggatttt
ggtcatgagattatcaaaaggatcttcacctagatccttttaaattaaa
aatgaagttttaaatcaatctaaagtatatgagtaaacttggtctgac
agttaccaatgcttaatcagtgaggcacctatctcagcgatctgtctatt |

TABLE 12-continued

AAV6 Mutant Plasmid vector sequences

| SEQ ID NO | Construct | Sequence |
|---|---|---|
| | | tcgttcatccatagttgcctgactcccgtcgtgtagataactacgatac<br>gggagggcttaccatctggccccagtgctgcaatgataccgcgagaccca<br>cgctcaccggctccagatttatcagcaataaaccagccagccggaagggc<br>cgagcgcagaagtggtcctgcaactttatccgcctccatccagtctatta<br>attgttgccgggaagctagagtaagtagttcgccagttaatagtttgcgc<br>aacgttgttgccattgctacaggcatcgtggtgtcacgctcgtcgtttgg<br>tatggcttcattcagctccggttcccaacgatcaaggcgagttacatgat<br>cccccatgttgtgcaaaaaagcggttagctccttcggtcctccgatcgtt<br>gtcagaagtaagttggccgcagtgttatcactcatggttatggcagcact<br>gcataattctcttactgtcatgccatccgtaagatgcttttctgtgactg<br>gtgagtactcaaccaagtcattctgagaatagtgtatgcggcgaccgagt<br>tgctcttgcccggcgtcaatacgggataataccgcgccacatagcagaac<br>tttaaaagtgctcatcattggaaaacgttcttcggggcgaaaactctcaa<br>ggatcttaccgctgttgagatccagttcgatgtaacccactcgtgcaccc<br>aactgatcttcagcatcttttactttcaccagcgtttctgggtgagcaaa<br>aacaggaaggcaaaatgccgcaaaaaagggaataagggcgacacggaaat<br>gttgaatactcatactcttccttttcaatattattgaagcatttatcag<br>ggttattgtctcatgagcggatacatatttgaatgtatttagaaaaataa<br>acaaataggggttccgcgcacatttccccgaaaagtgccacctaaattgt<br>aagcgttaatattttgttaaaattcgcgttaaattttgttaaatcagct<br>cattttttaaccaataggccgaaatcggcaaaatcccttataaatcaaaa<br>gaatagaccgagatagggttgagtgttgttccagtttggaacaagagtcc<br>actattaaagaacgtggactccaacgtcaaagggcgaaaaaccgtctatc<br>agggcgatggcccactacgtgaaccatcaccctaatcaagttttttgggg<br>tcgaggtgccgtaaagcactaaatcggaaccctaaagggagcccccgatt<br>tagagcttgacggggaaagccggcgaacgtggcgagaaaggaagggaaga<br>aagcgaaaggagcgggcgctagggcgctggcaagtgtagcggtcacgctg<br>cgcgtaaccaccacacccgccgcgcttaatgcgccgctacagggcgcgtc<br>ccattcgccattcaggctgcgcaactgttgggaagggcgatcggtgcggg<br>cctcttcgctattacgccagctggcgaaagggggatgtgctgcaaggcga<br>ttaagttgggtaacgccagggttttcccagtcacgacgttgtaaaacgac<br>ggccagtgagcgcgcgtaatacgactcactatagggcgaattgggtaccg<br>ggccccccctcgatcgaggtcgacggtatcggggggagctcgcagggtctc<br>cattttgaagcgggaggtttgaacgcgcag |
| 199 | 17AALHYC_<br>AAV6_L584N_<br>pAAV-DJ | ccgccatgccggggttttacgagattgtgattaaggtccccagcgacctt<br>gacgagcatctgcccggcatttctgacagctttgtgaactgggtggccga<br>gaaggaatgggagttgccgccagattctgcatggatctgaatctgattg<br>agcaggcaccccctgaccgtggccgagaagctgcagcgcgactttctgacg<br>gaatggcgccgtgtgagtaaggcccccggaggcccttttctttgtgcaatt<br>tgagaagggagagagctacttccacatgcacgtgctcgtggaaaccaccg<br>gggtgaaatccatggttttgggacgtttcctgagtcagattcgcgaaaaa<br>ctgattcagagaatttaccgcgggatcgagccgactttgccaaactggtt<br>cgcggtcacaaagaccagaaatggcgccggaggcgggaacaaggtggtgg<br>atgagtgctacatccccaattacttgctccccaaaacccagcctgagctc<br>cagtgggcgtggactaatatggaacagtatttaagcgcctgtttgaatct<br>cacggagcgtaaacggttggtggcgcagcatctgacgcacgtgtcgcaga<br>cgcaggagcagaacaaagagaatcagaatcccaattctgatgcgccggtg<br>atcagatcaaaaacttcagccaggtacatggagctggtcgggtggctcgt<br>ggacaaggggattacctcggagaagcagtggatccaggaggaccaggcct<br>catacatctccttcaatgcggcctccaactcgcggtcccaaatcaaggct<br>gccttggacaatgcgggaaagattatgagcctgactaaaaccgccccga<br>ctacctggtgggccagcagcccgtggaggacatttccagcaatcggattt<br>ataaaattttggaactaaacgggtacgatccccaatatgcggcttccgtc<br>tttctgggatgggccacgaaaaagttcggcaagaggaacaccatctggct<br>gtttgggcctgcaactaccgggaagaccaacatcgcggaggccatagccc<br>acactgtgcccttctacgggtgcgtaaactggaccaatgagaactttccc<br>ttcaacgactgtgtcgacaagatggtgatctggtgggaggaggggaagat<br>gaccgccaaggtcgtggagtcggccaaagccattctcggaggaagcaagg<br>tgcgcgtggaccagaaatgcaagtcctcggcccagatagacccgactccc<br>gtgatcgtcacctccaacaccaacatgtgcgccgtgattgacgggaactc<br>aacgaccttcgaacaccagcagccgttgcaagaccggatgttcaaatttg<br>aactcacccgccgtctggatcatgactttgggaaggtcaccaagcaggaa<br>gtcaaagacttttttccggtgggcaaggatcacgtggttgaggtggagca<br>tgaattctacgtcaaaaagggtggagccaagaaaagacccgcccccagtg<br>acgcagatataagtgagcccaaacgggtgcgcgagtcagttgcgcagcca<br>tcgacgtcagacgcggaagcttcgatcaactacgcagacaggtaccaaaa<br>caaatgttctcgtcacgtgggcatgaatctgatgctgtttccctgcagac<br>aatgcgagagaatgaatcagaattcaaatatctgcttcactcacggacag<br>aaagactgtttagagtgctttcccgtgtcagaatctcaacccgtttctgt<br>cgtcaaaaaggcgtatcagaaactgtgctacattcatcatatcatgggaa<br>aggtgccagacgcttgcactgcctgcgatctggtcaatgtggatttggat<br>gactgcatctttgaacaataaatgatttaaatcaggtatggctgccgatg<br>gttatcttccagattggctcgaggacaacctctctgagggcattcgcgag |

TABLE 12-continued

AAV6 Mutant Plasmid vector sequences

| SEQ ID NO | Construct | Sequence |
|---|---|---|
| | | tggtgggacttgaaacctggagccccgaaacccaaagccaaccagcaaaa gcaggacgacggccggggtctggtgcttcctggctacaagtacctcggac ccttcaacggactcgacaaggggggagcccgtcaacgcggcggatgcagcg gccctcgagcacgacaaggcctacgaccagcagctcaaagcgggtgacaa tccgtacctgcggtataaccacgccgacgccgagtttcaggagcgtctgc aagaagatacgtcttttggggggcaacctcgggcgagcagtcttccaggcc aagaagagggttctcgaaccttttggtctggttgaggaaggtgctaagac ggctcctggaaagaaacgtccggtagagcagtcgccacaagagccagact cctcctcgggcattggcaagacaggccagcagcccgctaaaaagagactc aattttggtcagactggcgactcagagtcagtccccgacccacaacctct cggagaacctccagcaaccccccgctgctgtgggacctactacaatggctt caggcggtggcgcaccaatggcagacaataacgaaggcgccgacggagtg ggtaatgcctcaggaaattggcattgcgattccacatggctgggcgacag agtcatcaccaccagcacccgaacatgggccttgcccacctataacaacc acctctacaagcaaatctccagtgcttcaacggggggccagcaacgacaac cactacttcggctacagcacccctgggggtattttgatttcaacagatt ccactgccatttctcaccacgtgactggcagcgactcatcaacaacaatt ggggattccggcccaagagactcaacttcaagctcttcaacatccaagtc aaggaggtcacgacgaatgatggcgtcacgaccatcgctaataaccttac cagcacggttcaagtcttctcggactcggagtaccagttgccgtacgtcc tcggctctgcgcaccagggctgcctccctccgttcccggcggacgtgttc atgattccgcagtacggctacctaacgctcaacaatggcagcccaggcagt gggacggtcatccttttactgcctggaatatttcccatcgcagatgctga gaacgggcaataactttaccttcagctacaccttcgaggacgtgccttttc cacagcagctacgcgcacagccagagcctggaccggctgatgaatcctct catcgaccagtacctgtattacctgaacagaactcagaatcagtccggaa gtgcccaaaacaaggacttgctgtttagccggggggtctccagctggcatg tctgttcagcccaaaaactggctacctggaccctgttaccggcagcagcg cgtttctaaaacaaaaacagacaacaacaacagcaactttacctggactg gtgcttcaaaatataaccttaatgggcgtgaatctataatcaaccctggc actgctatggcctcacacaaagacgacaaagacaagttctttcccatgag cggtgtcatgatttttggaaaggagagcgccggagcttcaaacactgcat tggacaatgtcatgatcacagacgaagaggaaatcaaagccactaacccc gtggccaccgaaagatttgggactgtggcagtcaataaccagagcagcag cacagaccctgcgaccggagatgtgcatgttatgggagcctttacctggaa tggtgtggcaagacagagacgtatacctgcagggtcctattgggccaaa attcctcacacggatggacactttcacccgtctcctctcatgggcggctt tggacttaagcacccgcctcctcagatcctcatcaaaaacacgctgttc ctgcgaatcctccggcagagttttcggctacaaagtttgcttcattcatc acccagtattccacaggacaagtgagcgtggagattgaatgggagctgca gaaagaaaacagcaaacgctggaatcccgaagtgcagtatacatctaact atgcaaaatctgccaacgttgatttcactgtggacaacaatggactttat actgagcctcgccccattggcacccgttacctcacccgtccctgtaatt gtgtgttaatcaataaccggttgattcgtttcagttgaacttggtctc tgcgaagggcgaattcgtttaaacctgcaggactagaggtcctgtattag aggtcacgtgagtgttttgcgacattttgcgacaccatgtggtcacgctg gtatttaagcccgagtgagcacgcagggtctccattttgaagcgggagg tttgaacgcgcagccgccaagccgaattctgcagatatccatcacactgg cggccgctcgactagagcggccgccaccgcggtggagctccagcttttgt tccctttagtgagggttaattgcgcgcttggcgtaatcatggtcatagct gtttcctgtgtgaaattgttatccgctcacaattccacacaacatacgag ccggaagcataaagtgtaaagcctggggtgcctaatgagtgagctaactc acattaattgcgttgcgctcactgcccgctttccagtcgggaaacctgtc gtgccagctgcattaatgaatcggccaacgcgcggggagaggcggtttgc gtattgggcgctcttccgcttcctcgctcactgactcgctgcgctcggtc gttcggctgcggcgagcggtatcagctcactcaaaggcggtaatacggtt atccacagaatcaggggataacgcaggaaagaacatgtgagcaaaaggcc agcaaaaggccaggaaccgtaaaaaggccgcgttgctggcgtttttccat aggctccgcccccctgacgagcatcacaaaaatcgacgctcaagtcagag gtggcgaaacccgacaggactataaagataccaggcgtttccccctggaa gctccctcgtgcgctctcctgttccgaccctgccgcttaccggatacctg tccgcctttctcccttcgggaagcgtggcgctttctcatagctcacgctg taggtatctcagttcggtgtaggtcgttcgctccaagctgggctgtgtgc acgaaccccccgttcagcccgaccgctgcgccttatccggtaactatcgt cttgagtccaacccggtaagcacgacttatcgccactggcagcagccac tggtaacaggattagcagagcgaggtatgtaggcggtgctacagagttct tgaagtggtggcctaactacggctacactagaagaacagtatttggtatc tgcgctctgctgaagccagttaccttcggaaaaagagttggtagctcttg atccggcaaacaaaccaccgctggtagcggtggttttttgtttgcaagc agcagattacgcgcagaaaaaaaggatctcaagaagatcctttgatcttt tctacggggtctgacgctcagtggaacgaaaactcacgttaagggatttt ggtcatgagattatcaaaaaggatcttcacctagatccttttaaattaaa aatgaagttttaaatcaatctaaagtatatatgagtaaacttggtctgac agttaccaatgcttaatcagtgaggcacctatctcagcgatctgtctatt |

TABLE 12-continued

AAV6 Mutant Plasmid vector sequences

| SEQ ID NO | Construct | Sequence |
|---|---|---|
| | | tcgttcatccatagttgcctgactcccgtcgtgtagataactacgatac gggagggcttaccatctggcccagtgctgcaatgataccgcgagaccca cgctcaccggctccagatttatcagcaataaaccagccagccggaagggc cgagcgcagaagtggtcctgcaactttatccgcctccatccagtctatta attgttgccgggaagctagagtaagtagttcgccagttaatagtttgcgc aacgttgttgccattgctacaggcatcgtggtgtcacgctcgtcgtttgg tatggcttcattcagctccggttcccaacgatcaaggcgagttacatgat cccccatgttgtgcaaaaaagcggttagctccttcggtcctccgatcgtt gtcagaagtaagttggccgcagtgttatcactcatggttatggcagcact gcataattctcttactgtcatgccatccgtaagatgcttttctgtgactg gtgagtactcaaccaagtcattctgagaatagtgtatgcggcgaccgagt tgctcttgcccggcgtcaatacgggataataccgcgccacatagcagaac tttaaaagtgctcatcattggaaaacgttcttcggggcgaaaactctcaa ggatcttaccgctgttgagatccagttcgatgtaacccactcgtgcaccc aactgatcttcagcatcttttactttcaccagcgtttctgggtgagcaaa aacaggaaggcaaaatgccgcaaaaaagggaataagggcgacacggaaat gttgaatactcatactcttcctttttcaatattattgaagcatttatcag ggttattgtctcatgagcggatacatatttgaatgtatttagaaaaataa acaaataggggttccgcgcacatttccccgaaaagtgccacctaaattgt aagcgttaatattttgttaaaattcgcgttaaattttgttaaatcagct cattttttaaccaataggccgaaatcggcaaaatcccttataaatcaaaa gaatagaccgagatagggttgagtgttgttccagtttggaacaagagtcc actattaaagaacgtggactccaacgtcaaagggcgaaaaaccgtctatc agggcgatggcccactacgtgaaccatcaccctaatcaagttttttgggg tcgaggtgccgtaaagcactaaatcggaaccctaaagggagcccccgatt tagagcttgacggggaaagccggcgaacgtggcgagaaaggaagggaaga aagcgaaaggagcgggcgctagggcgctggcaagtgtagcggtcacgctg cgcgtaaccaccacacccgccgcgcttaatgcgccgctacagggcgcgtc ccattcgccattcaggctgcgcaactgttgggaagggcgatcggtgcggg cctcttcgctattacgccagctggcgaaagggggatgtgctgcaaggcga ttaagttgggtaacgccagggttttcccagtcacgacgttgtaaaacgac ggccagtgagcgcgtaatacgactcactatagggcgaattgggtaccg ggccccccctcgatcgaggtcgacggtatcggggggagctcgcagggtctc cattttgaagcgggaggtttgaacgcgcag |
| 200 | 17AALHZC_ AAV6_L584H_ pAAV-DJ | ccgccatgccggggttttacgagattgtgattaaggtccccagcgaccttgacgagcatctgcccggcatttctgacagctttgtgaactgggtggccgagaaggaatgggagttgccgccagattctgcatggatctgaatctgattgagcaggcaccccctgaccgtggccgagaagctgcagcgcgactttctgacggaatggcgccgtgtgagtaaggccccggaggccctttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgccccgactacctggtgggccagcagcccgtggaggacatttccagcaatcggatttataaaattttggaactaaacgggtacgatcccaatatgcggcttccgtctttctgggatgggccacgaaaaagttcggcaagaggaacaccatctggctgtttgggcctgcaactaccgggaagaccaacatcgcggaggccatagcccacactgtgccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactccctgtcgtcacctccaacaccaacatgtgccgtgattgacgggaactcaacgaccttcgaacaccagcagccgttgcaagaccggatgttcaaatttgaactcacccgccgtctggatcatgactttgggaaggtcaccaagcaggaagtcaaagacttttttcggtgggcaaaggatcacgtggttgaggtggagcatgaattctacgtcaaaaagggtggagccaagaaaagaccccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttcctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgag |

TABLE 12-continued

AAV6 Mutant Plasmid vector sequences

| SEQ ID NO | Construct | Sequence |
|---|---|---|
| | | tggtgggacttgaaacctggagccccgaaacccaaagccaaccagcaaaa<br>gcaggacgacggccggggtctggtgcttcctggctacaagtacctcggac<br>ccttcaacggactcgacaaggggggagcccgtcaacgcggcggatgcagcg<br>gccctcgagcacgacaaggcctacgaccagcagctcaaagcgggtgacaa<br>tccgtacctgcggtataaccacgccgacgccgagtttcaggagcgtctgc<br>aagaagatacgtcttttgggggcaacctcgggcgagcagtcttccaggcc<br>aagaagagggttctcgaaccttttggtctggttgaggaaggtgctaagac<br>ggctcctggaaagaaacgtccggtagagcagtcgccacaagagccagact<br>cctcctcgggcattggcaagacaggccagcagcccgctaaaaagagactc<br>aattttggtcagactggcgactcagagtcagtcccgacccacaacctct<br>cggagaacctccagcaaccccccgctgctgtgggacctactacaatggctt<br>caggcggtggcgcaccaatggcagacaataacgaaggcgccgacggagtg<br>ggtaatgcctcaggaaattggcattgcgattccacatggctgggcgacag<br>agtcatcaccaccagcacccgaacatgggccttgcccacctataacaacc<br>acctctacaagcaaatctccagtgcttcaacggggccagcaacgacaac<br>cactacttcggctacagcacccctgggggtattttgatttcaacagatt<br>ccactgccatttctcaccacgtgactggcagcgactcatcaacaacaatt<br>ggggattccggcccaagagactcaacttcaagctcttcaacatccaagtc<br>aaggaggtcacgacgaatgatggcgtcacgaccatcgctaataaccttac<br>cagcacggttcaagtcttctcggactcggagtaccagttgccgtacgtcc<br>tcggctctgcgcaccagggctgcctccctccgttcccggcggacgtgttc<br>atgattccgcagtacggctacctaacgctcaacaatggcagcaggcagt<br>gggacggtcatccttttactgcctggaatatttcccatcgcagatgctga<br>gaacgggcaataactttaccttcagctacaccttcgaggacgtgccttc<br>cacagcagctacgcgcacagccagagcctggaccggctgatgaatcctct<br>catcgaccagtacctgtattacctgaacagaactcagaatcagtccggaa<br>gtgcccaaaacaaggacttgctgtttagccggggggtctccagctggcatg<br>tctgttcagcccaaaaactggctacctggaccctgttaccggcagcagcg<br>cgtttctaaaacaaaaacagacaacaacaacagcaactttacctggactg<br>gtgcttcaaaatataaccttaatgggcgtgaatctataatcaaccctggc<br>actgctatggcctcacacaaagacgacaaagacaagttctttcccatgag<br>cggtgtcatgatttttggaaaggagagcgccggagcttcaaacactgcat<br>tggacaatgtcatgatcacagacgaagaggaaatcaaagccactaacccc<br>gtggccaccgaaagatttgggactgtggcagtcaatcaccagagcagcag<br>cacagaccctgcgaccggagatgtgcatgttatgggagccttacctggaa<br>tggtgtggcaagacagagacgtatacctgcagggtcctattttgggccaaa<br>attcctcacacggatggacactttcacccgtctcctctcatgggcggctt<br>tggacttaagcacccgcctcctcagatcctcatcaaaaacacgcctgttc<br>ctgcgaatcctccggcagagttttcggctacaaagtttgcttcattcatc<br>acccagtattccacaggacaagtgagcgtggagattgaatgggagctgca<br>gaaagaaaacagcaaacgctggaatcccgaagtgcagtatacatctaact<br>atgcaaaatctgccaacgttgatttcactgtggacaacaatggactttat<br>actgagcctcgcccattggcacccgttacctcacccgtccctgtaatt<br>gtgtgttaatcaataaaccggttgattcgtttcagttgaactttggtctc<br>tgcgaagggcgaattcgtttaaacctgcaggactagaggtcctgtattag<br>aggtcacgtgagtgttttgcgacattttgcgacaccatgtggtcacgctg<br>ggtatttaagcccgagtgagcacgcagggtctccatttttgaagcgggagg<br>tttgaacgcgcagccgccaagccgaattctgcagatatccatcacactgg<br>cggccgctcgactagagcggccgccaccgcggtggagctccagcttttgt<br>tccctttagtgagggttaattgcgcgcttggcgtaatcatggtcatagct<br>gtttcctgtgtgaaattgttatccgctcacaattccacacaacatacgag<br>ccggaagcataaagtgtaaagcctggggtgcctaatgagtgagctaactc<br>acattaattgcgttgcgctcactgcccgctttccagtcgggaaacctgtc<br>gtgccagctgcattaatgaatcggccaacgcgcggggagaggcggtttgc<br>gtattgggcgctcttccgcttcctcgctcactgactcgctgcgctcggtc<br>gttcggctgcggcgagcggtatcagctcactcaaaggcggtaatacggtt<br>atccacagaatcaggggataacgcaggaaagaacatgtgagcaaaaggcc<br>agcaaaaggccaggaaccgtaaaaaggccgcgttgctggcgtttttccat<br>aggctccgcccccctgacgagcatcacaaaaatcgacgctcaagtcagag<br>gtggcgaaacccgacaggactataaagataccaggcgtttccccctggaa<br>gctccctcgtgcgctctcctgttccgaccctgccgcttaccggatacctg<br>tccgcctttctcccttcgggaagcgtggcgctttctcatagctcacgctg<br>taggtatctcagttcggtgtaggtcgttcgctccaagctgggctgtgtgc<br>acgaaccccccgttcagcccgaccgctgcgccttatccggtaactatcgt<br>cttgagtccaacccggtaagacacgacttatcgccactggcagcagccac<br>tggtaacaggattagcagagcgaggtatgtaggcggtgctacagagttct<br>tgaagtggtggcctaactacggctacactagaagaacagtatttggtatc<br>tgcgctctgctgaagccagttaccttcggaaaaagagttggtagctcttg<br>atccggcaaacaaaccaccgctggtagcggtggtttttttgtttgcaagc<br>agcagattacgcgcagaaaaaaaggatctcaagaagatcctttgatcttt<br>tctacggggtctgacgctcagtggaacgaaaactcacgttaagggattt<br>ggtcatgagattatcaaaaaggatcttcacctagatccttttaaattaaa<br>aatgaagttttaaatcaatctaaagtatatatgagtaaacttggtctgac<br>agttaccaatgcttaatcagtgaggcacctatctcagcgatctgtctatt |

TABLE 12-continued

AAV6 Mutant Plasmid vector sequences

| SEQ ID NO | Construct | Sequence |
|---|---|---|
| | | tcgttcatccatagttgcctgactcccgtcgtgtagataactacgatac<br>gggagggcttaccatctggccccagtgctgcaatgataccgcgagaccca<br>cgctcaccggctccagatttatcagcaataaaccagccagccggaagggc<br>cgagcgcagaagtggtcctgcaactttatccgcctccatccagtctatta<br>attgttgccgggaagctagagtaagtagttcgccagttaatagtttgcgc<br>aacgttgttgccattgctacaggcatcgtggtgtcacgctcgtcgtttgg<br>tatggcttcattcagctccggttcccaacgatcaaggcgagttacatgat<br>cccccatgttgtgcaaaaaagcggttagctccttcggtcctccgatcgtt<br>gtcagaagtaagttggccgcagtgttatcactcatggttatggcagcact<br>gcataattctcttactgtcatgccatccgtaagatgcttttctgtgactg<br>gtgagtactcaaccaagtcattctgagaatagtgtatgcggcgaccgagt<br>tgctcttgcccggcgtcaatacgggataataccgcgccacatagcagaac<br>tttaaaagtgctcatcattggaaaacgttcttcggggcgaaaactctcaa<br>ggatcttaccgctgttgagatccagttcgatgtaacccactcgtgcaccc<br>aactgatcttcagcatcttttactttcaccagcgtttctgggtgagcaaa<br>aacaggaaggcaaaatgccgcaaaaaagggaataagggcgacacggaaat<br>gttgaatactcatactcttccttttcaatattattgaagcatttatcag<br>ggttattgtctcatgagcggatacatatttgaatgtatttagaaaaataa<br>acaaatagggggttccgcgcacatttccccgaaaagtgccacctaaattgt<br>aagcgttaatattttgttaaaattcgcgttaaattttttgttaaatcagct<br>cattttttaaccaataggccgaaatcggcaaaatcccttataaatcaaaa<br>gaatagaccgagatagggttgagtgttgttccagtttggaacaagagtcc<br>actattaaagaacgtggactccaacgtcaaagggcgaaaaaccgtctatc<br>agggcgatggcccactacgtgaaccatcaccctaatcaagttttttgggg<br>tcgaggtgccgtaaagcactaaatcggaaccctaaagggagcccccgatt<br>tagagcttgacggggaaagccggcgaacgtggcgagaaaggaagggaaga<br>aagcgaaaggagcgggcgctagggcgctggcaagtgtagcggtcacgctg<br>cgcgtaaccaccacacccgccgcgcttaatgcgccgctacagggcgcgtc<br>ccattcgccattcaggctgcgcaactgttgggaagggcgatcggtgcggg<br>cctcttcgctattacgccagctggcgaaagggggatgtgctgcaaggcga<br>ttaagttgggtaacgccagggttttcccagtcacgacgttgtaaaacgac<br>ggccagtgagcgcgcgtaatacgactcactatagggcgaattgggtaccg<br>ggccccccctcgatcgaggtcgacggtatcggggggagctcgcagggtctc<br>cattttgaagcgggaggtttgaacgcgcag |
| 201 | 17AALH2C_<br>AAV6_L584D_<br>pAAV-DJ | ccgccatgccggggttttacgagattgtgattaaggtccccagcgaccttt<br>gacgagcatctgcccggcatttctgacagctttgtgaactgggtggccga<br>gaaggaatgggagttgccgccagattctgacatggatctgaatctgattg<br>agcaggcaccccctgaccgtggccgagaagctgcagcgcgactttctgacg<br>gaatggcgccgtgtgagtaaggcccccggaggcccttttctttgtgcaatt<br>tgagaagggagagagctacttccacatgcacgtgctcgtggaaaccaccg<br>gggtgaaatccatggttttgggacgtttcctgagtcagattcgcgaaaaa<br>ctgattcagagaatttaccgcgggatcgagccgactttgccaaactggtt<br>cgcggtcacaaagaccagaaatggcgccggaggcgggaacaaggtggtgg<br>atgagtgctacatccccaattacttgctccccaaaacccagcctgagctc<br>cagtgggcgtggactaatatggaacagtatttaagcgcctgtttgaatct<br>cacggagcgtaaacggttggtggcgcagcatctgacgcacgtgtcgcaga<br>cgcaggagcagaacaaagagaatcagaatcccaattctgatgcgccggtg<br>atcagatcaaaaacttcagccaggtacatggagctggtcgggtggctcgt<br>ggacaaggggattacctcggagaagcagtggatccaggaggaccaggcct<br>catacatctccttcaatgcggcctccaactcgcggtcccaaatcaaggct<br>gccttggacaatgcgggaaagattatgagcctgactaaaaccgcccccga<br>ctacctggtgggccagcagcccgtggaggacatttccagcaatcggattt<br>ataaaattttggaactaaacgggtacgatccccaatatgcggcttccgtc<br>tttctgggatgggccacgaaaaagttcggcaagaggaacaccatctggct<br>gtttgggcctgcaactaccgggaagaccaacatcgcggaggccatagccc<br>acactgtgcccttctacgggtgcgtaaactggaccaatgagaactttccc<br>ttcaacgactgtgtcgacaagatggtgatctggtgggaggaggggaagat<br>gaccgccaaggtcgtggagtcggccaaagccattctcggaggaagcaagg<br>tgcgcgtggaccagaaatgcaagtcctcggcccagatagacccgactccc<br>gtgatcgtcacctccaacaccaacatgtgcgccgtgattgacgggaactc<br>aacgaccttcgaacaccagcagccgttgcaagaccggatgttcaaatttg<br>aactcacccgccgtctggatcatgactttgggaaggtcaccaagcaggaa<br>gtcaaagacttttttccggtgggcaaaggatcacgtggttgaggtggagca<br>tgaattctacgtcaaaaagggtggagccaagaaaaagaccccgcccccagtg<br>acgcagatataagtgagcccaaacgggtgcgcgagtcagttgcgcagcca<br>tcgacgtcagacgcggaagcttcgatcaactacgcagacaggtaccaaaa<br>caaatgttctcgtcacgtgggcatgaatctgatgctgtttccctgcagac<br>aatgcgagagaatgaatcagaattcaaatatctgcttcactcacggacga<br>aaagactgtttagagtgcttttcccgtgtcagaatctcaaccccgtttctgt<br>cgtcaaaaaggcgtatcagaaactgtgctacattcatcatatcatgggaa<br>aggtgccagacgcttgcactgcctgcgatctggtcaatgtggatttggat<br>gactgcatctttgaacaataaaatgatttaaatcaggtatggctgccgatg<br>gttatcttccagattggctcgaggacaacctctctgagggcattcgcgag |

TABLE 12-continued

AAV6 Mutant Plasmid vector sequences

| SEQ ID NO | Construct | Sequence |
|---|---|---|
| | | tggtgggacttgaaacctggagccccgaaacccaaagccaaccagcaaaa gcaggacgacggccggggtctggtgcttcctggctacaagtacctcggac ccttcaacggactcgacaaggggagcccgtcaacgcggcggatgcagcg gccctcgagcacgacaaggcctacgaccagcagctcaaagcgggtgacaa tccgtacctgcggtataaccacgccgacgccgagtttcaggagcgtctgc aagaagatacgtcttttgggggcaacctcgggcgagcagtcttccaggcc aagaagagggttctcgaaccttttggtctggttgaggaaggtgctaagac ggctcctggaaagaaacgtccggtagagcagtcgccacaagagccagact cctcctcgggcattggcaagacaggccagcagcccgctaaaaagagactc aatttggtcagactggcgactcagagtcagtccccgacccacaacctct cggagaacctccagcaaccccgctgctgtgggacctactacaatggctt caggcggtggcgcaccaatggcagacaataacgaaggcgccgacggagtg ggtaatgcctcaggaaattggcattgcgattccacatggctgggcgacag agtcatcaccaccagcacccgaacatgggccttgcccacctataacaacc acctctacaagcaaatctccagtgcttcaacggggccagcaacgacaac cactacttcggctacagcacccctgggggtattttgatttcaacagatt ccactgccatttctcaccacgtgactggcagcgactcatcaacaacaatt ggggattccggcccaagagactcaacttcaagctcttcaacatccaagtc aaggaggtcacgacgaatgatggcgtcacgaccatcgctaataaccttac cagcacggttcaagtcttctcggactcggagtaccagttgccgtacgtcc tcggctctgcgcaccagggctgcctccctccgttcccggcggacgtgttc atgattccgcagtacggctacctaacgctcaacaatggcagcaggcagt gggacggtcatccttttactgcctggaatattccctgcagatgctga gaacgggcaataactttaccttcagctacaccttcgaggacgtgccttc cacagcagctacgcgcacagccagagcctggaccggctgatgaatcctct catcgaccagtcctgtattacctgaacagaactcagaatcagtccggaa gtgcccaaaacaaggacttgctgtttagccgggggtctccagctggcatg tctgttcagcccaaaaactggctacctggaccctgttaccggcagcagcg cgtttctaaaacaaaaacagacaacaacaacagcaactttacctggactg gtgcttcaaaatataaccttaatgggcgtgaatctataatcaaccctggc actgctatggcctcacacaaagacgacaaagacaagttctttcccatgag cggtgtcatgatttttggaaaggagagcgccggagcttcaaacactgcat tggacaatgtcatgatcacagacgaagaggaaatcaaagccactaacccc gtggccaccgaaagatttgggactgtggcagtcaatgaccagagcagcag cacagaccctgcgaccggagatgtgcatgttatgggagccttacctggaa tggtgtggcaagacagagacgtatacctgcagggtcctattgggccaaa attcctcacacggatggacactttcacccgtctcctctcatgggcggctt tggacttaagcacccgcctcctcagatcctcatcaaaaacacgctgttc ctgcgaatcctccggcagagttttcggctacaaagtttgcttcattcatc acccagtattccacaggacaagtgagcgtggagattgaatgggagctgca gaaagaaaacagcaaacgctggaatcccgaagtgcagtatacatctaact atgcaaaatctgccaacgttgatttcactgtggacaacaatggactttat actgagcctcgcccattggcacccgttacctcacccgtccctgtaatt gtgtgttaatcaataaacggttgattcgtttcagttgaactttggtctc tgcgaagggcgaattcgtttaaacctgcaggactagaggtcctgtattag aggtcacgtgagtgttttgcgacattttgcgacaccatgtggtcacgctg ggtatttaagcccgagtgagcacgcagggtctccattttgaagcgggagg tttgaacgcgcagccgccaagccgaattctgcagatatccatcacactgg cggccgctcgactagagcggccgccaccgcggtggagctccagcttttgt tccctttagtgagggttaattgcgcgcttggcgtaatcatggtcatagct gtttcctgtgtgaaattgttatccgctcacaattccacacaacatacgag ccggaagcataaagtgtaaagcctggggtgcctaatgagtgagctaactc acattaattgcgttgcgctcactgcccgctttccagtcgggaaacctgtc gtgccagctgcattaatgaatcggccaacgcgcggggagaggcggtttgc gtattgggcgctcttccgcttcctcgctcactgactcgctgcgctcggtc gttcggctgcggcgagcggtatcagctcactcaaaggcggtaatacggtt atccacagaatcaggggataacgcaggaaagaacatgtgagcaaaaggcc agcaaaaggccaggaaccgtaaaaaggccgcgttgctggcgtttttccat aggctccgcccccctgacgagcatcacaaaaatcgacgctcaagtcagag gtggcgaaacccgacaggactataaagataccaggcgtttccccctggaa gctccctcgtgcgctctcctgttccgaccctgccgcttaccggatacctg tccgcctttctcccttcgggaagcgtggcgctttctcatagctcacgctg taggtatctcagttcggtgtaggtcgttcgctccaagctgggctgtgtgc acgaaccccccgttcagcccgaccgctgcgccttatccggtaactatcgt cttgagtccaacccggtaagacacgacttatcgccactggcagcagccac tggtaacaggattagcagagcgaggtatgtaggcggtgctacagagttct tgaagtggtggcctaactacggctacactagaagaacagtatttggtatc tgcgctctgctgaagccagttaccttcggaaaaagagttggtagctcttg atccggcaaacaaaccaccgctggtagcggtggtttttttgtttgcaagc agcagattacgcgcagaaaaaaaggatctcaagaagatcctttgatcttt tctacggggtctgacgctcagtggaacgaaaactcacgttaagggatttt ggtcatgagattatcaaaaaggatcttcacctagatccttttaaattaaa aatgaagttttaaatcaatctaaagtatatatgagtaaacttggtctgac agttaccaatgcttaatcagtgaggcacctatctcagcgatctgtctatt |

TABLE 12-continued

AAV6 Mutant Plasmid vector sequences

| SEQ ID NO | Construct | Sequence |
|---|---|---|
| | | tcgttcatccatagttgcctgactcccgtcgtgtagataactacgatac gggagggcttaccatctggcccagtgctgcaatgataccgcgagaccca cgctcaccggctccagatttatcagcaataaaccagccagccggaagggc cgagcgcagaagtggtcctgcaactttatccgcctccatccagtctatta attgttgccgggaagctagagtaagtagttcgccagttaatagtttgcgc aacgttgttgccattgctacaggcatcgtggtgtcacgctcgtcgtttgg tatggcttcattcagctccggttcccaacgatcaaggcgagttacatgat cccccatgttgtgcaaaaaagcggttagctccttcggtcctccgatcgtt gtcagaagtaagttggccgcagtgttatcactcatggttatggcagcact gcataattctcttactgtcatgccatccgtaagatgcttttctgtgactg gtgagtactcaaccaagtcattctgagaatagtgtatgcggcgaccgagt tgctcttgcccggcgtcaatacgggataataccgcgccacatagcagaac tttaaaagtgctcatcattggaaaacgttcttcggggcgaaaactctcaa ggatcttaccgctgttgagatccagttcgatgtaacccactcgtgcaccc aactgatcttcagcatcttttactttcaccagcgtttctgggtgagcaaa aacaggaaggcaaaatgccgcaaaaaagggaataagggcgacacggaaat gttgaatactcatactcttcctttttcaatattattgaagcatttatcag ggttattgtctcatgagcggatacatatttgaatgtatttagaaaaataa acaaataggggttccgcgcacatttccccgaaaagtgccacctaaattgt aagcgttaatattttgttaaaattcgcgttaaattttgttaaatcagct cattttttaaccaataggccgaaatcggcaaaatcccttataaatcaaaa gaatagaccgagatagggttgagtgttgttccagtttggaacaagagtcc actattaaagaacgtggactccaacgtcaaagggcgaaaaaccgtctatc agggcgatggcccactacgtgaaccatcaccctaatcaagttttttgggg tcgaggtgccgtaaagcactaaatcggaaccctaaagggagccccgatt tagagcttgacggggaaagccggcgaacgtggcgagaaaggaagggaaga aagcgaaaggagcgggcgctagggcgctggcaagtgtagcggtcacgctg cgcgtaaccaccacacccgccgcgcttaatgcgccgctacagggcgcgtc ccattcgccattcaggctgcgcaactgttgggaagggcgatcggtgcggg cctcttcgctattacgccagctggcgaaaggggatgtgctgcaaggcga ttaagttgggtaacgccagggttttcccagtcacgacgttgtaaaacgac ggccagtgagcgcgcgtaatacgactcactataggggcgaattgggtaccg ggcccccctcgatcgaggtcgacggtatcgggggagctcgcagggtctc cattttgaagcgggaggtttgaacgcgcag |
| 202 | 17AALH3C_ AAV6_V598L_ pAAV-DJ | ccgccatgccggggttttacgagattgtgattaaggtccccagcgaccttt gacgagcatctgcccggcatttctgacagctttgtgaactgggtggccga gaaggaatgggagttgccgccagattctgcatggatctgaatctgattg agcaggcacccctgaccgtggccgagaagctgcagcgcgactttctgacg gaatggcgccgtgtgagtaaggcccccggaggcccttttctttgtgcaatt tgagaagggagagagctacttccacatgcacgtgctcgtggaaaccaccg gggtgaaatccatggttttgggacgtttcctgagtcagattcgcgaaaaa ctgattcagagaatttaccgcgggatcgagccgactttgccaaactggtt cgcggtcacaaagaccagaaatggcgccggaggcgggaacaaggtggtgg atgagtgctacatccccaattacttgctccccaaaacccagcctgagctc cagtgggcgtggactaatatggaacagtatttaagcgcctgtttgaatct cacggagcgtaaacggttggtggcgcagcatctgacgcacgtgtcgcaga cgcaggagcagaacaaagagaatcagaatcccaattctgatgcgccggtg atcagatcaaaaacttcagccaggtacatggagctggtcggtggctcgt ggacaaggggattacctcggagaagcagtggatccaggaggaccaggcct catacatctccttcaatgcggcctccaactcgcggtcccaaatcaaggct gccttggacaatgcgggaaagattatgagcctgactaaaaccgccccga ctacctggtgggccagcagcccgtggaggacatttccagcaatcggattt ataaaattttggaactaaacgggtacgatcccaatatgcggcttccgtc tttctgggatggccacgaaaaagttcggcaagaggaacaccatctggct gtttgggcctgcaactaccgggaagaccaacatcgcggaggccatagccc acactgtgcccttctacgggtgcgtaaactggaccaatgagaactttccc ttcaacgactgtgtcgacaagatggtgatctggtgggaggagggggaagat gaccgccaaggtcgtggagtcggccaaagccattctcggaggaagcaagg tgcgcgtggaccagaaatgcaagtcctcggcccagatagacccgactccc gtgatcgtcacctccaacaccaacatgtgcgccgtgattgacgggaactc aacgaccttcgaacaccagcagccgttgcaagaccggatgttcaaatttg aactcacccgccgtctggatcatgactttgggaaggtcaccaagcaggaa gtcaaagacttttttccggtgggcaaggatcacgtggttgaggtggagca tgaattctacgtcaaaaagggtggagccaagaaaagacccgccccccagtg acgcagatataagtgagcccaaacgggtgcgcgagtcagttgcgcagcca tcgacgtcagacgcggaagcttcgatcaactacgcagacaggtaccaaaa caaatgttctcgtcacgtgggcatgaatctgatgctgtttccctgcagac aatgcgagagaatgaatcagaattcaaatatctgcttcatcacgacgcag aaagactgtttgagtgcttcccgtgtcagaatctcaacccgtttctgt cgtcaaaaaggcgtatcagaaactgtgctacattcatcatatcatgggaa aggtgccagacgcttgcactgcctgcgatctggtcaatgtggatttggat gactgcatctttgaacaataaatgatttaaatcaggtatggctgccgatg gttatcttccagattggctcgaggacaacctctctgagggcattcgcgag |

TABLE 12-continued

AAV6 Mutant Plasmid vector sequences

| SEQ ID NO | Construct | Sequence |
|---|---|---|
| | | tggtgggacttgaaacctggagccccgaaacccaaagccaaccagcaaaa gcaggacgacggccggggtctggtgcttcctggctacaagtacctcggac ccttcaacggactcgacaaggggggagcccgtcaacgcggcggatgcagcg gccctcgagcacgacaaggcctacgaccagcagctcaaagcgggtgacaa tccgtacctgcggtataaccacgccgacgccgagtttcaggagcgtctgc aagaagatacgtcttttgggggcaacctcgggcgagcagtcttccaggcc aagaagagggttctcgaaccttttggtctggttgaggaaggtgctaagac ggctcctggaaagaaacgtccggtagagcagtcgccacaagagccagact cctcctcgggcattggcaagacaggccagcagcccgctaaaaagagactc aatttggtcagactggcgactcagagtcagtcccgacccacaacctct cggagaacctccagcaaccccgctgctgtgggacctactacaatggctt caggcggtggcgcaccaatggcagacaataacgaaggcgccgacggagtg ggtaatgcctcaggaaattggcattgcgattccacatggctgggcgacag agtcatcaccaccagcacccgaacatgggccttgcccacctataacaacc acctctacaagcaaatctccagtgcttcaacggggggccagcaacgacaac cactacttcggctacagcaccccctggggtattttgatttcaacagatt ccactgccatttctcaccacgtgactggcagcgactcatcaacaacaatt ggggattccggcccaagagactcaacttcaagctcttcaacatccaagtc aaggaggtcacgacgaatgatggcgtcacgaccatcgctaataaccttac cagcacggttcaagtcttctcggactcggagtaccagttgccgtacgtcc tcggctctgcgcaccagggctgcctccctccgttcccggcggacgtgttc atgattccgcagtacggctacctaacgctcaacaatggcagccaggcagt gggacggtcatcctttttactgcctggaatatttcccatcgcagatgctga gaacgggcaataactttaccttcagctacaccttcgaggacgtgcctttc cacagcagctacgcgcacagccagagcctggaccggctgatgaatcctct catcgaccagtcctgtattacctgaacagaactcagaatcagtccggaa gtgcccaaaacaaggacttgctgtttagccgggggtctccagctggcatg tctgttcagcccaaaaactggctacctggaccctgttaccggcagcagcg cgtttctaaaacaaaaacagacaacaacaacagcaactttacctggactg gtgcttcaaaatataaccttaatgggcgtgaatctataatcaaccctggc actgctatggcctcacacaaagacgacaaagacaagttctttcccatgag cggtgtcatgattttttggaaaggagagcgccggagcttcaaacactgcat tggacaatgtcatgatcacagacgaagaggaaatcaaagccactaacccc gtggccaccgaaagatttgggactgtggcagtcaatctccagagcagcag cacagaccctgcgaccggagatgtgcatcttatgggagccttacctggaa tggtgtggcaagacagagacgtataccctgcagggtcctattgggccaaa attcctcacacggatggacactttcacccgtctcctctcatgggcggctt tggacttaagcacccgcctcctcagatcctcatcaaaaacacgctgttc ctgcgaatcctccggcagagttttcggctacaaagtttgcttcattcatc acccagtattccacaggacaagtgagcgtggagattgaatgggagctgca gaaagaaaacagcaaacgctggaatcccgaagtgcagtatacatctaact atgcaaaatctgccaacgttgatttcactgtggacaacaatggactttat actgagcctcgcccattggcacccgttacctcacccgtccctgtaatt gtgtgttaatcaataaaccggttgattcgtttcagttgaactttggtctc tgcgaagggcgaattcgtttaaacctgcaggactagaggtcctgtattag aggtcacgtgagtgttttgcgacattttgcgacaccatgtggtcacgctg ggtatttaagcccgagtgagcacgcagggtctccattttgaagcgggagg tttgaacgcgcagccgccaagccgaattctgcagatatccatcacactgg cggccgctcgactagagcggccgccaccgcggtggagctccagcttttgt tccctttagtgagggttaattgcgcgcttggcgtaatcatggtcatagct gtttcctgtgtgaaattgttatccgctcacaattccacacaacatacgag ccggaagcataaagtgtaaagcctggggtgcctaatgagtgagctaactc acattaattgcgttgcgctcactgcccgctttccagtcgggaaacctgtc gtgccagctgcattaatgaatcggccaacgcgcggggagaggcggtttgc gtattgggcgctcttccgcttcctcgctcactgactcgctgcgctcggtc gttcggctgcggcgagcggtatcagctcactcaaaggcggtaatacggtt atccacagaatcaggggataacgcaggaaagaacatgtgagcaaaaggcc agcaaaaggccaggaaccgtaaaaaggccgcgttgctggcgtttttccat aggctccgccccctgacgagcatcacaaaaatcgacgctcaagtcagag gtggcgaaacccgacaggactataaagataccaggcgtttccccctggaa gctccctcgtgcgctctcctgttccgaccctgccgcttaccggatacctg tccgcctttctcccttcgggaagcgtggcgctttctcatagctcacgctg taggtatctcagttcggtgtaggtcgttcgctccaagctgggctgtgtgc acgaacccccgttcagcccgaccgctgcgccttatccggtaactatcgt cttgagtccaacccggtaagacacgacttatcgccactggcagcagccac tggtaacaggattagcagagcgaggtatgtaggcggtgctacagagttct tgaagtggtggcctaactacggctacactagaagaacagtatttggtatc tgcgctctgctgaagccagttaccttcggaaaaagagttggtagctcttg atccggcaaacaaaccaccgctggtagcggtggtttttttgtttgcaagc agcagattacgcgcagaaaaaaaggatctcaagaagatcctttgatcttt tctacggggtctgacgctcagtggaacgaaaactcacgttaagggattt ggtcatgagattatcaaaaaggatcttcacctagatccttttaaattaaa aatgaagttttaaatcaatctaaagtatatatgagtaaacttggtctgac agttaccaatgcttaatcagtgaggcacctatctcagcgatctgtctatt |

TABLE 12-continued

AAV6 Mutant Plasmid vector sequences

| SEQ ID NO | Construct | Sequence |
|---|---|---|
| | | tcgttcatccatagttgcctgactcccgtcgtgtagataactacgatac gggagggcttaccatctggcccagtgctgcaatgataccgcgagaccca cgctcaccggctccagatttatcagcaataaaccagccagccggaagggc cgagcgcagaagtggtcctgcaactttatccgcctccatccagtctatta attgttgccgggaagctagagtaagtagttcgccagttaatagtttgcgc aacgttgttgccattgctacaggcatcgtggtgtcacgctcgtcgtttgg tatggcttcattcagctccggttcccaacgatcaaggcgagttacatgat cccccatgttgtgcaaaaaagcggttagctccttcggtcctccgatcgtt gtcagaagtaagttggccgcagtgttatcactcatggttatggcagcact gcataattctcttactgtcatgccatccgtaagatgcttttctgtgactg gtgagtactcaaccaagtcattctgagaatagtgtatgcggcgaccgagt tgctcttgcccggcgtcaatacgggataataccgcgccacatagcagaac tttaaaagtgctcatcattggaaaacgttcttcggggcgaaaactctcaa ggatcttaccgctgttgagatccagttcgatgtaacccactcgtgcaccc aactgatcttcagcatcttttactttcaccagcgtttctgggtgagcaaa aacaggaaggcaaaatgccgcaaaaaagggaataagggcgacacggaaat gttgaatactcatactcttcctttttcaatattattgaagcatttatcag ggttattgtctcatgagcggatacatatttgaatgtatttagaaaaataa acaaataggggttccgcgcacatttccccgaaaagtgccacctaaattgt aagcgttaatattttgttaaaattcgcgttaaattttttgttaaatcagct catttttaaccaataggccgaaatcggcaaaatcccttataaatcaaaa gaatagaccgagatagggttgagtgttgttccagtttggaacaagagtcc actattaaagaacgtggactccaacgtcaaagggcgaaaaaccgtctatc agggcgatggcccactacgtgaaccatcaccctaatcaagttttttgggg tcgaggtgccgtaaagcactaaatcggaaccctaaagggagcccccgatt tagagcttgacggggaaagccggcgaacgtggcgagaaaggaagggaaga aagcgaaaggagcgggcgctagggcgctggcaagtgtagcggtcacgctg cgcgtaaccaccacacccgccgcgcttaatgcgccgctacagggcgcgtc ccattcgccattcaggctgcgcaactgttgggaagggcgatcggtgcggg cctcttcgctattacgccagctggcgaaagggggatgtgctgcaaggcga ttaagttgggtaacgccagggttttcccagtcacgacgttgtaaaacgac ggccagtgagcgcgcgtaatacgactcactatagggcgaattgggtaccg ggccccccctcgatcgaggtcgacggtatcggggggagctcgcagggtctc cattttgaagcgggaggtttgaacgcgcag |
| 203 | 17AALH5C_ AAV6_H642N_ pAAV-DJ | ccgccatgccggggttttacgagattgtgattaaggtccccagcgaccttt gacgagcatctgcccggcatttctgacagctttgtgaactgggtggccga gaaggaatgggagttgccgccagattctgacatggatctgaatctgattg agcaggcaccccctgaccgtggccgagaagctgcagcgcgactttctgacg gaatggcgccgtgtgagtaaggcccccggaggcccttttctttgtgcaatt tgagaagggagagagctacttccacatgcacgtgctcgtggaaaccaccg gggtgaaatccatggttttgggacgtttcctgagtcagattcgcgaaaaa ctgattcagagaatttaccgcgggatcgagccgactttgccaaactggtt cgcggtcacaaagaccagaaatggcgccggaggcgggaacaaggtggtgg atgagtgctacatccccaattacttgctccccaaaaacccagcctgagctc cagtgggcgtggactaatatggaacagtatttaagcgcctgtttgaatct cacggagcgtaaacggttggtggcgcagcatctgacgcacgtgtcgcaga cgcaggagcagaacaaagagaatcagaatcccaattctgatgcgccggtg atcagatcaaaaacttcagccaggtacatggagctggtcggctggctcgt ggacaaggggattacctcggagaagcagtggatccaggaggaccaggcct catacatctccttcaatgcggcctccaactcgcggtcccaaatcaaggct gccttggacaatgcgggaaagattatgagcctgactaaaaccgcccccga ctacctggtgggccagcagcccgtggaggacatttccagcaatcggattt ataaaattttggaactaaacgggtacgatccccaatatgcggcttccgtc tttctgggatgggccacgaaaaagttcggcaagaggaacaccatctggct gtttgggcctgcaactaccgggaagaccaacatcgcggaggccatagccc acactgtgccttctacgggtgcgtaaactggaccaatgagaactttccc ttcaacgactgtgtcgacaagatggtgatctggtgggaggaggggaagat gaccgccaaggtcgtggagtcggccaaagccattctcggaggaagcaagg tgcgcgtggaccagaaatgcaagtcctcggcccagatagacccgactccc gtgatcgtcacctccaacaccaacatgtgcgccgtgattgacgggaactc aacgaccttcgaacaccagcagccgttgcaagaccggatgttcaaatttg aactcacccgccgtctggatcatgactttgggaaggtcaccaagcaggaa gtcaaagactttttccgtgggcaaaggatcacgtggttgagtgggagca tgaattctacgtcaaaaagggtggagccaagaaaagacccgccccccagtg acgcagatataagtgagcccaaacgggtgcgcgagtcagttgcgcagcca tcgacgtcagacgcggaagcttcgatcaactacgcagacaggtaccaaaa caaatgttctcgtcacgtgggcatgaatctgatgctgtttcctgcagac aatgcgagagaatgaatcagaattcaaatatctgcttcactcacggacag aaagactgtttgagtgctttcccgtgtcagaatctcaacccgtttctgt cgtcaaaaaggcgtatcagaaactgtgctacattcatcatatcatgggaa aggtgccagacgcttgcactgcctgcgatctggtcaatgtggatttggat gactgcatctttgaacaataaatgatttaaatcaggtatggctgccgatg gttatcttccagattggctcgaggacaacctctctgagggcattcgcgag |

TABLE 12-continued

AAV6 Mutant Plasmid vector sequences

| SEQ ID NO | Construct | Sequence |
|---|---|---| tggtgggacttgaaacctggagccccgaaacccaaagccaaccagcaaaa
gcaggacgacggccggggtctggtgcttcctggctacaagtacctcggac
ccttcaacggactcgacaagggggagcccgtcaacgcggcggatgcagcg
gccctcgagcacgacaaggcctacgaccagcagctcaaagcgggtgacaa
tccgtacctgcggtataaccacgccgacgccgagtttcaggagcgtctgc
aagaagatacgtcttttgggggcaacctcgggcgagcagtcttccaggcc
aagaagagggttctcgaaccttttggtctggttgaggaaggtgctaagac
ggctcctggaaagaaacgtccggtagagcagtcgccacaagagccagact
cctcctcgggcattggcaagacaggccagcagcccgctaaaaagagactc
aattttggtcagactggcgactcagagtcagtcccgacccacaacctct
cggagaacctccagcaaccccccgctgctgtgggacctactacaatggctt
caggcggtggcgcaccaatggcagacaataacgaaggcgccgacggagtg
ggtaatgcctcaggaaattggcattgcgattccacatggctgggcgacag
agtcatcaccaccagcacccgaacatgggccttgcccacctataacaacc
acctctacaagcaaatctccagtgcttcaacggggccagcaacgacaac
cactacttcggctacagcacccccctgggggtattttgatttcaacagatt
ccactgccatttctcaccacgtgactggcagcgactcatcaacaacaatt
ggggattccggcccaagagactcaacttcaagctcttcaacatccaagtc
aaggaggtcacgacgaatgatggcgtcacgaccatcgctaataaccttac
cagcacggttcaagtcttctcggactcggagtaccagttgccgtacgtcc
tcggctctgcgcaccagggctgcctccctccgttcccggcggacgtgttc
atgattccgcagtacggctacctaacgctcaacaatggcagcaggcagt
gggacggtcatccttttactgcctggaatatttcccatcgcagatgctga
gaacgggcaataactttaccttcagctacaccttcgaggacgtgccttc
cacagcagctacgcgcacagccagagcctggaccggctgatgaatcctct
catcgaccagtacctgtattacctgaacagaactcagaatcagtccggaa
gtgcccaaaacaaggacttgctgtttagccgggggtctccagctggcatg
tctgttcagcccaaaaactggctacctggaccctgttaccggcagcagcg
cgtttctaaaacaaaaacagacaacaacaacagcaactttacctggactg
gtgcttcaaaatataaccttaatgggcgtgaatctataatcaaccctggc
actgctatggcctcacacaaagacgacaaagacaagttctttcccatgag
cggtgtcatgattttttggaaaggagagcgccggagcttcaaacactgcat
tggacaatgtcatgatcacagacgaagaggaaatcaaagccactaacccc
gtggccaccgaaagatttgggactgtggcagtcaatctccagagcagcag
cacagaccctgcgaccggagatgtgcatgttatgggagccttacctggaa
tggtgtggcaagacagagacgtatacctgcagggtcctattgggccaaa
attcctcacacgga tggacactttcacccgtctcctctcatgggcggctt
tggacttaagaacccgcctcctcagatcctcatcaaaaacacgcctgttc
ctgcgaatcctccggcagagttttcggctacaaagtttgcttcattcatc
acccagtattccacaggacaagtgagcgtggagattgaatgggagctgca
gaaagaaaacagcaaacgctggaatcccgaagtgcagtatacatctaact
atgcaaaatctgccaacgttgatttcactgtggacaacaatggactttat
actgagcctcgccccattggcacccgttacctcacccgtccctgtaatt
gtgtgttaatcaataaccggttgattcgtttcagttgaactttggtctc
tgcgaagggcgaattcgtttaaacctgcaggactagaggtcctgtattag
aggtcacgtgagtgttttgcgacattttgcgacaccatgtggtcacgctg
ggtatttaagcccgagtgagcacgcagggtctccattttgaagcgggagg
tttgaacgcgcagccgccaagccgaattctgcagatatccatcacactgg
cggccgctcgactagagcggccgccaccgcggtggagctccagcttttgt
tccctttagtgagggttaattgcgcgcttggcgtaatcatggtcatagct
gtttcctgtgtgaaattgttatccgctcacaattccacacaacatacgag
ccggaagcataaagtgtaaagcctggggtgcctaatgagtgagctaactc
acattaattgcgttgcgctcactgcccgctttccagtcgggaaacctgtc
gtgccagctgcattaatgaatcggccaacgcgcggggagaggcggtttgc
gtattgggcgctcttccgcttcctcgctcactgactcgctgcgctcggtc
gttcggctgcggcgagcggtatcagctcactcaaaggcggtaatacggtt
atccacagaatcaggggataacgcaggaaagaacatgtgagcaaaaggcc
agcaaaaggccaggaaccgtaaaaaggccgcgttgctggcgtttttccat
aggctccgcccccctgacgagcatcacaaaaatcgacgctcaagtcagag
gtggcgaaacccgacaggactataaagataccaggcgtttccccctggaa
gctccctcgtgcgctctcctgttccgaccctgccgcttaccggatacctg
tccgcctttctcccttcgggaagcgtggcgctttctcatagctcacgctg
taggtatctcagttcggtgtaggtcgttcgctccaagctgggctgtgtgc
acgaaccccccgttcagcccgaccgctgcgccttatccggtaactatcgt
cttgagtccaacccggtaagacacgacttatcgccactggcagcagccac
tggtaacaggattagcagagcgaggtatgtaggcggtgctacagagttct
tgaagtggtggcctaactacggctacactagaagaacagtatttggtatc
tgcgctctgctgaagccagttaccttcggaaaaagagttggtagctcttg
atccggcaaacaaaccaccgctggtagcggtggtttttttgtttgcaagc
agcagattacgcgcagaaaaaaaggatctcaagaagatcctttgatcttt
tctacggggtctgacgctcagtggaacgaaaactcacgttaagggatttt
ggtcatgagattatcaaaaaggatcttcacctagatccttttaaattaaa
aatgaagttttaaatcaatctaaagtatatatgagtaaacttggtctgac
agttaccaatgcttaatcagtgaggcacctatctcagcgatctgtctatt TABLE 12-continued AAV6 Mutant Plasmid vector sequences

| SEQ ID NO | Construct | Sequence |
|---|---|---|
|  |  | tcgttcatccatagttgcctgactcccgtcgtgtagataactacgatac gggagggcttaccatctggccccagtgctgcaatgataccgcgagaccca cgctcaccggctccagatttatcagcaataaaccagccagccggaagggc cgagcgcagaagtggtcctgcaactttatccgcctccatccagtctatta attgttgccgggaagctagagtaagtagttcgccagttaatagtttgcgc aacgttgttgccattgctacaggcatcgtggtgtcacgctcgtcgtttgg tatggcttcattcagctccggttcccaacgatcaaggcgagttacatgat cccccatgttgtgcaaaaaagcggttagctccttcggtcctccgatcgtt gtcagaagtaagttggccgcagtgttatcactcatggttatggcagcact gcataattctcttactgtcatgccatccgtaagatgcttttctgtgactg gtgagtactcaaccaagtcattctgagaatagtgtatgcggcgaccgagt tgctcttgcccggcgtcaatacgggataataccgcgccacatagcagaac tttaaaagtgctcatcattggaaaacgttcttcggggcgaaaactctcaa ggatcttaccgctgttgagatccagttcgatgtaacccactcgtgcaccc aactgatcttcagcatcttttactttcaccagcgtttctgggtgagcaaa aacaggaaggcaaaatgccgcaaaaaagggaataagggcgacacggaaat gttgaatactcatactcttcctttttcaatattattgaagcatttatcag ggttattgtctcatgagcggatacatatttgaatgtatttagaaaaataa acaaataggggttccgcgcacatttccccgaaaagtgccacctaaattgt aagcgttaatattttgttaaaattcgcgttaaattttgttaaatcagct cattttttaaccaataggccgaaatcggcaaaatcccttataaatcaaaa gaatagaccgagatagggttgagtgttgttccagtttggaacaagagtcc actattaaagaacgtggactccaacgtcaaagggcgaaaaaccgtctatc agggcgatggcccactacgtgaaccatcaccctaatcaagttttttgggg tcgaggtgccgtaaagcactaaatcggaaccctaaagggagcccccgatt tagagcttgacggggaaagccggcgaacgtggcgagaaaggaagggaaga aagcgaaaggagcgggcgctagggcgctggcaagtgtagcggtcacgctg cgcgtaaccaccacacccgccgcgcttaatgcgccgctacagggcgcgtc ccattcgccattcaggctgcgcaactgttgggaagggcgatcggtgcggg cctcttcgctattacgccagctggcgaaagggggatgtgctgcaaggcga ttaagttgggtaacgccagggttttcccagtcacgacgttgtaaaacgac ggccagtgagcgcgcgtaatacgactcactatagggcgaattgggtaccg ggccccccctcgatcgaggtcgacggtatcgggggagctcgcagggtctc cattttgaagcgggaggtttgaacgcgcag |
| 204 | 17AALH6C_ AAV6_F129L_ H642N_pAAV-DJ | ccgccatgccggggttttacgagattgtgattaaggtccccagcgaccttgacgagcatctgcccggcatttctgacagctttgtgaactgggtggccgagaaggaatgggagttgccgccagattctgcatggatctgaatctgattgagcaggcaccccctgaccgtggccgagaagctgcagcgcgactttctgacggaatggcgccgtgtgagtaaggcccccggaggccctttctttgtgcattgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatcccaatatgcggcttccgtctttctgggatgggccacgaaaaagttcggcaagaggaacaccatctggctgtttgggcctgcaactaccgggaagaccaacatcgcggaggccatagcccacactgtgccttctacgggtgcgtaaactggaccaatgagaactttccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatatatgtgagcccaaacgggtgcgcgagtcagttgcgcagccatcgacgtcagacgcggaagcttcgatcaactacgcagacaggtaccaaaaacaaatgttctcgtcacgtgggcatgaatctgatgctgtttccctgcagacaatgcgagagaatgaatcagaattcaaatatctgcttcactcacgacaaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgag |

TABLE 12-continued

AAV6 Mutant Plasmid vector sequences

| SEQ ID NO | Construct | Sequence |
|---|---|---|
| | | tggtgggacttgaaacctggagccccgaaacccaaagccaaccagcaaaa gcaggacgacggccggggtctggtgcttcctggctacaagtacctcggac ccttcaacggactcgacaaggggagcccgtcaacgcggcggatgcagcg gccctcgagcacgacaaggcctacgaccagcagctcaaagcgggtgacaa tccgtacctgcggtataaccacgccgacgccgagtttcaggagcgtctgc aagaagatacgtcttttgggggcaacctcgggcgagcagtcttccaggcc aagaagagggttctcgaaccttttaggtctggttgaggaaggtgctaagac ggctcctggaaagaaacgtccggtagagcagtcgccacaagagccagact cctcctcgggcattggcaagacaggccagcagcccgctaaaaagagactc aattttggtcagactggcgactcagagtcagtcccgacccacaacctct cggagaacctccagcaaccccgctgctgtgggacctactacaatggctt caggcggtggcgcaccaatggcagacaataacgaaggcgccgacggagtg ggtaatgcctcaggaaattggcattgcgattccacatggctgggcgacag agtcatcaccaccagcacccgaacatgggcctt gcccacctataacaacc acctctacaagcaaatctccagtgcttcaacggggccagcaacgacaac cactacttcggctacagcacccctgggggtattttgatttcaacagatt ccactgccatttctcaccacgtgactggcagcgactcatcaacaacaatt ggggattccggcccaagagactcaacttcaagctcttcaacatccaagtc aaggaggtcacgacgaatgatggcgtcacgaccatcgctaataaccttac cagcacggttcaagtcttctcggactcggagtaccagttgccgtacgtcc tcggctctgcgcaccagggctgcctccctccgttcccggcggacgtgttc atgattccgcagtacggctacctaacgctcaacaatggcagcc aggcagt gggacggtcatccttttactgcctggaatatttcccatcgcagatgctga gaacgggcaataactttaccttcagctacaccttcgaggacgtgccttt c cacagcagctacgcgcacagccagagcctggaccggctgatgaatcctct catcgaccagtacctgtattacctgaacagaactcagaatcagtccggaa gtgcccaaaacaaggacttgctgtttagccgggggtctccagctggcatg tctgttcagcccaaaaactggctacctggaccctgttaccggcagcagcg cgtttctaaaacaaaaacagacaacaacaacagcaactttacctggactg gtgcttcaaaatataaccttaatgggcgtgaatctataatcaaccctggc actgctatggcctcacacaaagacgacaaagacaagttctttcccatgag cggtgtcatgatttttggaaaggagagcgccggagcttcaaacactgcat tggacaatgtcatgatcacagacgaagaggaaatcaaagccactaaccc gtggccaccgaaagatttgggactgtggcagtcaatctccagagcagcag cacagaccctgcgaccggagatgtgcatgttatgggagccttacctggaa tggtgtggcaagacagagacgtataccctgcagggtcctattgggcaaa attcctcacacgatggacacttcaccgctctcctctcatgggcggctt tggacttaagaacccgcctcctcagatcctcatcaaaacacgctgttc ctgcgaatcctccggcagagttttcggctacaaagtttgcttcattcatc acccagtattccacaggacaagtgagcgtggagattgaatgggagctgca gaaagaaaacagcaaacgctggaatcccgaagtgcagtatacatctaact atgcaaaatctgccaacgttgatttcactgtggacaacaatggactttat actgagcctcgcccccattggcacccgttacctcacccgtccctgtaatt gtgtgttaatcaataaaccggttgattcgtttcagttgaactttggtctc tgcgaagggcgaattcgtttaaacctgcaggactagaggtcctgtattag aggtcacgtgagtgttttgcgacatttttgcgacaccatgtggtcacgctg ggtatttaagcccgagtgagcacgcagggtctccattttgaagcgggagg tttgaacgcgcagccgccaagccgaattctgcagatatccatcacactgg cggccgctcgactagagcggccgccaccgcggtggagctccagcttttgt tccctttagtgagggttaattgcgcgcttggcgtaatcatggtcatagct gtttcctgtgtgaaattgttatccgctcacaattccacacaacatacgag ccggaagcataaagtgtaaagcctggggtgcctaatgagtgagctaactc acattaattgcgttgcgctcactgcccgctttccagtcgggaaacctgtc gtgccagctgcattaatgaatcggccaacgcgcggggagaggcggtttgc gtattgggcgctcttccgcttcctcgctcactgactcgctgcgctcggtc gttcggctgcggcgagcggtatcagctcactcaaaggcggtaatacggtt atccacagaatcaggggataacgcaggaaagaacatgtgagcaaaaggcc agcaaaaggccaggaaccgtaaaaaggccgcgttgctggcgtttttccat aggctccgcccccctgacgagcatcacaaaaatcgacgctcaagtcagag gtggcgaaacccgacaggactataaagataccaggcgtttccccctggaa gctccctcgtgcgctctcctgttccgaccctgccgcttaccggatacctg tccgcctttctcccttcgggaagcgtggcgctttctcatagctcacgctg taggtatctcagttcggtgtaggtcgttcgctccaagctgggctgtgtgc acgaaccccccgttcagcccgaccgctgcgccttatccggtaactatcgt cttgagtccaacccggtaagacacgacttatcgccactggcagcagccac tggtaacaggattagcagagcgaggtatgtaggcggtgctacagagttct tgaagtggtggcctaactacggctacactagaagaacagtatttggtatc tgcgctctgctgaagccagttaccttcggaaaaagagttggtagctcttg atccggcaaacaaaccaccgctggtagcggtggtttttttgtttgcaagc agcagattacgcgcagaaaaaaaggatctcaagaagatcctttgatcttt tctacggggtctgacgctcagtggaacgaaaactcacgttaagggatttt ggtcatgagattatcaaaaaggatcttcacctagatccttttaaattaaa aatgaagttttaaatcaatctaaagtatatatgagtaaacttggtctgac agttaccaatgcttaatcagtgaggcacctatctcagcgatctgtctatt |

TABLE 12-continued

AAV6 Mutant Plasmid vector sequences

| SEQ ID NO | Construct | Sequence |
|---|---|---|
| | | tcgttcatccatagttgcctgactcccgtcgtgtagataactacgatac<br>gggagggcttaccatctggccccagtgctgcaatgataccgcgagaccca<br>cgctcaccggctccagatttatcagcaataaaccagccagccggaagggc<br>cgagcgcagaagtggtcctgcaactttatccgcctccatccagtctatta<br>attgttgccgggaagctagagtaagtagttcgccagttaatagtttgcgc<br>aacgttgttgccattgctacaggcatcgtggtgtcacgctcgtcgtttgg<br>tatggcttcattcagctccggttcccaacgatcaaggcgagttacatgat<br>cccccatgttgtgcaaaaaagcggttagctccttcggtcctccgatcgtt<br>gtcagaagtaagttggccgcagtgttatcactcatggttatggcagcact<br>gcataattctcttactgtcatgccatccgtaagatgcttttctgtgactg<br>gtgagtactcaaccaagtcattctgagaatagtgtatgcggcgaccgagt<br>tgctcttgcccggcgtcaatacgggataataccgcgccacatagcagaac<br>tttaaaagtgctcatcattggaaaacgttcttcggggcgaaaactctcaa<br>ggatcttaccgctgttgagatccagttcgatgtaacccactcgtgcaccc<br>aactgatcttcagcatcttttactttcaccagcgtttctgggtgagcaaa<br>aacaggaaggcaaaatgccgcaaaaaagggaataagggcgacacggaaat<br>gttgaatactcatactcttcctttttcaatattattgaagcatttatcag<br>ggttattgtctcatgagcggatacatatttgaatgtatttagaaaaataa<br>acaaatagggttccgcgcacatttccccgaaaagtgccacctaaattgt<br>aagcgttaatattttgttaaaattcgcgttaaattttgttaaatcagct<br>catttttaaccaataggccgaaatcggcaaaatcccttataaatcaaaa<br>gaatagaccgagatagggttgagtgttgttccagtttggaacaagagtcc<br>actattaaagaacgtggactccaacgtcaaagggcgaaaaaccgtctatc<br>agggcgatggcccactacgtgaaccatcaccctaatcaagttttttgggg<br>tcgaggtgccgtaaagcactaaatcggaaccctaaagggagcccccgatt<br>tagagcttgacggggaaagccggcgaacgtggcgagaaaggaagggaaga<br>aagcgaaaggagcgggcgctaggcgctggcaagtgtagcggtcacgctg<br>cgcgtaaccaccacacccgccgcgcttaatgcgccgctacagggcgcgtc<br>ccattcgccattcaggctgcgcaactgttgggaagggcgatcggtgcggg<br>cctcttcgctattacgccagctggcgaaaggggatgtgctgcaaggcga<br>ttaagttgggtaacgccagggttttcccagtcacgacgttgtaaaacgac<br>ggccagtgagcgcgcgtaatacgactcactatagggcgaattgggtaccg<br>ggccccccctcgatcgaggtcgacggtatcggggggagctcgcagggtctc<br>cattttgaagcgggaggtttgaacgcgcag |
| 205 | 17AALH7C_<br>AAV6_F129L_<br>L584D_pAAV-<br>DJ | ccgccatgccggggttttacgagattgtgattaaggtccccagcgacctt<br>gacgagcatctgcccggcatttctgacagctttgtgaactgggtggccga<br>gaaggaatgggagttgccgccagattctgcatggatctgaatctgattg<br>agcaggcacccctgaccgtggccgagaagctgcagcgcgactttctgacg<br>gaatggcgccgtgtgagtaaggcccccggaggcccttttcttttgcaatt<br>tgagaagggagagagctacttccacatgcacgtgctcgtggaaaccaccg<br>gggtgaaatccatggttttgggacgtttcctgagtcagattcgcgaaaaa<br>ctgattcagagaatttaccgcgggatcgagccgactttgccaaactggtt<br>cgcggtcacaaagaccagaaatggcgccggaggcgggaacaaggtggtgg<br>atgagtgctacatccccaattacttgctccccaaaacccagcctgagctc<br>cagtgggcgtggactaatatggaacagtatttaagcgcctgtttgaatct<br>cacggagcgtaaacggttggtggcgcagcatctgacgcacgtgtcgcaga<br>cgcaggagcagaacaaagagaatcagaatcccaattctgatgcgcggtg<br>atcagatcaaaaacttcagccaggtacatggagctggtcgggtggctcgt<br>ggacaaggggattacctcggagaagcagtggatccaggaggaccaggcct<br>catacatctccttcaatgcggcctccaactcgcggtcccaaatcaaggct<br>gccttggacaatgcgggaaagattatgagcctgactaaaaccgcccccga<br>ctacctggtgggccagcagcccgtggaggacatttccagcaatcggattt<br>ataaaattttggaactaaacgggtacgatcccaatatgcggcttccgtc<br>tttctgggatgggccacgaaaaagttcggcaagaggaacaccatctggct<br>gtttgggcctgcaactaccgggaagaccaacatcgcggaggccatagccc<br>acactgtgccttctacgggtgcgtaaactggaccaatgagaactttccc<br>ttcaacgactgtgtcgacaagatggtgatctggtgggaggagggggaagat<br>gaccgccaaggtcgtggagtcggccaaagccattctcggaggaagcaagg<br>tgcgcgtggaccagaaatgcaagtcctcggcccagatagcccgactccc<br>gtgatcgtcacctccaacaccaacatgtgcgccgtgattgacgggaactc<br>aacgacccttcgaacaccagcagccgttgcaagaccggatgttcaaatttg<br>aactcacccgccgtctggatcatgactttgggaaggtcaccaagcaggaa<br>gtcaaagacttttttccggtgggcaaaggatcacgtggttgaggtggagca<br>tgaattctacgtcaaaaagggtggagccaagaaaagacccgcccccagtg<br>acgcagatataagtgagcccaaacgggtgcgcgagtcagttgcgcagcca<br>tcgacgtcagacgcggaagcttcgatcaactacgcagacaggtaccaaaa<br>caaatgttctcgtcacgtgggcatgaatctgatgctgtttccctgcagac<br>aatgcgagagaatgaatcagaattcaaatatctgcttcactcacggacga<br>aaagactgtttagagtgctttcccgtgtcagaatctcaacccgtttctgt<br>cgtcaaaaaggcgtatcagaaactgtgctacattcatcatatcatgggaa<br>aggtgccagacgcttgcactgcctgcgatctggtcaatgtggatttggat<br>gactgcatctttgaacaataaatgatttaaatcaggtatggctgccgatg<br>gttatcttccagattggctcgaggacaacctctctgagggcattcgcgag |

TABLE 12-continued

AAV6 Mutant Plasmid vector sequences

| SEQ ID NO | Construct | Sequence |
|---|---|---|
| | | tggtgggacttgaaacctggagccccgaaacccaaagccaaccagcaaaa gcaggacgacggccggggtctggtgcttcctggctacaagtacctcggac ccttcaacggactcgacaaggggagcccgtcaacgcggcggatgcagcg gccctcgagcacgacaaggcctacgaccagcagctcaaagcgggtgacaa tccgtacctgcggtataaccacgccgacgccgagtttcaggagcgtctgc aagaagatacgtcttttgggggcaacctcgggcgagcagtcttccaggcc aagaagagggttctcgaaccttttaggtctggttgaggaaggtgctaagac ggctcctggaaagaaacgtccggtagagcagtcgccacaagagccagact cctcctcgggcattggcaagacaggccagcagcccgctaaaaagagactc aattttggtcagactggcgactcagagtcagtccccgacccacaacctct cggagaacctccagcaaccccccgctgctgtgggacctactacaatggctt caggcggtggcgcaccaatggcagacaataacgaaggcgccgacggagtg ggtaatgcctcaggaaattggcattgcgattccacatggctgggcgacag agtcatcaccaccagcacccgaacatgggccttgcccacctataacaacc acctctacaagcaaatctccagtgcttcaacggggccagcaacgacaac cactacttcggctacagcaccccctggggtattttgatttcaacagatt ccactgccatttctcaccacgtgactggcagcgactcatcaacaacaatt ggggattccggcccaagagactcaacttcaagctcttcaacatccaagtc aaggaggtcacgacgaatgatggcgtcacgaccatcgctaataaccttac cagcacggttcaagtcttctcggactcggagtaccagttgccgtacgtcc tcggctctgcgcaccagggctgcctccctccgttcccggcggacgtgttc atgattccgcagtacggctacctaacgctcaacaatggcagccaggcagt gggacggtcatccttttactgcctggaatatttcccatcgcagatgctga gaacgggcaataactttaccttcagctacaccttcgaggacgtgcctttc cacagcagctacgcgcacagccagagcctggaccggctgatgaatcctct catcgaccagtacctgtattacctgaacagaactcagaatcagtccggaa gtgcccaaaacaaggacttgctgtttagccgggggtctccagctggcatg tctgttcagcccaaaaactggctacctggaccctgttaccggcagcagcg cgtttctaaaacaaaaacagacaacaacaacagcaactttacctggactg gtgcttcaaaatataaccttaatgggcgtgaatctataatcaaccctggc actgctatggcctcacacaaagacgacaaagacaagttctttcccatgag cggtgtcatgattttttggaaaggagagcgccggagcttcaaacactgcat tggacaatgtcatgatcacagacgaagaggaaatcaaagccactaacccc gtggccaccgaaagatttgggactgtggcagtcaatgaccagagcagcag cacagaccctgcgaccggagatgtgcatgttatgggagccttacctggaa tggtgtggcaagacagagacgtatacctgcagggtcctattgggccaaaa attcctcacacggatggacactttcacccgtctcctctcatgggcggctt tggacttaagcacccgcctcctcagatcctcatcaaaaacacgctgttc ctgcgaatcctccggcagagttttcggctacaaagtttgcttcattcatc acccagtattccacaggacaagtgagcgtggagattgaatgggagctgca gaaagaaaacagcaaacgctggaatcccgaagtgcagtatacatctaact atgcaaaatctgccaacgttgatttcactgtggacaacaatggactttat actgagcctcgcccattggcacccgttacctcacccgtccctgtaatt gtgtgttaatcaataaccggttgattcgtttcagttgaactttggtctc tgcgaagggcgaattcgtttaaacctgcaggactagaggtcctgtattag aggtcacgtgagtgttttgcgacattttgcgacaccatgtggtcacgctg ggtatttaagcccgagtgagcacgcagggtctccattttgaagcgggagg tttgaacgcgcagccgccaagccgaattctgcagatatccatcacactgg cggccgctcgactagagcggccgccaccgcggtggagctccagcttttgt tccctttagtgagggttaattgcgcgcttggcgtaatcatggtcatagct gtttcctgtgtgaaattgttatccgctcacaattccacacaacatacgag ccggaagcataaagtgtaaagcctggggtgcctaatgagtgagctaactc acattaattgcgttgcgctcactgcccgctttccagtcgggaaacctgtc gtgccagctgcattaatgaatcggccaacgcgcggggagaggcggtttgc gtattgggcgctcttccgcttcctcgctcactgactcgctgcgctcggtc gttcggctgcggcgagcggtatcagctcactcaaaggcggtaatacggtt atccacagaatcaggggataacgcaggaaagaacatgtgagcaaaaggcc agcaaaaggccaggaaccgtaaaaaggccgcgttgctggcgtttttccat aggctccgcccccctgacgagcatcacaaaaatcgacgctcaagtcagag gtggcgaaacccgacaggactataaagataccaggcgtttccccctggaa gctccctcgtgcgctctcctgttccgaccctgccgcttaccggatacctg tccgcctttctcccttcgggaagcgtggcgctttctcatagctcacgctg taggtatctcagttcggtgtaggtcgttcgctccaagctgggctgtgtgc acgaaccccccgttcagcccgaccgctgcgccttatccggtaactatcgt cttgagtccaacccggtaagacacgacttatcgccactggcagcagccac tggtaacaggattagcagagcgaggtatgtaggcggtgctacagagttct tgaagtggtggcctaactacggctacactagaagaacagtatttggtatc tgcgctctgctgaagccagttaccttcggaaaaagagttggtagctcttg atccggcaaacaaaccaccgctggtagcggtggtttttttgtttgcaagc agcagattacgcgcagaaaaaaaggatctcaagaagatcctttgatcttt tctacggggtctgacgctcagtggaacgaaaactcacgttaagggatttt ggtcatgagattatcaaaaaggatcttcacctagatccttttaaattaaa aatgaagttttaaatcaatctaaagtatatatgagtaaacttggtctgac agttaccaatgcttaatcagtgaggcacctatctcagcgatctgtctatt |

TABLE 12-continued

AAV6 Mutant Plasmid vector sequences

| SEQ ID NO | Construct | Sequence |
|---|---|---|
| | | tcgttcatccatagttgcctgactcccgtcgtgtagataactacgatac ggggagggcttaccatctggcccccagtgctgcaatgataccgcgagaccca cgctcaccggctccagatttatcagcaataaaccagccagccggaagggc cgagcgcagaagtggtcctgcaactttatccgcctccatccagtctatta attgttgccgggaagctagagtaagtagttcgccagttaatagtttgcgc aacgttgttgccattgctacaggcatcgtggtgtcacgctcgtcgtttgg tatggcttcattcagctccggttcccaacgatcaaggcgagttacatgat cccccatgttgtgcaaaaaagcggttagctccttcggtcctccgatcgtt gtcagaagtaagttggccgcagtgttatcactcatggttatggcagcact gcataattctcttactgtcatgccatccgtaagatgcttttctgtgactg gtgagtactcaaccaagtcattctgagaatagtgtatgcggcgaccgagt tgctcttgcccggcgtcaatacgggataataccgcgccacatagcagaac tttaaaagtgctcatcattggaaaacgttcttcggggcgaaaactctcaa ggatcttaccgctgttgagatccagttcgatgtaacccactcgtgcaccc aactgatcttcagcatcttttactttcaccagcgtttctgggtgagcaaa aacaggaaggcaaaatgccgcaaaaaagggaataagggcgacacggaaat gttgaatactcatactcttcctttttcaatattattgaagcatttatcag ggttattgtctcatgagcggatacatatttgaatgtatttagaaaaataa acaaataggggttccgcgcacatttccccgaaaagtgccacctaaattgt aagcgttaatattttgttaaaattcgcgttaaattttttgttaaatcagct catttttaaccaataggccgaaatcggcaaaatcccttataaatcaaaa gaatagaccgagataggttgagtgttgttccagtttggaacaagagtcc actattaaagaacgtggactccaacgtcaaagggcgaaaaaccgtctatc agggcgatggcccactacgtgaaccatcaccctaatcaagttttttgggg tcgaggtgccgtaaagcactaaatcggaaccctaaagggagcccccgatt tagagcttgacggggaaagccggcgaacgtggcgagaaaggaagggaaga aagcgaaaggagcgggcgctagggcgctggcaagtgtagcggtcacgctg cgcgtaaccaccacacccgccgcgcttaatgcgccgctacagggcgcgtc ccattcgccattcaggctgcgcaactgttgggaagggcgatcggtgcggg cctcttcgctattacgccagctggcgaaagggggatgtgctgcaaggcga ttaagttgggtaacgccagggttttcccagtcacgacgttgtaaaacgac ggccagtgagcgcgcgtaatacgactcactatagggcgaattgggtaccg ggccccccctcgatcgaggtcgacggtatcggggggagctcgcagggtctc cattttgaagcgggaggtttgaacgcgcag |
| 206 | 17AALIAC_ AAV6_F129L_ D418N_pAAV- DJ | ccgccatgccggggttttacgagattgtgattaaggtccccagcgacctt gacgagcatctgcccggcatttctgacagctttgtgaactgggtggccga gaaggaatgggagttgccgccagattctgcatggatctgaatctgattg agcaggcaccccctgaccgtggccgagaagctgcagcgcgactttctgacg gaatggcgccgtgtgagtaaggcccccggaggccccttttttctttgtcaatt tgagaagggagagagctacttccacatgcacgtgctcgtggaaaccaccg gggtgaaatccatggttttgggacgtttcctgagtcagattcgcgaaaaa ctgattcagagaatttaccgcgggatcgagccgactttgccaaactggtt cgcggtcacaaagaccagaaatggcgccggaggcgggaacaaggtggtgg atgagtgctacatccccaattacttgctccccaaaacccagcctgagctc cagtgggcgtggactaatatggaacagtatttaagcgcctgtttgaatct cacggagcgtaaacggttggtggcgcagcatctgacgcacgtgtcgcaga cgcaggagcagaacaaagagaatcagaatcccaattctgatgcgccggtg atcagatcaaaaacttcagccaggtacatggagctggtcggtggctcgt ggacaaggggattacctcggagaagcagtggatccaggaggaccaggcct catacatctccttcaatgcggcctccaactcgcggtcccaaatcaaggct gccttggacaatgcgggaaagattatgagcctgactaaaaccgcccccga ctacctggtgggccagcagcccgtggaggacatttccagcaatcggattt ataaaattttggaactaaacgggtacgatccccaatatgcggcttccgtc tttctgggatgggccacgaaaaagttcggcaagaggaacaccatctggct gtttgggcctgcaactaccgggaagaccaacatcgcggaggccatagccc acactgtgcccttctacggtgcgtaaactggaccaatgagaactttccc ttcaacgactgtgtcgacaagatggtgatctggtgggaggaggggaagat gaccgccaaggtcgtggagtcggccaaagccattctcggaggaagcaagg tgcgcgtggaccagaaatgcaagtcctcggcccagatagacccgactccc gtgatcgtcacctccaacaccaacatgtgcgccgtgattgacgggaactc aacgaccttcgaacaccagcagccgttgcaagaccggatgttcaaatttg aactcacccgccgtctggatcatgactttgggaaggtcaccaagcaggaa gtcaaagactttttccggtgggcaaaggatcacgtggttgaggtggagca tgaattctacgtcaaaaagggtggagccaagaaaagacccgccccccagtg acgcagatataagtgagcccaaacgggtgcgcgagtcagttgcgcagcca tcgacgtcagacgcggaagcttcgatcaactacgcagacaggtaccaaaa caaatgttctcgtcacgtgggcatgaatctgatgctgtttccctgcagac aatgcgagagaatgaatcagaattcaaatatctgcttcatcacgcagag aaagactgtttagagtgcttccccgtgtcagaatctcaacccgtttctgt cgtcaaaaaggcgtatcagaaactgtgctacattcatcatatcatgggaa aggtgccagacgcttgcactgcctgcgatctggtcaatgtggatttggat gactgcatctttgaacaataaaatgatttaaatcaggtatggctgccgatg gttatcttccagattggctcgaggacaacctctctgagggcattcgcgag |

TABLE 12-continued

AAV6 Mutant Plasmid vector sequences

| SEQ ID NO | Construct | Sequence |
|---|---|---|
| | | tggtgggacttgaaacctggagccccgaaacccaaagccaaccagcaaaa gcaggacgacggccggggtctggtgcttcctggctacaagtacctcggac ccttcaacggactcgacaaggggagcccgtcaacgcggcggatgcagcg gccctcgagcacgacaaggcctacgaccagcagctcaaagcgggtgacaa tccgtacctgcggtataaccacgccgacgccgagtttcaggagcgtctgc aagaagatacgtcttttgggggcaacctcgggcgagcagtcttccaggcc aagaagagggttctcgaaccttttaggtctggttgaggaaggtgctaagac ggctcctggaaagaaacgtccggtagagcagtcgccacaagagccagact cctcctcgggcattggcaagacaggccagcagcccgctaaaaagagactc aatttttggtcagactggcgactcagagtcagtccccgacccacaacctct cggagaacctccagcaaccccccgctgctgtgggacctactacaatggctt caggcggtggcgcaccaatggcagacaataacgaaggcgccgacggagtg ggtaatgcctcaggaaattggcattgcgattccacatggctgggcgacag agtcatcaccaccagcacccgaacatgggccttgcccacctataacaacc acctctacaagcaaatctccagtgcttcaacggggccagcaacgacaac cactacttcggctacagcaccccctgggggtattttgatttcaacagatt ccactgccatttctcaccacgtgactggcagcgactcatcaacaacaatt ggggattccggcccaagagactcaacttcaagctcttcaacatccaagtc aaggaggtcacgacgaatgatggcgtcacgaccatcgctaataaccttac cagcacggttcaagtcttctcggactcggagtaccagttgccgtacgtcc tcggctctgcgcaccagggctgcctccctccgttcccggcggacgtgttc atgattccgcagtacggctacctaacgctcaacaatggcagcaggcagt gggacggtcatcctttttactgcctggaatatttcccatcgcagatgctga gaacgggcaataactttacccttcagctacaccttcgagaacgtgccttt cacagcagctacgcgcacagccagagcctggaccggctgatgaatcctct catcgaccagtacctgtattacctgaacagaactcagaatcagtccggaa gtgcccaaaacaaggacttgctgtttagccgggggtctccagctggcatg tctgttcagcccaaaaactggctacctggaccctgttaccggcagcagcg cgtttctaaaacaaaaacagacaacaacaacagcaactttacctggactg gtgcttcaaaatataaccttaatgggcgtgaatctataatcaaccctggc actgctatggcctcacacaaagacgacaaagacaagttctttcccatgag cggtgtcatgattttttggaaaggagagcgccggagcttcaaacactgcat tggacaatgtcatgatcacagacgaagaggaaatcaaagccactaacccc gtggccaccgaaagatttgggactgtggcagtcaatctccagagcagcag cacagaccctgcgaccggagatgtgcatgttatgggagcctacctggaa tggtgtggcaagacagagacgtatacctgcagggtcctattgggccaaa attcctcacacgggatggacactttcacccgtctcctctcatgggcggct ttggacttaagcacccgcctcctcagatcctcatcaaaaacacgctgttc ctgcgaatcctccggcagagttttcggctacaaagtttgcttcattcatc acccagtattccacaggacaagtgagcgtggagattgaatgggagctgca gaaagaaaacagcaaacgctggaatcccgaagtgcagtatacatctaact atgcaaaatctgccaacgttgatttcactgtggacaacaatggactttat actgagcctcgcccccattggcacccgttacctcacccgtcccctgtaatt gtgtgttaatcaataaccggttgattcgtttcagttgaactttggtctc tgcgaagggcgaattcgtttaaacctgcaggactagaggtcctgtattag aggtcacgtgagtgttttgcgacatttttgcgacaccatgtggtcacgctg ggtatttaagcccgagtgagcacgcagggtctccatttttgaagcgggagg tttgaacgcgcagccgccaagccgaattctgcagatatccatcacactgg cggccgctcgactagagcggccgccaccgcggtggagctccagcttttgt tccctttagtgagggttaattgcgcgcttggcgtaatcatggtcatagct gtttcctgtgtgaaattgttatccgctcacaattccacacaacatacgag ccggaagcataaagtgtaaagcctggggtgcctaatgagtgagctaactc acattaattgcgttgcgctcactgcccgctttccagtcgggaaacctgtc gtgccagctgcattaatgaatcggccaacgcgcggggagaggcggtttgc gtattgggcgctcttccgcttcctcgctcactgactcgctgcgctcggtc gttcggctgcggcgagcggtatcagctcactcaaaggcggtaatacggtt atccacagaatcaggggataacgcaggaaagaacatgtgagcaaaaggcc agcaaaaggccaggaaccgtaaaaaggccgcgttgctggcgtttttccat aggctccgcccccctgacgagcatcacaaaaatcgacgctcaagtcagag gtggcgaaacccgacaggactataaagataccaggcgtttccccctggaa gctccctcgtgcgctctcctgttccgaccctgccgcttaccggatacctg tccgcctttctcccttcgggaagcgtggcgctttctcatagctcacgctg taggtatctcagttcggtgtaggtcgttcgctccaagctgggctgtgtgc acgaaccccccgttcagcccgaccgctgcgccttatccggtaactatcgt cttgagtccaacccggtaagacacgacttatcgccactggcagcagccac tggtaacaggattagcagagcgaggtatgtaggcggtgctacagagttct tgaagtggtggcctaactacggctacactagaagaacagtatttggtatc tgcgctctgctgaagccagttaccttcggaaaaagagttggtagctcttg atccggcaaacaaaccaccgctggtagcggtggtttttttgtttgcaagc agcagattacgcgcagaaaaaaaggatctcaagaagatcctttgatcttt tctacggggtctgacgctcagtggaacgaaaactcacgttaagggattt ggtcatgagattatcaaaaaggatcttcacctagatccttttaaattaaa aatgaagttttaaatcaatctaaagtatatatgagtaaacttggtctgac agttaccaatgcttaatcagtgaggcacctatctcagcgatctgtctatt |

TABLE 12-continued

AAV6 Mutant Plasmid vector sequences

| SEQ ID NO | Construct | Sequence |
|---|---|---|
| | | tcgttcatccatagttgcctgactcccgtcgtgtagataactacgatac
ggggagggcttaccatctggcccccagtgctgcaatgataccgcgagaccca
cgctcaccggctccagatttatcagcaataaaccagccagccggaagggc
cgagcgcagaagtggtcctgcaactttatccgcctccatccagtctatta
attgttgccgggaagctagagtaagtagttcgccagttaatagtttgcgc
aacgttgttgccattgctacaggcatcgtggtgtcacgctcgtcgtttgg
tatggcttcattcagctccggttcccaacgatcaaggcgagttacatgat
cccccatgttgtgcaaaaaagcggttagctccttcggtcctccgatcgtt
gtcagaagtaagttggccgcagtgttatcactcatggttatggcagcact
gcataattctcttactgtcatgccatccgtaagatgcttttctgtgactg
gtgagtactcaaccaagtcattctgagaatagtgtatgcggcgaccgagt
tgctcttgcccggcgtcaatacgggataataccgcgccacatagcagaac
tttaaaagtgctcatcattggaaaacgttcttcggggcgaaaactctcaa
ggatcttaccgctgttgagatccagttcgatgtaacccactcgtgcaccc
aactgatcttcagcatcttttactttcaccagcgtttctgggtgagcaaa
aacaggaaggcaaaatgccgcaaaaaagggaataagggcgacacggaaat
gttgaatactcatactcttcctttttcaatattattgaagcatttatcag
ggttattgtctcatgagcggatacatatttgaatgtatttagaaaaataa
acaaataggggttccgcgcacatttccccgaaaagtgccacctaaattgt
aagcgttaatattttgttaaaattcgcgttaaattttgttaaatcagct
catttttaaccaataggccgaaatcggcaaaatcccttataaatcaaaa
gaatagaccgagatagggttgagtgttgttccagtttggaacaagagtcc
actattaaagaacgtggactccaacgtcaaagggcgaaaaaccgtctatc
agggcgatggcccactacgtgaaccatcaccctaatcaagttttttgggg
tcgaggtgccgtaaagcactaaatcggaaccctaaagggagcccccgatt
tagagcttgacggggaaagccggcgaacgtggcgagaaaggaagggaaga
aagcgaaaggagcgggcgctagggcgctggcaagtgtagcggtcacgctg
cgcgtaaccaccacacccgccgcgcttaatgcgccgctacagggcgcgtc
ccattcgccattcaggctgcgcaactgttgggaagggcgatcggtgcggg
cctcttcgctattacgccagctggcgaaagggggatgtgctgcaaggcga
ttaagttgggtaacgccagggttttcccagtcacgacgttgtaaaacgac
ggccagtgagcgcgcgtaatacgactcactatagggcgaattgggtaccg
ggccccccctcgatcgaggtcgacggtatcggggggagctcgcagggtctc
cattttgaagcgggaggtttgaacgcgcag |
| 207 | 17AALIBC_AAV6_F129L_L584H_pAAV-DJ | ccgccatgccggggttttacgagattgtgattaaggtccccagcgaccttgacgagcatctgcccggcatttctgacagctttgtgaactgggtggccgagaaggaatgggagttgccgccagattctgcattggatctgaatctgattgagcaggcaccccctgaccgtggccgagaagctgcagcgcgactttctgacgaatggcgccgtgtgagtaaggccccggaggccctttcttttgtcaatttgagaagggagagagctacttccacatgcacgtgctcgtggaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaatttggaactaaacgggtacgatcccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggagggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagcaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacgacagaaagactgtttagagtgctttcccgtgtcagaatctcaaccccgtttctgtcgtcaaaaaggcgtatcagaaactgtgctacattcatcatatcatgggaaaggtgccagacgcttgcactgcctgcgatctggtcaatgtggatttggatgactgcatctttgaacaataaaatgatttaaatcaggtatggctgccgatggttatcttccagattggctcgaggacaacctctctgagggcattcgcgag |

TABLE 12-continued

AAV6 Mutant Plasmid vector sequences

| SEQ ID NO | Construct | Sequence |
|---|---|---|
| | | tggtgggacttgaaacctggagccccgaaacccaaagccaaccagcaaaa
gcaggacgacggccggggtctggtgcttcctggctacaagtacctcggac
ccttcaacggactcgacaaggggggagcccgtcaacgcggcggatgcagcg
gccctcgagcacgacaaggcctacgaccagcagctcaaagcgggtgacaa
tccgtacctgcggtataaccacgccgacgccgagtttcaggagcgtctgc
aagaagatacgtctttttgggggcaacctcgggcgagcagtcttccaggcc
aagaagagggttctcgaacctttaggtctggttgaggaaggtgctaagac
ggctcctggaaagaaacgtccggtagagcagtcgccacaagagccagact
cctcctcgggcattggcaagacaggccagcagcccgctaaaaagagactc
aattttggtcagactggcgactcagagtcagtccccgacccacaacctct
cggagaacctccagcaaccccccgctgctgtgggacctactacaatggctt
caggcggtggcgcaccaatggcagacaataacgaaggcgccgacggagtg
ggtaatgcctcaggaaattggcattgcgattccacatggctgggcgacag
agtcatcaccaccagcacccgaacatgggccttgcccacctataacaacc
acctctacaagcaaatctccagtgcttcaacggggggccagcaacgacaac
cactacttcggctacagcacccccctgggggtatttttgatttcaacagatt
ccactgccatttctcaccacgtgactggcagcgactcatcaacaacaatt
ggggattccggcccaagagactcaacttcaagctcttcaacatccaagtc
aaggaggtcacgacgaatgatggcgtcacgaccatcgctaataaccttac
cagcacggttcaagtcttctcggactcggagtaccagttgccgtacgtcc
tcggctctgcgcaccagggctgcctccctccgttcccggcggacgtgttc
atgattccgcagtacggctacctaacgctcaacaatggcagcaggcagt
gggacggtcatccttttactgcctggaatatttcccatcgcagatgctga
gaacgggcaataactttaccttcagctacaccttcgaggacgtgccttttc
cacagcagctacgcgcacagccagagcctggaccggctgatgaatcctct
catcgaccagtacctgtattacctgaacagaactcagaatcagtccggaa
gtgcccaaaacaaggacttgctgtttagccgggggtctccagctggcatg
tctgttcagcccaaaactggctacctggaccctgttaccggcagcagcg
cgtttctaaaacaaaaacagacaacaacaacagcaactttacctggactg
gtgcttcaaaatataaccttaatgggcgtgaatctataatcaaccctggc
actgctatggcctcacacaaagacgacaaagacaagttctttcccatgag
cggtgtcatgatttttggaaaggagagcgccggagcttcaaacactgcat
tggacaatgtcatgatcacagacgaagaggaaatcaaagccactaacccc
gtggccaccgaaagatttgggactgtggcagtcaatcaccagagcagcag
cacagaccctgcgaccggagatgtgcatgttatgggagccttacctggaa
tggtgtggcaagacagagacgtatacctgcagggtcctattgtgggccaaa
attcctcacacggatggacactttcacccgtctcctctcatgggcggctt
tggacttaagcacccgcctcctcagatcctcatcaaaaacacgctgttc
ctgcgaatcctccggcagagttttcggctacaaagtttgcttcattcatc
acccagtattccacaggacaagtgagcgtggagattgaatgggagctgca
gaaagaaaacagcaaacgctggaatcccgaagtgcagtatacatctaact
atgcaaaatctgccaacgttgatttcactgtggacaacaatggactttat
actgagcctcgcccattggcacccgttacctcacccgtccctgtaatt
gtgtgttaatcaataaaccggttgattcgtttcagttgaactttggtctc
tgcgaagggcgaattcgtttaaacctgcaggactagaggtcctgtattag
aggtcacgtgagtgttttgcgacattttgcgacaccatgtggtcacgctg
ggtatttaagcccgagtgagcacgcagggtctccatttttgaagcgggagg
tttgaacgcgcagccgccaagccgaattctgcagatatccatcacactgg
cggccgctcgactagagcggccgccaccgcggtggagctccagcttttgt
tccctttagtgagggttaattgcgcgcttggcgtaatcatggtcatagct
gtttcctgtgtgaaattgttatccgctcacaattccacacaacatacgag
ccggaagcataaagtgtaaagcctggggtgcctaatgagtgagctaactc
acattaattgcgttgcgctcactgcccgctttccagtcgggaaacctgtc
gtgccagctgcattaatgaatcggccaacgcgcggggagaggcggtttgc
gtattgggcgctcttccgcttcctcgctcactgactcgctgcgctcggtc
gttcggctgcggcgagcggtatcagctcactcaaaggcggtaatacggtt
atccacagaatcaggggataacgcaggaaagaacatgtgagcaaaaggcc
agcaaaaggccaggaaccgtaaaaaggccgcgttgctggcgtttttccat
aggctccgcccccctgacgagcatcacaaaaatcgacgctcaagtcagag
gtggcgaaacccgacaggactataaagataccaggcgtttccccctggaa
gctccctcgtgcgctctcctgttccgaccctgccgcttaccggatacctg
tccgcctttctcccttcgggaagcgtggcgctttctcatagctcacgctg
taggtatctcagttcggtgtaggtcgttcgctccaagctgggctgtgtgc
acgaaccccccgttcagcccgaccgctgcgccttatccggtaactatcgt
cttgagtccaacccggtaagacacgacttatcgccactggcagcagccac
tggtaacaggattagcagagcgaggtatgtaggcggtgctacagagttct
tgaagtggtggcctaactacggctacactagaagaacagtatttggtatc
tgcgctctgctgaagccagttaccttcggaaaaagagttggtagctcttg
atccggcaaacaaaccaccgctggtagcggtggtttttttgtttgcaagc
agcagattacgcgcagaaaaaaaggatctcaagaagatcctttgatctttt
ctacggggtctgacgctcagtggaacgaaaactcacgttaagggatttt
ggtcatgagattatcaaaaaggatcttcacctagatccttttaaattaaa
aatgaagttttaaatcaatctaaagtatatatgagtaaacttggtctgac
agttaccaatgcttaatcagtgaggcacctatctcagcgatctgtctatt |

TABLE 12-continued

AAV6 Mutant Plasmid vector sequences

| SEQ ID NO | Construct | Sequence |
|---|---|---|
| | | tcgttcatccatagttgcctgactcccgtcgtgtagataactacgatac<br>gggagggcttaccatctggcccagtgctgcaatgataccgcgagaccca<br>cgctcaccggctccagatttatcagcaataaaccagccagccggaagggc<br>cgagcgcagaagtggtcctgcaactttatccgcctccatccagtctatta<br>attgttgccgggaagctagagtaagtagttcgccagttaatagtttgcgc<br>aacgttgttgccattgctacaggcatcgtggtgtcacgctcgtcgtttgg<br>tatggcttcattcagctccggttcccaacgatcaaggcgagttacatgat<br>cccccatgttgtgcaaaaaagcggttagctccttcggtcctccgatcgtt<br>gtcagaagtaagttggccgcagtgttatcactcatggttatggcagcact<br>gcataattctcttactgtcatgccatccgtaagatgcttttctgtgactg<br>gtgagtactcaaccaagtcattctgagaatagtgtatgcggcgaccgagt<br>tgctcttgcccggcgtcaatacgggataataccgcgccacatagcagaac<br>tttaaaagtgctcatcattggaaaacgttcttcggggcgaaaactctcaa<br>ggatcttaccgctgttgagatccagttcgatgtaacccactcgtgcaccc<br>aactgatcttcagcatcttttactttcaccagcgtttctgggtgagcaaa<br>aacaggaaggcaaaatgccgcaaaaaagggaataagggcgacacggaaat<br>gttgaatactcatactcttccttttcaatattattgaagcatttatcag<br>ggttattgtctcatgagcggatacatatttgaatgtatttagaaaaataa<br>acaaataggggttccgcgcacatttccccgaaaagtgccacctaaattgt<br>aagcgttaatattttgttaaaattcgcgttaaattttgttaaatcagct<br>cattttttaaccaataggccgaaatcggcaaaatcccttataaatcaaaa<br>gaatagaccgagatagggttgagtgttgttccagtttggaacaagagtcc<br>actattaaagaacgtggactccaacgtcaaagggcgaaaaaccgtctatc<br>agggcgatggcccactacgtgaaccatcaccctaatcaagttttttgggg<br>tcgaggtgccgtaaagcactaaatcggaaccctaaagggagcccccgatt<br>tagagcttgacggggaaagccggcgaacgtggcgagaaaggaagggaaga<br>aagcgaaaggagcgggcgctagggcgctggcaagtgtagcggtcacgctg<br>cgcgtaaccaccacacccgccgcgcttaatgcgccgctacagggcgcgtc<br>ccattcgccattcaggctgcgcaactgttgggaagggcgatcggtgcggg<br>cctcttcgctattacgccagctggcgaaagggggatgtgctgcaaggcga<br>ttaagttgggtaacgccagggttttcccagtcacgacgttgtaaaacgac<br>ggccagtgagcgcgcgtaatacgactcactatagggcgaattgggtaccg<br>ggccccccctcgatcgaggtcgacggtatcgggggagctcgcagggtctc<br>cattttgaagcgggaggtttgaacgcgcag |
| 208 | 17AALICC_6_<br>F129L_H642N_<br>D418N_pAAV-<br>DJ | ccgccatgccggggttttacgagattgtgattaaggtccccagcgaccttt<br>gacgagcatctgcccggcatttctgacagctttgtgaactgggtggccga<br>gaaggaatgggagttgccgccagattctgcatggatctgaatctgattg<br>agcaggcaccccctgaccgtggccgagaagctgcagcgcgactttctgacg<br>gaatggcgccgtgtgagtaaggcccccggaggcccttttctttgtgcaatt<br>tgagaagggagagagctacttccacatgcacgtgctcgtggaaaccaccg<br>gggtgaaatccatggttttgggacgtttcctgagtcagattcgcgaaaaa<br>ctgattcagagaatttaccgcgggatcgagccgactttgccaaactggtt<br>cgcggtcacaaagaccagaaatggcgccggaggcgggaacaaggtggtgg<br>atgagtgctacatccccaattacttgctccccaaaacccagcctgagctc<br>cagtgggcgtggactaatatggaacagtatttaagcgcctgtttgaatct<br>cacggagcgtaaacggttggtggcgcagcatctgacgcacgtgtcgcaga<br>cgcaggagcagaacaaagagaatcagaatcccaattctgatgcgccggtg<br>atcagatcaaaaacttcagccaggtacatggagctggtcgggtggctcgt<br>ggacaaggggattacctcggagaagcagtggatccaggaggaccaggcct<br>catacatctccttcaatgcggcctccaactcgcggtcccaaatcaaggct<br>gccttggacaatgcgggaaagattatgagcctgactaaaaccgcccccga<br>ctacctggtgggccagcagcccgtggaggacatttccagcaatcggattt<br>ataaaattttggaactaaacgggtacgatcccaatatgcggcttccgtc<br>tttctgggatgggccacgaaaaagttcggcaagaggaacaccatctggct<br>gtttgggcctgcaactaccgggaagaccaacatcgcggaggccatagccc<br>acactgtgcccttctacgggtgcgtaaactggaccaatgagaactttccc<br>ttcaacgactgtgtcgacaagatggtgatctggtgggaggagggggaagat<br>gaccgccaaggtcgtggagtcggccaaagccattctcggaggaagcaagg<br>tgcgcgtggaccagaaatgcaagtcctcggcccagatagaccccgactcc<br>gtgatcgtcacctccaacaccaacatgtgcgccgtgattgacgggaactc<br>aacgaccttcgaacaccagcagccgttgcaagaccggatgttcaaatttg<br>aactcacccgccgtctggatcatgactttgggaaggtcaccaagcaggaa<br>gtcaaagacttttttccggtgggcaaaggatcacgtggttgaggtggagca<br>tgaattctacgtcaaaaagggtggagccaagaaaaagaccccgcccccagtg<br>acgcagatataagtgagcccaaacgggtgcgcgagtcagttgcgcagcca<br>tcgacgtcagacgcggaagcttcgatcaactacgcagacaggtaccaaaa<br>caaatgttctcgtcacgtgggcatgaatctgatgctgtttccctgcagac<br>aatgcgagagaatgaatcagaattcaaatatctgcttcactcacggacag<br>aaagactgtttagagtgctttcccgtgtcagaatctcaacccgtttctgt<br>cgtcaaaaaggcgtatcagaaactgtgctacattcatcatatcatgggaa<br>aggtgccagacgcttgcactgcctgcgatctggtcaatgtggatttggat<br>gactgcatctttgaacaataaaatgatttaaatcaggtatggctgccgatg<br>gttatcttccagattggctcgaggacaacctctctgagggcattcgcgag |

TABLE 12-continued

AAV6 Mutant Plasmid vector sequences

| SEQ ID NO | Construct | Sequence |
|---|---|---|
| | | tggtgggacttgaaacctggagccccgaaacccaaagccaaccagcaaaa
gcaggacgacggccggggtctggtgcttcctggctacaagtacctcggac
ccttcaacggactcgacaaggggagcccgtcaacgcggcggatgcagcg
gccctcgagcacgacaaggcctacgaccagcagctcaaagcgggtgacaa
tccgtacctgcggtataaccacgccgacgccgagtttcaggagcgtctgc
aagaagatacgtcttttgggggcaacctcgggcgagcagtcttccaggcc
aagaagagggttctcgaaccttttaggtctggttgaggaaggtgctaagac
ggctcctggaaagaaacgtccggtagagcagtcgccacaagagccagact
cctcctcgggcattggcaagacaggccagcagcccgctaaaaagagactc
aattttggtcagactggcgactcagagtcagtccccgacccacaacctct
cggagaacctccagcaaccccgctgctgtgggacctactacaatggctt
caggcggtggcgcaccaatggcagacaataacgaaggcgccgacggagtg
ggtaatgcctcaggaaattggcattgcgattccacatggctgggcgacag
agtcatcaccaccagcacccgaacatgggccttgcccacctataacaacc
acctctacaagcaaatctccagtgcttcaacggggccagcaacgacaac
cactacttcggctacagcaccccctggggtattttgatttcaacagatt
ccactgccatttctcaccacgtgactggcagcgactcatcaacaacaatt
ggggattccggcccaagagactcaacttcaagctcttcaacatccaagtc
aaggaggtcacgacgaatgatggcgtcacgaccatcgctaataaccttac
cagcacggttcaagtcttctcggactcggagtaccagttgccgtacgtcc
tcggctctgcgcaccagggctgcctccctccgttcccggcggacgtgttc
atgattccgcagtacggctacctaacgctcaacaatggcagccaggcagt
gggacggtcatcctttactgcctggaatatttcccatcgcagatgctga
gaacgggcaataactttaccttcagctacaccttcgagaacgtgccttc
cacagcagctacgcgcacagccagagcctggaccggctgatgaatcctct
catcgaccagtacctgtattacctgaacagaactcagaatcagtccggaa
gtgcccaaaacaaggacttgctgtttagccggggtctccagctggcatg
tctgttcagcccaaaaactggctacctggaccctgttaccggcagcagcg
cgtttctaaaacaaaaacagacaacaacaacagcaactttacctggactg
gtgcttcaaaatataaccttaatgggcgtgaatctataatcaaccctggc
actgctatggcctcacacaaagacgacaaagacaagttctttcccatgag
cggtgtcatgattttttggaaaggagagcgccggagcttcaaacactgcat
tggacaatgtcatgatcacagacgaagaggaaatcaaagccactaacccc
gtggccaccgaaagatttgggactgtggcagtcaatctccagagcagcag
cacagaccctgcgaccggagatgtgcatgttatgggagccttacctggaa
tggtgtggcaagacagagacgtatacctgcagggtcctattgggccaaa
attcctcacacggatggacactttcacccgtctcctctcatgggcggctt
tggacttaagaacccgcctcctcagatcctcatcaaaaacacgcctgttc
ctgcgaatcctccggcagagttttcggctacaaagtttgcttcattcatc
acccagtattccacaggacaagtgagcgtggagattgaatgggagctgca
gaaagaaaacagcaaacgctggaatcccgaagtgcagtatacatctaact
atgcaaaatctgccaacgttgatttcactgtggacaacaatggactttat
actgagcctcgccccattggcacccgttacctcacccgtccctgtaatt
gtgtgttaatcaataaccggttgattcgtttcagttgaactttggtctc
tgcgaagggcgaattcgttaaacctgcaggactagaggtcctgtattag
aggtcacgtgagtgttttgcgacattttgcgacaccatgtggtcacgctg
ggtatttaagcccgagtgagcacgcagggtctccattttgaagcgggagg
tttgaacgcgcagccgccaagccgaattctgcagatatccatcacactgg
cggccgctcgactagagcggccgccaccgcggtggagctccagcttttgt
tcccttagtgagggttaattgcgcgcttggcgtaatcatggtcatagct
gtttcctgtgtgaaattgttatccgctcacaattccacacaacatacgag
ccggaagcataaagtgtaaagcctggggtgcctaatgagtgagctaactc
acattaattgcgttgcgctcactgcccgctttccagtcgggaaacctgtc
gtgccagctgcattaatgaatcggccaacgcgcggggagaggcggtttgc
gtattgggcgctcttccgcttcctcgctcactgactcgctgcgctcggtc
gttcggctgcggcgagcggtatcagctcactcaaaggcggtaatacggtt
atccacagaatcaggggataacgcaggaaagaacatgtgagcaaaaggcc
agcaaaaggccaggaaccgtaaaaaggccgcgttgctggcgtttttccat
aggctccgcccccctgacgagcatcacaaaaatcgacgctcaagtcagag
gtggcgaaacccgacaggactataaagataccaggcgtttccccctggaa
gctccctcgtgcgctctcctgttccgaccctgccgcttaccggatacctg
tccgcctttctcccttcgggaagcgtggcgctttctcatagctcacgctg
taggtatctcagttcggtgtaggtcgttcgctccaagctgggctgtgtgc
acgaacccccgttcagcccgaccgctgcgccttatccggtaactatcgt
cttgagtccaacccggtaagacacgacttatcgccactggcagcagccac
tggtaacaggattagcagagcgaggtatgtaggcggtgctacagagttct
tgaagtggtggcctaactacggctacactagaagaacagtatttggtatc
tgcgctctgctgaagccagttaccttcggaaaaagagttggtagctcttg
atccggcaaacaaaccaccgctggtagcggtggtttttttgtttgcaagc
agcagattacgcgcagaaaaaaaggatctcaagaagatcctttgatcttt
tctacggggtctgacgctcagtggaacgaaaactcacgttaagggatttt
ggtcatgagattatcaaaaaggatcttcacctagatccttttaaattaaa
aatgaagttttaaatcaatctaaagtatatatgagtaaacttggtctgac
agttaccaatgcttaatcagtgaggcacctatctcagcgatctgtctatt |

TABLE 12-continued

AAV6 Mutant Plasmid vector sequences

| SEQ ID NO | Construct | Sequence |
|---|---|---|
| | | tcgttcatccatagttgcctgactcccgtcgtgtagataactacgatac<br>gggagggcttaccatctggccccagtgctgcaatgataccgcgagaccca<br>cgctcaccggctccagatttatcagcaataaaccagccagccggaagggc<br>cgagcgcagaagtggtcctgcaactttatccgcctccatccagtctatta<br>attgttgccgggaagctagagtaagtagttcgccagttaatagtttgcgc<br>aacgttgttgccattgctacaggcatcgtggtgtcacgctcgtcgtttgg<br>tatggcttcattcagctccggttcccaacgatcaaggcgagttacatgat<br>cccccatgttgtgcaaaaaagcggttagctccttcggtcctccgatcgtt<br>gtcagaagtaagttggccgcagtgttatcactcatggttatggcagcact<br>gcataattctcttactgtcatgccatccgtaagatgcttttctgtgactg<br>gtgagtactcaaccaagtcattctgagaatagtgtatgcggcgaccgagt<br>tgctcttgcccggcgtcaatacgggataataccgcgccacatagcagaac<br>tttaaaagtgctcatcattggaaaacgttcttcggggcgaaaactctcaa<br>ggatcttaccgctgttgagatccagttcgatgtaacccactcgtgcaccc<br>aactgatcttcagcatcttttactttcaccagcgtttctgggtgagcaaa<br>aacaggaaggcaaaatgccgcaaaaaagggaataagggcgacacggaaat<br>gttgaatactcatactcttccttttcaatattattgaagcatttatcag<br>ggttattgtctcatgagcggatacatatttgaatgtatttagaaaaataa<br>acaaataggggttccgcgcacatttccccgaaaagtgccacctaaattgt<br>aagcgttaatattttgttaaaattcgcgttaaattttttgttaaatcagct<br>cattttttaaccaataggccgaaatcggcaaaatcccttataaatcaaaa<br>gaatagaccgagatagggttgagtgttgttccagtttggaacaagagtcc<br>actattaaagaacgtggactccaacgtcaaagggcgaaaaaccgtctatc<br>agggcgatggcccactacgtgaaccatcaccctaatcaagttttttgggg<br>tcgaggtgccgtaaagcactaaatcggaaccctaaagggagcccccgatt<br>tagagcttgacggggaaagccggcgaacgtggcgagaaaggaagggaaga<br>aagcgaaaggagcgggcgctagggcgctggcaagtgtagcggtcacgctg<br>cgcgtaaccaccacacccgccgcgcttaatgcgccgctacagggcgcgtc<br>ccattcgccattcaggctgcgcaactgttgggaagggcgatcggtgcggg<br>cctcttcgctattacgccagctggcgaaaggggggatgtgctgcaaggcga<br>ttaagttgggtaacgccagggttttcccagtcacgacgttgtaaaacgac<br>ggccagtgagcgcgcgtaatacgactcactatagggcgaattgggtaccg<br>ggccccccctcgatcgaggtcgacggtatcgggggagctcgcagggtctc<br>cattttgaagcgggaggtttgaacgcgcag |
| 209 | 17AALIDC_6_<br>F129L_H642N_<br>L584D_pAAV-<br>DJ | ccgccatgccggggttttacgagattgtgattaaggtccccagcgaccctt<br>gacgagcatctgcccggcatttctgacagctttgtgaactgggtggccga<br>gaaggaatgggagttgccgccagattctgcatggatctgaatctgattg<br>agcaggcacccctgaccgtggccgagaagctgcagcgcgactttctgacg<br>gaatggcgccgtgtgagtaaggcccccggaggcccttttctttgtcaatt<br>tgagaagggagagagctacttccacatgcacgtgctcgtggaaaccaccg<br>gggtgaaatccatggttttgggacgtttcctgagtcagattcgcgaaaaa<br>ctgattcagagaatttaccgcgggatcgagccgactttgccaaactggtt<br>cgcggtcacaaagaccagaaatggcgccggaggcgggaacaaggtggtgg<br>atgagtgctacatccccaattacttgctccccaaaacccagcctgagctc<br>cagtgggcgtggactaatatggaacagtatttaagcgcctgtttgaatct<br>cacggagcgtaaacggttggtggcgcagcatctgacgcacgtgtcgcaga<br>cgcaggagcagaacaaagagaatcagaatcccaattctgatgcgccggtg<br>atcagatcaaaaacttcagccaggtacatggagctggtcgggtggctcgt<br>ggacaaggggattacctcggagaagcagtggatccaggaggaccaggcct<br>catacatctccttcaatgcggcctccaactcgcggtcccaaatcaaggct<br>gccttggacaatgcgggaaagattatgagcctgactaaaaccgcccccga<br>ctacctggtgggccagcagcccgtggaggacatttccagcaatcggattt<br>ataaaattttggaactaaacgggtacgatcccaatatgcggcttccgtc<br>tttctgggatgggccacgaaaaagttcggcaagaggaacaccatctggct<br>gtttgggcctgcaactaccgggaagaccaacatcgcggaggccatagccc<br>acactgtgccttctacgggtgcgtaaactggaccaatgagaactttccc<br>ttcaacgactgtgtcgacaagatggtgatctggtgggaggaggggaagat<br>gaccgccaaggtcgtggagtcggccaaagccattctcggaggaagcaagg<br>tgcgcgtggaccagaaatgcaagtcctcggcccagatagcccgactccc<br>gtgatcgtcacctccaacaccaacatgtgcgccgtgattgacgggaactc<br>aacgaccttcgaacaccagcagccgttgcaagaccggatgttcaaatttg<br>aactcacccgccgtctggatcatgactttgggaaggtcaccaagcaggaa<br>gtcaaagactttttccggtgggcaaaggatcacgtggttgaggtggagca<br>tgaattctacgtcaaaaagggtggagccaagaaaagacccgccccagtg<br>acgcagatataagtgagcccaaacgggtgcgcgagtcagttgcgcagcca<br>tcgacgtcagacgcggaagcttcgatcaactacgcagacaggtaccaaaa<br>caaatgttctcgtcacgtgggcatgaatctgatgctgtttccctgcagac<br>aatgcgagagaatgaatcagaattcaaatatctgcttcactcacggacag<br>aaagactgtttagagtgcttcccgtgtcagaatctcaacccgtttctgt<br>cgtcaaaaaggcgtatcagaaactgtgctacattcatcatatcatgggaa<br>aggtgccagacgcttgcactgcctgcgatctggtcaatgtggatttggat<br>gactgcatctttgaacaataaatgatttaaatcaggtatggctgccgatg<br>gttatcttccagattggctcgaggacaacctctctgagggcattcgcgag |

TABLE 12-continued

AAV6 Mutant Plasmid vector sequences

| SEQ ID NO | Construct | Sequence |
|---|---|---|
| | | tggtgggacttgaaacctggagccccgaaacccaaagccaaccagcaaaa gcaggacgacggccggggtctggtgcttcctggctacaagtacctcggac ccttcaacggactcgacaaggggagcccgtcaacgcggcggatgcagcg gccctcgagcacgacaaggcctacgaccagcagctcaaagcgggtgacaa tccgtacctgcggtataaccacgccgacgccgagtttcaggagcgtctgc aagaagatacgtcttttgggggcaacctcgggcgagcagtcttccaggcc aagaagagggttctcgaacctttaggtctggttgaggaaggtgctaagac ggctcctggaaagaaacgtccggtagagcagtcgccacaagagccagact cctcctcgggcattggcaagacaggccagcagcccgctaaaaagagactc aattttggtcagactggcgactcagagtcagtcccgacccacaacctct cggagaacctccagcaaccccgctgctgtgggacctactacaatggctt caggcggtggcgcaccaatggcagacaataacgaaggcgccgacggagtg ggtaatgcctcaggaaattggcattgcgattccacatggctgggcgacag agtcatcaccaccagcacccgaacatgggccttgcccacctataacaacc acctctacaagcaaatctccagtgcttcaacggggccagcaacgacaac cactacttcggctacagcaccccctgggggtattttgatttcaacagatt ccactgccatttctcaccacgtgactggcagcgactcatcaacaacaatt ggggattccggcccaagagactcaacttcaagctcttcaacatccaagtc aaggaggtcacgacgaatgatggcgtcacgaccatcgctaataaccttac cagcacggttcaagtcttctcggactcggagtaccagttgccgtacgtcc tcggctctgcgcaccagggctgcctccctccgttcccggcggacgtgttc atgattccgcagtacggctacctaacgctcaacaatggcagccaggcagt gggacggtcatccttttactgcctggaatatttcccatcgcagatgctga gaacgggcaataactttaccttcagctacaccttcgaggacgtgccttc cacagcagctacgcgcacagccagagcctggaccggctgatgaatcctct catcgaccagtacctgtattacctgaacagaactcagaatcagtccggaa gtgcccaaaacaaggacttgctgtttagccgggggtctccagctggcatg tctgttcagcccaaaaactggctacctggaccctgttaccggcagcagcg cgtttctaaaacaaaaacagacaacaacaacagcaactttacctggactg gtgcttcaaaatataaccttaatgggcgtgaatctataatcaaccctggc actgctatggcctcacacaaagacgacaaagacaagttctttcccatgag cggtgtcatgattttggaaaggagagcgccggagcttcaaacactgcat tggacaatgtcatgatcacagacgaagaggaaatcaaagccactaacccc gtggccaccgaaagatttgggactgtggcagtcaatgaccagagcagcag cacagaccctgcgaccggagatgtgcatgttatgggagccttacctggaa tggtgtggcaagacagagacgtatacctgcagggtcctattgggccaaa attcctcacacggatggacactttcacccgtctcctctcatgggcggctt tggacttaagaacccgcctcctcagatcctcatcaaaaacacgctgttc ctgcgaatcctccggcagagttttcggctacaaagtttgcttcattcatc acccagtattccacaggacaagtgagcgtggagattgaatgggagctgca gaaagaaaacagcaaacgctggaatcccgaagtgcagtatacatctaact atgcaaaatctgccaacgttgatttcactgtggacaacaatggactttat actgagcctcgcccattggcacccgttacctcacccgtccctgtaatt gtgtgttaatcaataaaccggttgattcgtttcagttgaactttggtctc tgcgaagggcgaattcgtttaaacctgcaggactagaggtcctgtattag aggtcacgtgagtgttttgcgacattttgcgacaccatgtggtcacgctg ggtatttaagcccgagtgagcacgcagggtctccattttgaagcgggagg tttgaacgcgcagccgccaagccgaattctgcagatatccatcacactgg cggccgctcgactagagcggccgccaccgcggtggagctccagcttttgt tcccttagtgagggttaattgcgcgcttggcgtaatcatggtcatagct gtttcctgtgtgaaattgttatccgctcacaattccacacaacatacgag ccggaagcataaagtgtaaagcctggggtgcctaatgagtgagctaactc acattaattgcgttgcgctcactgcccgctttccagtcgggaaacctgtc gtgccagctgcattaatgaatcggccaacgcgcggggagaggcggtttgc gtattgggcgctcttccgcttcctcgctcactgactcgctgcgctcggtc gttcggctgcggcgagcggtatcagctcactcaaaggcggtaatacggtt atccacagaatcaggggataacgcaggaaagaacatgtgagcaaaaggcc agcaaaaggccaggaaccgtaaaaaggccgcgttgctggcgtttttccat aggctccgcccccctgacgagcatcacaaaaatcgacgctcaagtcagag gtggcgaaacccgacaggactataaagataccaggcgtttccccctggaa gctccctcgtgcgctctcctgttccgaccctgccgcttaccggatacctg tccgcctttctcccttcgggaagcgtggcgctttctcatagctcacgctg taggtatctcagttcggtgtaggtcgttcgctccaagctgggctgtgtgc acgaaccccccgttcagcccgaccgctgcgccttatccggtaactatcgt cttgagtccaacccggtaagacacgacttatcgccactggcagcagccac tggtaacaggattagcagagcgaggtatgtaggcggtgctacagagttct tgaagtggtggcctaactacggctacactagaagaacagtatttggtatc tgcgctctgctgaagccagttaccttcggaaaaagagttggtagctcttg atccggcaaacaaaccaccgctggtagcggtggtttttttgtttgcaagc agcagattacgcgcagaaaaaaaggatctcaagaagatcctttgatcttt tctacggggtctgacgctcagtggaacgaaaactcacgttaagggattt ggtcatgagattatcaaaaaggatcttcacctagatccttttaaattaaa aatgaagttttaaatcaatctaaagtatatatgagtaaacttggtctgac agttaccaatgcttaatcagtgaggcacctatctcagcgatctgtctatt |

TABLE 12-continued

AAV6 Mutant Plasmid vector sequences

| SEQ ID NO | Construct | Sequence |
|---|---|---|
| | | tcgttcatccatagttgcctgactcccgtcgtgtagataactacgatac gggagggcttaccatctggccccagtgctgcaatgataccgcgagaccca cgctcaccggctccagatttatcagcaataaaccagccagccggaagggc cgagcgcagaagtggtcctgcaactttatccgcctccatccagtctatta attgttgccgggaagctagagtaagtagttcgccagttaatagtttgcgc aacgttgttgccattgctacaggcatcgtggtgtcacgctcgtcgtttgg tatggcttcattcagctccggttcccaacgatcaaggcgagttacatgat ccccatgttgtgcaaaaaagcggttagctccttcggtcctccgatcgtt gtcagaagtaagttggccgcagtgttatcactcatggttatggcagcact gcataattctcttactgtcatgccatccgtaagatgcttttctgtgactg gtgagtactcaaccaagtcattctgagaatagtgtatgcggcgaccgagt tgctcttgcccggcgtcaatacgggataataccgcgccacatagcagaac tttaaaagtgctcatcattggaaaacgttcttcggggcgaaaactctcaa ggatcttaccgctgttgagatccagttcgatgtaacccactcgtgcaccc aactgatcttcagcatcttttactttcaccagcgtttctgggtgagcaaa aacaggaaggcaaaatgccgcaaaaaagggaataagggcgacacggaaat gttgaatactcatactcttcctttttcaatattattgaagcatttatcag ggttattgtctcatgagcggatacatatttgaatgtatttagaaaaataa acaaataggggttccgcgcacatttccccgaaaagtgccacctaaattgt aagcgttaatattttgttaaaattcgcgttaaattttgttaaatcagct cattttttaaccaataggccgaaatcggcaaaatcccttataaatcaaaa gaatagaccgagatagggttgagtgttgttccagtttggaacaagagtcc actattaaagaacgtggactccaacgtcaaagggcgaaaaaccgtctatc agggcgatggcccactacgtgaaccatcaccctaatcaagttttttgggg tcgaggtgccgtaaagcactaaatcggaaccctaaagggagcccccgatt tagagcttgacggggaaagccggcgaacgtggcgagaaaggaagggaaga aagcgaaaggagcgggcgctagggcgctggcaagtgtagcggtcacgctg cgcgtaaccaccacacccgccgcgcttaatgcgccgctacagggcgcgtc ccattcgccattcaggctgcgcaactgttgggaagggcgatcggtgcggg cctcttcgctattacgccagctggcgaaagggggatgtgctgcaaggcga ttaagttgggtaacgccagggttttcccagtcacgacgttgtaaaacgac ggccagtgagcgcgcgtaatacgactcactatagggcgaattgggtaccg ggccccccctcgatcgaggtcgacggtatcggggggagctcgcagggtctc cattttgaagcgggaggtttgaacgcgcag |
| 210 | 17AALIEC_6_ F129L_H642N_ L584N_pAAV-DJ | ccgccatgccggggttttacgagattgtgattaaggtccccagcgaccctt gacgagcatctgcccggcatttctgacagctttgtgaactgggtggccga gaaggaatgggagttgccgccagattctgcatggatctgaatctgattg agcaggcaccccctgaccgtggccgagaagctgcagcgcgactttctgacg gaatggcgccgtgtgagtaaggcccccggaggccctttctctttgtgcaattt tgagaagggagagagctacttccacatgcacgtgctcgtggaaaccaccg gggtgaaatccatggttttgggacgtttcctgagtcagattcgcgaaaaa ctgattcagagaatttaccgcgggatcgagccgactttgccaaactggttt cgcggtcacaaagaccagaaatggcgccggaggcgggaacaaggtggtgg atgagtgctacatccccaattacttgctccccaaaacccagcctgagctc cagtgggcgtggactaatatggaacagtatttaagcgcctgtttgaatct cacggagcgtaaacggttggtggcgcagcatctgacgcacgtgtcgcaga cgcaggagcagaacaaagagaatcagaatcccaattctgatgcgccggtg atcagatcaaaaacttcagccaggtacatggagctggtcggtggctcgt ggacaaggggattacctcggagaagcagtggatccaggaggaccaggcct catacatctccttcaatgcggcctccaactcgcggtcccaaatcaaggct gccttggacaatgcgggaaagattatgagcctgactaaaaccgccccga ctacctggtgggccagcagcccgtggaggacatttccagcaatcggattt ataaaattttggaactaaacgggtacgatcccaatatgcggcttccgtc tttctgggatgggccacgaaaaagttcggcaagaggaacaccatctggct gtttgggcctgcaactaccgggaagaccaacatcgcggaggccatagccc acactgtgcccttctacgggtgcgtaaactggaccaatgagaactttccc ttcaacgactgtgtcgacaagatggtgatctggtgggaggagggggaagat gaccgccaaggtcgtggagtcggccaaagccattctcggaggaagcaagg tgcgcgtggaccagaaatgcaagtcctcggcccagatagacccgactccc gtgatcgtcacctccaacaccaacatgtgcgccgtgattgacgggaactc aacgaccttcgaacaccagcagccgttgcaagaccggatgttcaaatttg aactcacccgccgtctggatcatgactttgggaaggtcaccaagcaggaa gtcaaagacttttttcggtgggcaaaggatcacgtggttgaggtggagca tgaattctacgtcaaaaagggtggagccaagaaaagacccgcccccagtg acgcagatatataagtgagcccaaacgggtgcgcgagtcagttgcgcagcca tcgacgtcagacgcggaagcttcgatcaactacgcagacaggtaccaaaa caaatgttctcgtcacgtgggcatgaatctgatgctgtttccctgcagac aatgcgagagaatgaatcagaattcaaatatctgcttcactcacgagaca aagactgtttagagtgcttcccgtgtcagaatctcaacccgtttctgt cgtcaaaaaggcgtatcagaaactgtgctacattcatcatatcatgggaa aggtgccagacgcttgcactgcctgcgatctggtcaatgtggatttggat gactgcatctttgaacaataaatgatttaaatcaggtatggctgccgatg gttatcttccagattggctcgaggacaacctctctgagggcattcgcgag |

TABLE 12-continued

AAV6 Mutant Plasmid vector sequences

| SEQ ID NO | Construct | Sequence |
|---|---|---|
| | | tggtgggacttgaaacctggagccccgaaacccaaagccaaccagcaaaa<br>gcaggacgacggccggggtctggtgcttcctggctacaagtacctcggac<br>ccttcaacggactcgacaaggggagcccgtcaacgcggcggatgcagcg<br>gccctcgagcacgacaaggcctacgaccagcagctcaaagcgggtgacaa<br>tccgtacctgcggtataaccacgccgacgccgagtttcaggagcgtctgc<br>aagaagatacgtcttttgggggcaacctcgggcgagcagtcttccaggcc<br>aagaagagggttctcgaaccttttaggtctggttgaggaaggtgctaagac<br>ggctcctggaaagaaacgtccggtagagcagtcgccacaagagccagact<br>cctcctcgggcattggcaagacaggccagcagcccgctaaaaagagactc<br>aattttggtcagactggcgactcagagtcagtcccgacccacaacctct<br>cggagaacctccagcaaccccgctgctgtgggacctactacaatggctt<br>caggcggtggcgcaccaatggcagacaataacgaaggcgccgacggagtg<br>ggtaatgcctcaggaaattggcattgcgattccacatggctgggcgacag<br>agtcatcaccaccagcacccgaacatgggccttgcccacctataacaacc<br>acctctacaagcaaatctccagtgcttcaacggggccagcaacgacaac<br>cactacttcggctacagcacccctgggggtattttgatttcaacagatt<br>ccactgccatttctcaccacgtgactggcagcgactcatcaacaacaatt<br>ggggattccggcccaagagactcaacttcaagctcttcaacatccaagtc<br>aaggaggtcacgacgaatgatggcgtcacgaccatcgctaataaccttac<br>cagcacggttcaagtcttctcggactcggagtaccagttgccgtacgtcc<br>tcggctctgcgcaccagggctgcctccctccgttcccggcggacgtgttc<br>atgattccgcagtacggctacctaacgctcaacaatggcagcaggcagt<br>gggacggtcatccttttactgcctggaatatttcccatcgcagatgctga<br>gaacgggcaataactttaccttcagctacaccttcgaggacgtgccttc<br>cacagcagctacgcgcacagccagagcctggaccggctgatgaatcctct<br>catcgaccagtacctgtattacctgaacagaactcagaatcagtccggaa<br>gtgcccaaaacaaggacttgctgtttagccgggggtctccagctggcatg<br>tctgttcagcccaaaaactggctacctggaccctgttaccggcagcagcg<br>cgtttctaaaacaaaaacagacaacaacaacagcaactttacctggactg<br>gtgcttcaaaatataaccttaatgggcgtgaatctataatcaaccctggc<br>actgctatggcctcacacaaagacgacaaagacaagttctttcccatgag<br>cggtgtcatgatttttggaaaggagagcgccggagcttcaaacactgcat<br>tggacaatgtcatgatcacagacgaagaggaaatcaaagccactaacccc<br>gtggccaccgaaagatttgggactgtggcagtcaataaccagagcagcag<br>cacagaccctgcgaccggagatgtgcatgttatgggagccttacctggaa<br>tggtgtggcaagacagagacgtatacctgcagggtcctattggggccaaa<br>attcctcacacggatggacactttcacccgtctcctctcatgggcggctt<br>tggacttaagaacccgcctcctcagatcctcatcaaaaacacgcctgttc<br>ctgcgaatcctccggcagagttttcggctacaaagtttgcttcattcatc<br>acccagtattccacaggacaagtgagcgtggagattgaatgggagctgca<br>gaaagaaaacagcaaacgctggaatcccgaagtgcagtatacatctaact<br>atgcaaaatctgccaacgttgatttcactgtggacaacaatggactttat<br>actgagcctcgcccattggcacccgttacctcacccgtccctgtaatt<br>gtgtgttaatcaataaccggttgattcgtttcagttgaactttggtctc<br>tgcgaagggcgaattcgtttaaacctgcaggactagaggtcctgtattag<br>aggtcacgtgagtgttttgcgacattttgcgacaccatgtggtcacgctg<br>ggtatttaagcccgagtgagcacgcagggtctccattttgaagcgggagg<br>tttgaacgcgcagccgccaagccgaattctgcagatatccatcacactgg<br>cggccgctcgactagagcggccgccaccgcggtggagctccagcttttgt<br>tccctttagtgagggttaattgcgcgcttggcgtaatcatggtcatagct<br>gtttcctgtgtgaaattgttatccgctcacaattccacacaacatacgag<br>ccggaagcataaagtgtaaagcctggggtgcctaatgagtgagctaactc<br>acattaattgcgttgcgctcactgcccgctttccagtcgggaaacctgtc<br>gtgccagctgcattaatgaatcggccaacgcgcggggagaggcggtttgc<br>gtattgggcgctcttccgcttcctcgctcactgactcgctgcgctcggtc<br>gttcggctgcggcgagcggtatcagctcactcaaaggcggtaatacggtt<br>atccacagaatcaggggataacgcaggaaagaacatgtgagcaaaaggcc<br>agcaaaaggccaggaaccgtaaaaaggccgcgttgctggcgtttttccat<br>aggctccgcccccctgacgagcatcacaaaaatcgacgctcaagtcagag<br>gtggcgaaacccgacaggactataaagataccaggcgtttccccctggaa<br>gctccctcgtgcgctctcctgttccgaccctgccgcttaccggatacctg<br>tccgcctttctcccttcgggaagcgtggcgctttctcatagctcacgctg<br>taggtatctcagttcggtgtaggtcgttcgctccaagctgggctgtgtgc<br>acgaaccccccgttcagcccgaccgctgcgccttatccggtaactatcgt<br>cttgagtccaacccggtaagacacgacttatcgccactggcagcagccac<br>tggtaacaggattagcagagcgaggtatgtaggcggtgctacagagttct<br>tgaagtggtggcctaactacggctacactagaagaacagtatttggtatc<br>tgcgctctgctgaagccagttaccttcggaaaaagagttggtagctcttg<br>atccggcaaacaaaccaccgctggtagcggtggttttttgtttgcaagc<br>agcagattacgcgcagaaaaaaaggatctcaagaagatcctttgatctttt<br>tctacggggtctgacgctcagtggaacgaaaactcacgttaagggatttt<br>ggtcatgagattatcaaaaaggatcttcacctagatccttttaaattaaa<br>aatgaagttttaaatcaatctaaagtatatatgagtaaacttggtctgac<br>agttaccaatgcttaatcagtgaggcacctatctcagcgatctgtctatt |

TABLE 12-continued

AAV6 Mutant Plasmid vector sequences

| SEQ ID NO | Construct | Sequence |
|---|---|---|
| | | tcgttcatccatagttgcctgactcccgtcgtgtagataactacgatac<br>gggagggcttaccatctggccccagtgctgcaatgataccgcgagaccca<br>cgctcaccggctccagatttatcagcaataaaccagccagccggaagggc<br>cgagcgcagaagtggtcctgcaactttatccgcctccatccagtctatta<br>attgttgccgggaagctagagtaagtagttcgccagttaatagtttgcgc<br>aacgttgttgccattgctacaggcatcgtggtgtcacgctcgtcgtttgg<br>tatggcttcattcagctccggttcccaacgatcaaggcgagttacatgat<br>cccccatgttgtgcaaaaaagcggttagctccttcggtcctccgatcgtt<br>gtcagaagtaagttggccgcagtgttatcactcatggttatggcagcact<br>gcataattctcttactgtcatgccatccgtaagatgcttttctgtgactg<br>gtgagtactcaaccaagtcattctgagaatagtgtatgcggcgaccgagt<br>tgctcttgcccggcgtcaatacgggataataccgcgccacatagcagaac<br>tttaaaagtgctcatcattggaaaacgttcttcggggcgaaaactctcaa<br>ggatcttaccgctgttgagatccagttcgatgtaacccactcgtgcaccc<br>aactgatcttcagcatcttttactttcaccagcgtttctgggtgagcaaa<br>aacaggaaggcaaaatgccgcaaaaaagggaataagggcgacacggaaat<br>gttgaatactcatactcttccttttcaatattattgaagcatttatcag<br>ggttattgtctcatgagcggatacatatttgaatgtatttagaaaaataa<br>acaaataggggttccgcgcacatttccccgaaaagtgccacctaaattgt<br>aagcgttaatattttgttaaaattcgcgttaaattttgttaaatcagct<br>catttttaaccaataggccgaaatcggcaaaatcccttataaatcaaaa<br>gaatagaccgagatagggttgagtgttgttccagtttggaacaagagtcc<br>actattaaagaacgtggactccaacgtcaaagggcgaaaaaccgtctatc<br>agggcgatggcccactacgtgaaccatcaccctaatcaagttttttgggg<br>tcgaggtgccgtaaagcactaaatcggaaccctaaagggagcccccgatt<br>tagagcttgacggggaaagccggcgaacgtggcgagaaaggaagggaaga<br>aagcgaaaggagcgggcgctagggcgctggcaagtgtagcggtcacgctg<br>cgcgtaaccaccacacccgccgcgcttaatgcgccgctacagggcgcgtc<br>ccattcgccattcaggctgcgcaactgttgggaagggcgatcggtgcggg<br>cctcttcgctattacgccagctggcgaaagggggatgtgctgcaaggcga<br>ttaagttgggtaacgccagggttttcccagtcacgacgttgtaaaacgac<br>ggccagtgagcgcgcgtaatacgactcactatagggcgaattgggtaccg<br>ggccccccctcgatcgaggtcgacggtatcggggggagctcgcagggtctc<br>cattttgaagcgggaggtttgaacgcgcag |
| 211 | 17AALIFC_6_<br>F129L_H642N_<br>L584H_pAAV-<br>DJ | ccgccatgccggggttttacgagattgtgattaaggtccccagcgaccctt<br>gacgagcatctgcccggcatttctgacagctttgtgaactgggtggccga<br>gaaggaatgggagttgccgccagattctgcatggatctgaatctgattg<br>agcaggcaccccctgaccgtggccgagaagctgcagcgcgactttctgacg<br>gaatggcgccgtgtgagtaaggcccccggaggccctttttctttgtgcaatt<br>tgagaagggagagagctacttccacatgcacgtgctcgtggaaaccaccg<br>gggtgaaatccatggttttgggacgtttcctgagtcagattcgcgaaaaa<br>ctgattcagagaatttaccgcgggatcgagccgactttgccaaactggtt<br>cgcggtcacaaagaccagaaatggcgccggaggcgggaacaaggtggtgg<br>atgagtgctacatccccaattacttgctccccaaaacccagcctgagctc<br>cagtgggcgtggactaatatggaacagtatttaagcgcctgtttgaatct<br>cacggagcgtaaacggttggtggcgcagcatctgacgcacgtgtcgcaga<br>cgcaggagcagaacaaagagaatcagaatcccaattctgatgcgccggtg<br>atcagatcaaaaacttcagccaggtacatggagctggtcggggtggctcgt<br>ggacaaggggattacctcggagaagcagtggatccaggaggaccaggcct<br>catacatctccttcaatgcggcctccaactcgcggtcccaaatcaaggct<br>gccttggacaatgcgggaaagattatgagcctgactaaaaccgcccccga<br>ctacctggtgggccagcagcccgtggaggacatttccagcaatcggattt<br>ataaaattttggaactaaacgggtacgatcccaatatgcggcttccgtc<br>tttctgggatgggccacgaaaaagttcggcaagaggaacaccatctggct<br>gtttgggcctgcaactaccgggaagaccaacatcgcggaggccatagccc<br>acactgtgcccttctacgggtgcgtaaactggaccaatgagaactttccc<br>ttcaacgactgtgtcgacaagatggtgatctggtgggaggaggggaagat<br>gaccgccaaggtcgtggagtcggccaaagccattctcggaggaagcaagg<br>tgcgcgtggaccagaaatgcaagtcctcggcccagatagacccgactccc<br>gtgatcgtcacctccaacaccaacatgtgcgccgtgattgacgggaactc<br>aacgaccttcgaacaccagcagccgttgcaagaccggatgttcaaatttg<br>aactcacccgccgtctggatcatgactttgggaaggtcaccaagcaggaa<br>gtcaaagacttttttccggtgggcaaaggatcacgtggttgaggtggagca<br>tgaattctacgtcaaaaagggtggagccaagaaaaagaccccgcccccagtg<br>acgcagatataagtgagcccaaacgggtgcgcgagtcagttgcgcagcca<br>tcgacgtcagacgcggaagcttcgatcaactacgcagacaggtaccaaaa<br>caaatgttctcgtcacgtgggcatgaatctgatgctgtttccctgcagac<br>aatgcgagagaatgaatcagaattcaaatatctgcttcactcacggacag<br>aaagactgtttagagtgcttcccgtgtcagaatctcaacccgtttctgt<br>cgtcaaaaaggcgtatcagaaactgtgctacattcatcatatcatgggaa<br>aggtgccagacgcttgcactgcctgcgatctggtcaatgtggatttggat<br>gactgcatctttgaacaataaaatgatttaaatcaggtatggctgccgatg<br>gttatcttccagattggctcgaggacaacctctctgagggcattcgcgag |

TABLE 12-continued

AAV6 Mutant Plasmid vector sequences

| SEQ ID NO | Construct | Sequence |
|---|---|---|
| | | tggtgggacttgaaacctggagccccgaaacccaaagccaaccagcaaaa
gcaggacgacggccggggtctggtgcttcctggctacaagtacctcggac
ccttcaacggactcgacaaggggagcccgtcaacgcggcggatgcagcg
gccctcgagcacgacaaggcctacgaccagcagctcaaagcgggtgacaa
tccgtacctgcggtataaccacgccgacgccgagtttcaggagcgtctgc
aagaagatacgtcttttgggggcaacctcgggcgagcagtcttccaggcc
aagaagagggttctcgaacctttaggtctggttgaggaaggtgctaagac
ggctcctggaaagaaacgtccggtagagcagtcgccacaagagccagact
cctcctcgggcattggcaagacaggccagcagcccgctaaaaagagactc
aattttggtcagactggcgactcagagtcagtccccgacccacaacctct
cggagaacctccagcaaccccgctgctgtgggacctactacaatggctt
caggcggtggcgcaccaatggcagacaataacgaaggcgccgacggagtg
ggtaatgcctcaggaaattggcattgcgattccacatggctgggcgacag
agtcatcaccaccagcacccgaacatgggccttgcccacctataacaacc
acctctacaagcaaatctccagtgcttcaacggggccagcaacgacaac
cactacttcggctacagcaccccctgggggtattttgatttcaacagatt
ccactgccatttctcaccacgtgactggcagcgactcatcaacaacaatt
ggggattccggcccaagagactcaacttcaagctcttcaacatccaagtc
aaggaggtcacgacgaatgatggcgtcacgaccatcgctaataaccttac
cagcacggttcaagtcttctcggactcggagtaccagttgccgtacgtcc
tcggctctgcgcaccagggctgcctccctccgttcccggcggacgtgttc
atgattccgcagtacggctacctaacgctcaacaatggcagccaggcagt
gggacggtcatccttttactgcctggaatatttcccatcgcagatgctga
gaacgggcaataactttaccttcagctacaccttcgaggacgtgcctttc
cacagcagctacgcgcacagccagagcctggaccggctgatgaatcctct
catcgaccagtacctgtattacctgaacagaactcagaatcagtccggaa
gtgcccaaaacaaggacttgctgtttagccggggtctccagctggcatg
tctgttcagcccaaaaactggctacctggaccctgttaccggcagcagcg
cgtttctaaaacaaaaacagacaacaacaacagcaactttacctggactg
gtgcttcaaaatataaccttaatgggcgtgaatctataatcaaccctggc
actgctatggcctcacacaaagacgacaaagacaagttctttcccatgag
cggtgtcatgatttttggaaaggagagcgccggagcttcaaacactgcat
tggacaatgtcatgatcacagacgaagaggaaatcaaagccactaacccc
gtggccaccgaaagatttgggactgtggcagtcaatcaccagagcagcag
cacagaccctgcgaccggagatgtgcatgttatgggagccttacctggaa
tggtgtggcaagacagagacgtatacctgcagggtcctattgggccaaa
attcctcacacggatggacactttcacccgtctcctctcatgggcggctt
tggacttaagaacccgcctcctcagatcctcatcaaaaacacgcctgttc
ctgcgaatcctccggcagagttttcggctacaaagtttgcttcattcatc
acccagtattccacaggacaagtgagcgtggagattgaatgggagctgca
gaaagaaaacagcaaacgctggaatcccgaagtgcagtatacatctaact
atgcaaaatctgccaacgttgatttcactgtggacaacaatggactttat
actgagcctcgccccattggcacccgttacctcacccgtcccctgtaatt
gtgtgttaatcaataaaccggttgattcgtttcagttgaactttggtctc
tgcgaagggcgaattcgtttaaacctgcaggactagaggtcctgtattag
aggtcacgtgagtgttttgcgacatttgcgacaccatgtggtcacgctg
ggtatttaagcccgagtgagcacgcagggtctccattttgaagcgggagg
tttgaacgcgcagccgccaagccgaattctgcagatatccatcacactgg
cggccgctcgactagagcggccgccaccgcggtggagctccagcttttgt
tccctttagtgagggttaattgcgcgcttggcgtaatcatggtcatagct
gtttcctgtgtgaaattgttatccgctcacaattccacacaacatacgag
ccggaagcataaagtgtaaagcctggggtgcctaatgagtgagctaactc
acattaattgcgttgcgctcactgcccgctttccagtcgggaaacctgtc
gtgccagctgcattaatgaatcggccaacgcgcggggagaggcggtttgc
gtattgggcgctcttccgcttcctcgctcactgactcgctgcgctcggtc
gttcggctgcggcgagcggtatcagctcactcaaaggcggtaatacggtt
atccacagaatcaggggataacgcaggaaagaacatgtgagcaaaaggcc
agcaaaaggccaggaaccgtaaaaaggccgcgttgctggcgtttttccat
aggctccgcccccctgacgagcatcacaaaaatcgacgctcaagtcagag
gtggcgaaacccgacaggactataaagataccaggcgtttccccctggaa
gctccctcgtgcgctctcctgttccgaccctgccgcttaccggatacctg
tccgcctttctcccttcgggaagcgtggcgctttctcatagctcacgctg
taggtatctcagttcggtgtaggtcgttcgctccaagctgggctgtgtgc
acgaaccccccgttcagcccgaccgctgcgccttatccggtaactatcgt
cttgagtccaacccggtaagacacgacttatcgccactggcagcagccac
tggtaacaggattagcagagcgaggtatgtaggcggtgctacagagttct
tgaagtggtggcctaactacggctacactagaagaacagtatttggtatc
tgcgctctgctgaagccagttaccttcggaaaaagagttggtagctcttg
atccggcaaacaaaccaccgctggtagcggtggtttttttgtttgcaagc
agcagattacgcgcagaaaaaaaggatctcaagaagatcctttgatcttt
tctacggggtctgacgctcagtggaacgaaaactcacgttaagggattt
ggtcatgagattatcaaaaaggatcttcacctagatccttttaaattaaa
aatgaagttttaaatcaatctaaagtatatatgagtaaacttggtctgac
agttaccaatgcttaatcagtgaggcacctatctcagcgatctgtctatt |

TABLE 12-continued

AAV6 Mutant Plasmid vector sequences

| SEQ ID NO | Construct | Sequence |
|---|---|---|
| | | tcgttcatccatagttgcctgactcccgtcgtgtagataactacgatac<br>gggagggcttaccatctggccccagtgctgcaatgataccgcgagaccca<br>cgctcaccggctccagatttatcagcaataaaccagccagccggaagggc<br>cgagcgcagaagtggtcctgcaactttatccgcctccatccagtctatta<br>attgttgccgggaagctagagtaagtagttcgccagttaatagtttgcgc<br>aacgttgttgccattgctacaggcatcgtggtgtcacgctcgtcgtttgg<br>tatggcttcattcagctccggttcccaacgatcaaggcgagttacatgat<br>cccccatgttgtgcaaaaaagcggttagctccttcggtcctccgatcgtt<br>gtcagaagtaagttggccgcagtgttatcactcatggttatggcagcact<br>gcataattctcttactgtcatgccatccgtaagatgcttttctgtgactg<br>gtgagtactcaaccaagtcattctgagaatagtgtatgcggcgaccgagt<br>tgctcttgcccggcgtcaatacgggataataccgcgccacatagcagaac<br>tttaaaagtgctcatcattggaaaacgttcttcggggcgaaaactctcaa<br>ggatcttaccgctgttgagatccagttcgatgtaacccactcgtgcaccc<br>aactgatcttcagcatcttttactttcaccagcgtttctgggtgagcaaa<br>aacaggaaggcaaaatgccgcaaaaaagggaataagggcgacacggaaat<br>gttgaatactcatactcttcctttttcaatattattgaagcatttatcag<br>ggttattgtctcatgagcggatacatatttgaatgtatttagaaaaataa<br>acaaataggggttccgcgcacatttccccgaaaagtgccacctaaattgt<br>aagcgttaatattttgttaaaattcgcgttaaattttttgttaaatcagct<br>cattttttaaccaataggccgaaatcggcaaaatcccttataaatcaaaa<br>gaatagaccgagatagggttgagtgttgttccagtttggaacaagagtcc<br>actattaaagaacgtggactccaacgtcaaagggcgaaaaaccgtctatc<br>agggcgatggcccactacgtgaaccatcaccctaatcaagttttttgggg<br>tcgaggtgccgtaaagcactaaatcggaaccctaaagggagcccccgatt<br>tagagcttgacggggaaagccggcgaacgtggcgagaaaggaagggaaga<br>aagcgaaggagcgggcgctagggcgctggcaagtgtagcggtcacgctg<br>cgcgtaaccaccacacccgccgcgcttaatgcgccgctacagggcgcgtc<br>ccattcgccattcaggctgcgcaactgttgggaagggcgatcggtgcggg<br>cctcttcgctattacgccagctggcgaaaggggatgtgctgcaaggcga<br>ttaagttgggtaacgccagggttttcccagtcacgacgttgtaaaacgac<br>ggccagtgagcgcgcgtaatacgactcactatagggcgaattgggtaccg<br>ggccccccctcgatcgaggtcgacggtatcgggggagctcgcagggtctc<br>catttgaagcgggaggtttgaacgcgcag |
| 212 | 17AALIGC_6_F129L_H642N_V598L_pAAV-DJ | ccgccatgccggggttttacgagattgtgattaaggtccccagcgaccgtt<br>gacgagcatctgcccggcatttctgacagctttgtgaactgggtggccga<br>gaaggaatgggagttgccgccagattctgcatggatctgaatctgattg<br>agcaggcaccccctgaccgtggccgagaagctgcagcgcgactttctgacg<br>gaatggcgccgtgtgagtaaggcccccggaggccctttcttttgtgcaatt<br>tgagaagggagagagctacttccacatgcacgtgctcgtggaaaccaccg<br>gggtgaaatccatggttttgggacgtttcctgagtcagattcgcgaaaaa<br>ctgattcagagaatttaccgcgggatcgagccgactttgccaaactggtt<br>cgcggtcacaaagaccagaaatggcgccggaggcgggaacaaggtggtgg<br>atgagtgctacatccccaattacttgctccccaaaacccagcctgagctc<br>cagtgggcgtggactaatatggaacagtatttaagcgcctgtttgaatct<br>cacggagcgtaaacggttggtggcgcagcatctgacgcacgtgtcgcaga<br>cgcaggagcagaacaaagagaatcagaatcccaattctgatgcgccggtg<br>atcagatcaaaaacttcagccaggtacatggagctggtcgggtggctcgt<br>ggacaaggggattacctcggagaagcagtggatccaggaggaccaggcct<br>catacatctccttcaatgcggcctccaactcgcggtcccaaatcaaggct<br>gccttggacaatgcgggaaagattatgagcctgactaaaaccgcccccga<br>ctacctggtgggccagcagcccgtggaggacatttccagcaatcggattt<br>ataaaattttggaactaaacgggtacgatcccaatatgcggcttccgtc<br>tttctgggatgggccacgaaaaagttcggcaagaggaacaccatctggct<br>gtttgggcctgcaactaccgggaagaccaacatcgcggaggccatagccc<br>acactgtgccttctacgggtgcgtaaactggaccaatgagaactttccc<br>ttcaacgactgtgtcgacaagatggtgatctggtgggaggaggggaagat<br>gaccgccaaggtcgtggagtcggccaaagccattctcggaggaagcaagg<br>tgcgcgtggaccagaaatgcaagtcctcggcccagatagacccgactccc<br>gtgatcgtcacctccaacaccaacatgtgcgccgtgattgacgggaactc<br>aacgaccttcgaacaccagcagccgttgcaagaccggatgttcaaatttg<br>aactcacccgccgtctggatcatgactttgggaaggtcaccaagcaggaa<br>gtcaaagacttttttccggtgggcaaaggatcacgtggttgaggtggagca<br>tgaattctacgtcaaaaagggtggagccaagaaaagacccgcccccagtg<br>acgcagatataagtgagcccaaacgggtgcgcgagtcagttgcgcagcca<br>tcgacgtcagacgcggaagcttcgatcaactacgcagacaggtaccaaaa<br>caaatgttctcgtcacgtgggcatgaatctgatgctgtttccctgcagac<br>aatgcgagagaatgaatcagaattcaaatatctgcttcactcacggacag<br>aaagactgtttagagtgcttttcccgtgtcagaatctcaacccgtttctgt<br>cgtcaaaaagcgtatcagaaactgtgctacattcatcatatcatgggaa<br>aggtgccagacgcttgcactgcctgcgatctggtcaatgtggatttggat<br>gactgcatctttgaacaataaatgatttaaatcaggtatggctgccgatg<br>gttatcttccagattggctcgaggacaacctctctgagggcattcgcgag |

TABLE 12-continued

AAV6 Mutant Plasmid vector sequences

| SEQ ID NO | Construct | Sequence |
|---|---|---|
| | | tggtgggacttgaaacctggagccccgaaacccaaagccaaccagcaaaa
gcaggacgacggccggggtctggtgcttcctggctacaagtacctcggac
ccttcaacggactcgacaaggggagcccgtcaacgcggcggatgcagcg
gccctcgagcacgacaaggcctacgaccagcagctcaaagcgggtgacaa
tccgtacctgcggtataaccacgccgacgccgagtttcaggagcgtctgc
aagaagatacgtcttttgggggcaacctcgggcgagcagtcttccaggcc
aagaagagggttctcgaaccttttaggtctggttgaggaaggtgctaagac
ggctcctggaaagaaacgtccggtagagcagtcgccacaagagccagact
cctcctcgggcattggcaagacaggccagcagcccgctaaaaagagactc
aattttggtcagactggcgactcagagtcagtccccgacccacaacctct
cggagaacctccagcaaccccccgctgctgtgggacctactacaatggctt
caggcggtggcgcaccaatggcagacaataacgaaggcgccgacggagtg
ggtaatgcctcaggaaattggcattgcgattccacatggctgggcgacag
agtcatcaccaccagcacccgaacatgggccttgcccacctataacaacc
acctctacaagcaaatctccagtgcttcaacggggggccagcaacgacaac
cactacttcggctacagcaccccctgggggtattttgatttcaacagatt
ccactgccatttctcaccacgtgactggcagcgactcatcaacaacaatt
ggggattccggcccaagagactcaacttcaagctcttcaacatccaagtc
aaggaggtcacgacgaatgatggcgtcacgaccatcgctaataaccttac
cagcacggttcaagtcttctcggactcggagtaccagttgccgtacgtcc
tcggctctgcgcaccagggctgcctccctccgttcccggcggacgtgttc
atgattccgcagtacggctacctaacgctcaacaatggcagccaggcagt
gggacggtcatccttttactgcctggaatatttcccatcgcagatgctga
gaacgggcaataactttaccttcagctacaccttcgaggacgtgccttc
cacagcagctacgcgcacagccagagcctggaccggctgatgaatcctct
catcgaccagtacctgtattacctgaacagaactcagaatcagtccggaa
gtgcccaaaacaaggacttgctgtttagccgggggtctccagctggcatg
tctgttcagcccaaaaactggctacctggaccctgttaccggcagcagcg
cgtttctaaaacaaaaacagacaacaacaacagcaactttacctggactg
gtgcttcaaaatataaccttaatgggcgtgaatctataatcaaccctggc
actgctatggcctcacacaaagacgacaaagacaagttctttcccatgag
cggtgtcatgattttttggaaaggagagcgccggagcttcaaacactgcat
tggacaatgtcatgatcacagacgaagaggaaatcaaagccactaaccc
gtggccaccgaaagatttgggactgtggcagtcaatctccagagcagcag
cacagaccctgcgaccggagatgtgcatcttatgggagccttacctggaa
tggtgtggcaagacagagacgtatacctgcagggtcctatttgggccaaa
attcctcacacgatggacactttcacccgtctcctctcatgggcggctt
tggacttaagaacccgcctcctcagatcctcatcaaaaacacgcctgttc
ctgcgaatcctccggcagagttttcggctacaaagtttgcttcattcatc
acccagtattccacaggacaagtgagcgtggagattgaatgggagctgca
gaaagaaaacagcaaacgctggaatcccgaagtgcagtatacatctaact
atgcaaaatctgccaacgttgatttcactgtggacaacaatggactttat
actgagcctcgcccattggcacccgttacctcacccgtccctgtaatt
gtgtgttaatcaataaccggttgattcgtttcagttgaactttggtctc
tgcgaagggcgaattcgtttaaacctgcaggactagaggtcctgtattag
aggtcacgtgagtgttttgcgacattttgcgacaccatgtggtcacgctg
ggtatttaagcccgagtgagcacgcagggtctccatttgaagcgggagg
tttgaacgcgcagccgccaagccgaattctgcagatatccatcacactgg
cggccgctcgactagagcggccgccaccgcggtggagctccagcttttgt
tccctttagtgagggttaattgcgcgcttggcgtaatcatggtcatagct
gtttcctgtgtgaaattgttatccgctcacaattccacacaacatacgag
ccgaagcataaagtgtaaagcctggggtgcctaatgagtgagctaactc
acattaattgcgttgcgctcactgcccgctttccagtcgggaaacctgtc
gtgccagctgcattaatgaatcggccaacgcgcggggagaggcggtttgc
gtattgggcgctcttccgcttcctcgctcactgactcgctgcgctcggtc
gttcggctgcggcgagcggtatcagctcactcaaaggcggtaatacggtt
atccacagaatcaggggataacgcaggaaagaacatgtgagcaaaaggcc
agcaaaaggccaggaaccgtaaaaaggccgcgttgctggcgtttttccat
aggctccgcccccctgacgagcatcacaaaaatcgacgctcaagtcagag
gtggcgaaacccgacaggactataaagataccaggcgtttccccctggaa
gctccctcgtgcgctctcctgttccgaccctgccgcttaccggatacctg
tccgcctttctcccttcgggaagcgtggcgctttctcatagctcacgctg
taggtatctcagttcggtgtaggtcgttcgctccaagctgggctgtgtgc
acgaaccccccgttcagcccgaccgctgcgccttatccggtaactatcgt
cttgagtccaacccggtaagacacgacttatcgccactggcagcagccac
tggtaacaggattagcagagcgaggtatgtaggcggtgctacagagttct
tgaagtggtggcctaactacggctacactagaagaacagtatttggtatc
tgcgctctgctgaagccagttaccttcggaaaaagagttggtagctcttg
atccggcaaacaaaccaccgctggtagcggtggtttttttgttgcaagc
agcagattacgcgcagaaaaaaaggatctcaagaagatcctttgatcttt
tctacggggtctgacgctcagtggaacgaaaactcacgttaagggattttt
ggtcatgagattatcaaaaaggatcttcacctagatccttttaaattaaa
aatgaagttttaaatcaatctaaagtatatatgagtaaacttggtctgac
agttaccaatgcttaatcagtgaggcacctatctcagcgatctgtctatt |

TABLE 12-continued

AAV6 Mutant Plasmid vector sequences

| SEQ ID NO | Construct | Sequence |
|---|---|---|
|  |  | tcgttcatccatagttgcctgactcccgtcgtgtagataactacgatac<br>gggagggcttaccatctggccccagtgctgcaatgataccgcgagaccca<br>cgctcaccggctccagatttatcagcaataaaccagccagccggaagggc<br>cgagcgcagaagtggtcctgcaactttatccgcctccatccagtctatta<br>attgttgccgggaagctagagtaagtagttcgccagttaatagtttgcgc<br>aacgttgttgccattgctacaggcatcgtggtgtcacgctcgtcgtttgg<br>tatggcttcattcagctccggttcccaacgatcaaggcgagttacatgat<br>cccccatgttgtgcaaaaaagcggttagctccttcggtcctccgatcgtt<br>gtcagaagtaagttggccgcagtgttatcactcatggttatggcagcact<br>gcataattctcttactgtcatgccatccgtaagatgcttttctgtgactg<br>gtgagtactcaaccaagtcattctgagaatagtgtatgcggcgaccgagt<br>tgctcttgcccggcgtcaatacgggataataccgcgccacatagcagaac<br>tttaaaagtgctcatcattggaaaacgttcttcggggcgaaaactctcaa<br>ggatcttaccgctgttgagatccagttcgatgtaacccactcgtgcaccc<br>aactgatcttcagcatcttttactttcaccagcgtttctgggtgagcaaa<br>aacaggaaggcaaaatgccgcaaaaaagggaataagggcgacacggaaat<br>gttgaatactcatactcttcctttttcaatattattgaagcatttatcag<br>ggttattgtctcatgagcggatacatatttgaatgtatttagaaaaataa<br>acaaataggggttccgcgcacatttccccgaaaagtgccacctaaattgt<br>aagcgttaatattttgttaaaattcgcgttaaattttgttaaatcagct<br>catttttaaccaataggccgaaatcggcaaaatcccttataaatcaaaa<br>gaatagaccgagatagggttgagtgttgttccagtttggaacaagagtcc<br>actattaaagaacgtggactccaacgtcaaagggcgaaaaaccgtctatc<br>agggcgatggcccactacgtgaaccatcaccctaatcaagttttttgggg<br>tcgaggtgccgtaaagcactaaatcggaaccctaaagggagcccccgatt<br>tagagcttgacggggaaagccggcgaacgtggcgagaaaggaagggaaga<br>aagcgaaaggagcgggcgctagggcgctggcaagtgtagcggtcacgctg<br>cgcgtaaccaccacaccccgccgcgcttaatgcgccgctacagggcgcgtc<br>ccattcgccattcaggctgcgcaactgttgggaagggcgatcggtgcggg<br>cctcttcgctattacgccagctggcgaaagggggatgtgctgcaaggcga<br>ttaagttgggtaacgccagggttttcccagtcacgacgttgtaaaacgac<br>ggccagtgagcgcgcgtaatacgactcactatagggcgaattgggtaccg<br>ggccccccctcgatcgaggtcgacggtatcggggggagctcgcagggtctc<br>catttttgaagcgggaggtttgaacgcgcag |
| 213 | 17AALIHC_6_<br>F129L_H642N_<br>V598I_pAAV-<br>DJ | ccgccatgccggggttttacgagattgtgattaaggtccccagcgacctt<br>gacgagcatctgcccggcatttctgacagctttgtgaactgggtggccga<br>gaaggaatgggagttgccgccagattctgcatggatctgaatctgattg<br>agcaggcaccccctgaccgtggccgagaagctgcagcgcgactttctgacg<br>gaatggcgccgtgtgagtaaggccccggaggccctttttctttgtgcaatt<br>tgagaagggagagagctacttccacatgcacgtgctcgtggaaaccaccg<br>gggtgaaatccatggttttgggacgtttcctgagtcagattcgcgaaaaa<br>ctgattcagagaatttaccgcgggatcgagccgactttgccaaactggtt<br>cgcggtcacaaagaccagaaatggcgccggaggcgggaacaaggtggtgg<br>atgagtgctacatccccaattacttgctccccaaaacccagcctgagctc<br>cagtgggcgtggactaatatggaacagtatttaagcgcctgtttgaatct<br>cacggagcgtaaacggttggtggcgcagcatctgacgcacgtgtcgcaga<br>cgcaggagcagaacaaagagaatcagaatcccaattctgatgcgccggtg<br>atcagatcaaaaacttcagccaggtacatggagctggtcgggtggctcgt<br>ggacaaggggattacctcggagaagcagtggatccaggaggaccaggcct<br>catacatctccttcaatgcggcctccaactcgcggtcccaaatcaaggct<br>gccttggacaatgcgggaaagattatgagcctgactaaaaccgcccccga<br>ctacctggtgggccagcagcccgtggaggacatttccagcaatcggattt<br>ataaaattttggaactaaacgggtacgatccccaatatgcggcttccgtc<br>tttctgggatgggccacgaaaaagttcggcaagaggaacaccatctggct<br>gtttgggcctgcaactaccgggaagaccaacatcgcggaggccatagccc<br>acactgtgcccttctacgggtgcgtaaactggaccaatgagaactttccc<br>ttcaacgactgtgtcgacaagatggtgatctggtgggaggagggggaagat<br>gaccgccaaggtcgtggagtcggccaaagccattctcggaggaagcaagg<br>tgcgcgtggaccagaaatgcaagtcctcggcccagatagacccgactccc<br>gtgatcgtcacctccaacaccaacatgtgcgccgtgattgacgggaactc<br>aacgaccttcgaacaccagcagccgttgcaagaccggatgttcaaatttg<br>aactcacccgccgtctggatcatgactttgggaaggtcaccaagcaggaa<br>gtcaaagacttttttccggtgggcaaaggatcacgtggttgaggtggagca<br>tgaattctacgtcaaaaagggtggagccaagaaaagacccgcccccagtg<br>acgcagatataagtgagcccaaacgggtgcgcgagtcagttgcgcagcca<br>tcgacgtcagacgcggaagcttcgatcaactacgcagacaggtaccaaaa<br>caaatgttctcgtcacgtgggcatgaatctgatgctgtttccctgcagac<br>aatgcgagagaatgaatcagaattcaaatatctgcttcactcacggacga<br>aaagactgtttagagtgcttttcccgtgtcagaatctcaacccgtttctgt<br>cgtcaaaaaggcgtatcagaaactgtgctacattcatcatatcatgggaa<br>aggtgccagacgcttgcactgcctgcgatctggtcaatgtggatttggat<br>gactgcatctttgaacaataaaatgatttaaatcaggtatggctgccgatg<br>gttatcttccagattggctcgaggacaacctctctgagggcattcgcgag |

TABLE 12-continued

AAV6 Mutant Plasmid vector sequences

| SEQ ID NO | Construct | Sequence |
|---|---|---|
| | | tggtgggacttgaaacctggagccccgaaacccaaagccaaccagcaaaa gcaggacgacggccggggtctggtgcttcctggctacaagtacctcggac ccttcaacggactcgacaagggggagcccgtcaacgcggcggatgcagcg gccctcgagcacgacaaggcctacgaccagcagctcaaagcgggtgacaa tccgtacctgcggtataaccacgccgacgccgagtttcaggagcgtctgc aagaagatacgtcttttgggggcaacctcgggcgagcagtcttccaggcc aagaagagggttctcgaaccttttaggtctggttgaggaaggtgctaagac ggctcctggaaagaaacgtccggtagagcagtcgccacaagagccagact cctcctcgggcattggcaagacaggccagcagcccgctaaaaagagactc aattttggtcagactggcgactcagagtcagtccccgacccacaacctct cggagaacctccagcaaccccccgctgctgtgggacctactacaatggctt caggcggtggcgcaccaatggcagacaataacgaaggcgccgacggagtg ggtaatgcctcaggaaattggcattgcgattccacatggctgggcgacag agtcatcaccaccagcacccgaacatgggccttgcccacctataacaacc acctctacaagcaaatctccagtgcttcaacggggccagcaacgacaac cactacttcggctacagcacccctgggggtattttgatttcaacagatt ccactgccatttctcaccacgtgactggcagcgactcatcaacaacaatt ggggattccggcccaagagactcaacttcaagctcttcaacatccaagtc aaggaggtcacgacgaatgatggcgtcacgaccatcgctaataaccttac cagcacggttcaagtcttctcggactcggagtaccagttgccgtacgtcc tcggctctgcgcaccagggctgcctccctccgttcccggcggacgtgttc atgattccgcagtacggctacctaacgctcaacaatggcagccaggcagt gggacggtcatccttttactgcctggaatatttcccatcgcagatgctga gaacgggcaataactttaccttcagctacaccttcgaggacgtgccttc cacagcagctacgcgcacagccagagcctggaccggctgatgaatcctct catcgaccagtacctgtattacctgaacagaactcagaatcagtccggaa gtgcccaaaacaaggacttgctgtttagccgggggtctccagctggcatg tctgttcagcccaaaaactggctacctggaccctgttaccggcagcagcg cgtttctaaaacaaaaacagacaacaacaacagcaactttacctggactg gtgcttcaaaatataaccttaatgggcgtgaatctataatcaaccctggc actgctatggcctcacacaaagacgacaaagacaagttctttcccatgag cggtgtcatgatttttggaaaggagagcgccggagcttcaaacactgcat tggacaatgtcatgatcacagacgaagaggaaatcaaagccactaacccc gtggccaccgaaagatttgggactgtggcagtcaatctccagagcagcag cacagaccctgcgaccggagatgtgcatattatgggagccttacctggaa tggtgtggcaagacagagacgtatacctgcagggtcctattgggccaaa attcctcacacggatggacactttcacccgtctcctctcatgggcggctt tggacttaagaacccgcctcctcagatcctcatcaaaaacacgcctgttc ctgcgaatcctccggcagagttttcggctacaaagtttgcttcattcatc acccagtattccacaggacaagtgagcgtggagattgaatgggagctgca gaaagaaaacagcaaacgctggaatcccgaagtgcagtatacatctaact atgcaaaatctgccaacgttgatttcactgtggacaacaatggactttat actgagcctcgccccattggcacccgttacctcacccgtcccctgtaatt gtgtgttaatcaataaaccggttgattcgtttcagttgaactttggtctc tgcgaagggcgaattcgtttaaacctgcaggactagaggtcctgtattag aggtcacgtgagtgttttgcgacattttgcgacaccatgtggtcacgctg ggtatttaagcccgagtgagcacgcagggtctccattttgaagcgggagg tttgaacgcgcagccgccaagccgaattctgcagatatccatcacactgg cggccgctcgactagagcggccgccaccgcggtggagctccagcttttgt tccctttagtgagggttaattgcgcgcttggcgtaatcatggtcatagct gtttcctgtgtgaaattgttatccgctcacaattccacacaacatacgag ccggaagcataaagtgtaaagcctggggtgcctaatgagtgagctaactc acattaattgcgttgcgctcactgcccgctttccagtcgggaaacctgtc gtgccagctgcattaatgaatcggccaacgcgcggggagaggcggtttgc gtattgggcgctcttccgcttcctcgctcactgactcgctgcgctcggtc gttcggctgcggcgagcggtatcagctcactcaaaggcggtaatacggtt atccacagaatcaggggataacgcaggaaagaacatgtgagcaaaaggcc agcaaaaggccaggaaccgtaaaaaggccgcgttgctggcgtttttccat aggctccgcccccctgacgagcatcacaaaaatcgacgctcaagtcagag gtggcgaaacccgacaggactataaagataccaggcgtttccccctggaa gctccctcgtgcgctctcctgttccgaccctgccgcttaccggatacctg tccgcctttctcccttcgggaagcgtggcgctttctcatagctcacgctg taggtatctcagttcggtgtaggtcgttcgctccaagctgggctgtgtgc acgaaccccccgttcagcccgaccgctgcgccttatccggtaactatcgt cttgagtccaacccggtaagacacgacttatcgccactggcagcagccac tggtaacaggattagcagagcgaggtatgtaggcggtgctacagagttct tgaagtggtggcctaactacggctacactagaagaacagtatttggtatc tgcgctctgctgaagccagttaccttcggaaaaagagttggtagctcttg atccggcaaacaaaccaccgctggtagcggtggtttttttgtttgcaagc agcagattacgcgcagaaaaaaaggatctcaagaagatcctttgatctttt ctacggggtctgacgctcagtggaacgaaaactcacgttaagggattttt ggtcatgagattatcaaaaaggatcttcacctagatccttttaaattaaa aatgaagttttaaatcaatctaaagtatatatgagtaaacttggtctgac agttaccaatgcttaatcagtgaggcacctatctcagcgatctgtctatt |

TABLE 12-continued

AAV6 Mutant Plasmid vector sequences

| SEQ ID NO | Construct | Sequence |
|---|---|---|
| | | tcgttcatccatagttgcctgactcccgtcgtgtagataactacgatac ggggagggcttaccatctggccccagtgctgcaatgataccgcgagaccca cgctcaccggctccagatttatcagcaataaaccagccagccggaagggc cgagcgcagaagtggtcctgcaactttatccgcctccatccagtctatta attgttgccgggaagctagagtaagtagttcgccagttaatagtttgcgc aacgttgttgccattgctacaggcatcgtggtgtcacgctcgtcgtttgg tatggcttcattcagctccggttcccaacgatcaaggcgagttacatgat cccccatgttgtgcaaaaaagcggttagctccttcggtcctccgatcgtt gtcagaagtaagttggccgcagtgttatcactcatggttatggcagcact gcataattctcttactgtcatgccatccgtaagatgcttttctgtgactg gtgagtactcaaccaagtcattctgagaatagtgtatgcggcgaccgagt tgctcttgcccgcgtcaatacgggataataccgcgccacatagcagaac tttaaaagtgctcatcattggaaaacgttcttcggggcgaaaactctcaa ggatcttaccgctgttgagatccagttcgatgtaacccactcgtgcaccc aactgatcttcagcatcttttactttcaccagcgtttctgggtgagcaaa aacaggaaggcaaaatgccgcaaaaaagggaataagggcgacacggaaat gttgaatactcatactcttccttttcaatattattgaagcatttatcag ggttattgtctcatgagcggatacatatttgaatgtatttagaaaaataa acaaatagggtccgcgcacatttccccgaaaagtgccacctaaattgt aagcgttaatattttgttaaaattcgcgttaaattttttgttaaatcagct cattttttaaccaataggccgaaatcggcaaaatcccttataaatcaaaa gaatagaccgagatagggttgagtgttgttccagtttggaacaagagtcc actattaaagaacgtggactccaacgtcaaagggcgaaaaaccgtctatc agggcgatggcccactacgtgaaccatcaccctaatcaagtttttgggg tcgaggtgccgtaaagcactaaatcggaaccctaaagggagcccccgatt tagagcttgacggggaaagccggcgaacgtggcgagaaaggaagggaaga aagcgaaaggagcgggcgctagggcgctggcaagtgtagcggtcacgctg cgcgtaaccaccacccgccgcgcttaatgcgccgctacagggcgcgtc ccattcgccattcaggctgcgcaactgttgggaagggcgatcggtgcggg cctcttcgctattacgccagctggcgaaaggggatgtgctgcaaggcga ttaagttgggtaacgccagggttttcccagtcacgacgttgtaaaacgac ggccagtgagcgcgcgtaatacgactcactatagggcgaattgggtaccg ggccccccctcgatcgaggtcgacggtatcggggagctcgcagggtctc cattttgaagcgggaggtttgaacgcgcag |

TABLE 13

Chimeric AAV Vectors

| SEQ ID NO | Construct | Sequence |
|---|---|---|
| 214 | 1_pAAV5VP1u-AAV6VP2/3 | ccgccatgccggggttttacgagattgtgattaaggtccccagcgaccttgac gagcatctgcccggcatttctgacagctttgtgaactgggtggccgagaagga atgggagttgccgccagattctgacatggatctgaatctgattgagcaggcac ccctgaccgtggccgagaagctgcagcgcgactttctgacggaatggcgccgt gtgagtaaggccccggaggcccttttcttgtgcaatttgagaagggagagag ctacttccacatgcacgtgctcgtggaaaccaccggggtgaaatccatggttt tgggacgtttcctgagtcagattcgcgaaaaactgattcagagaatttaccgc gggatcgagccgactttgccaaactggttcgcggtcacaaagaccagaaatgg cgccggaggcgggaacaaggtggtggatgagtgctacatccccaattacttgc tccccaaaacccagcctgagctccagtgggcgtggactaatatgaacagtat ttaagcgcctgtttgaatctcacggagcgtaaacggttggtggcgcagcatct gacgcacgtgtcgcagacgcaggagcagaacaaagagaatcagaatcccaatt ctgatgcgccggtgatcagatcaaaaacttcagccaggtacatggagctggtc gggtggctcgtggacaaggggattacctcggagaagcagtggatccaggagga ccaggcctcatacatctccttcaatgcggcctccaactcgcggtcccaaatca aggctgccttggacaatgcgggaaagattatgagcctgactaaaaccgccccc gactacctggtgggccagcagcccgtggaggacatttccagcaatcggattta taaaattttggaactaaacgggtacgatccccaatatgcggcttccgtcttc tgggatgggccacgaaaagttcggcaagaggaacaccatctggctgttgg cctgcaactaccgggaagaccaacatcgcggaggccatagcccacactgtgcc cttctacgggtgcgtaaactggaccaatgagaacttccccttcaacgactgtg tcgacaagatggtgatctggtgggaggagggggaagatgaccgccaaggtcgtg gagtcggccaaagccattctcggaggaagcaaggtgcgcgtggaccagaaatg caagtcctcggcccagatagacccgactcccgtgatcgtcacctccaacacca acatgtgcgccgtgattgacgggaactcaacgaccttcgaacaccagcagccg ttgcaagaccggatgttcaaatttgaactcacccgccgtctggatcatgactt tgggaaggtcaccaagcaggaagtcaaagacttttccggtgggcaaaggatc acgtggttgaggtggagcatgaattctacgtcaaaaagggtggagccaagaaa agacccgccccagtgacgcagatataagtgagcccaaacgggtgcgcgagtc |

TABLE 13 -continued

Chimeric AAV Vectors

| SEQ ID NO | Construct | Sequence |
|---|---|---|
| | | agttgcgcagccatcgacgtcagacgcggaagcttcgatcaactacgcagaca
ggtaccaaaacaaatgttctcgtcacgtgggcatgaatctgatgctgtttccc
tgcagacaatgcgagagaatgaatcagaattcaaatatctgcttcactcacgg
acagaaagactgtttagagtgctttcccgtgtcagaatctcaacccgtttctg
tcgtcaaaaaggcgtatcagaaactgtgctacattcatcatatcatgggaaag
gtgccagacgcttgcactgcctgcgatctggtcaatgtggatttggatgactg
catctttgaacaataaatgatttaaatcaggtatgtcttttgttgatcaccct
ccagattggttggaagaagttggtgaaggtcttcgcgagttttgggccttga
agcgggccaccgaaaccaaaacccaatcagcagcatcaagatcaagcccgtg
gtcttgtgctgcctggttataactatctcggacccggaaacggtctcgatcga
ggagagcctgtcaacagggcagacgaggtcgcgcgagagcacgacatctcgta
caacgagcagcttgaggcgggagacaaccccctacctcaagtacaaccacgcgg
acgccgagtttcaggagaagctcgccgacgacacatccttcggggggaaacctc
ggaaaggcagtctttcaggccaagaaaagggttctcgaaccttttggcctggt
tgaagagggtgctaagacggctcctggaaagaaacgtccggtagagcagtcgc
cacaagagccagactcctcctcgggcattggcaagacaggccagcagcccgct
aaaaagagactcaattttggtcagactggcgactcagagtcagtccccgaccc
acaacctctcggagaacctccagcaaccccgctgctgtgggacctactacaa
tggcttcaggcggtggcgcaccaatggcagacaataacgaaggcgccgacgga
gtgggtaatgcctcaggaaattggcattgcgattccacatggctgggcgacag
agtcatcaccaccagcacccgaacatgggccttgcccacctataacaaccacc
tctacaagcaaatctccagtgcttcaacggggggccagcaacgacaaccactac
ttcggctacagcaccccctgggggtattttgatttcaacagattccactgcca
tttctcaccacgtgactggcagcgactcatcaacaacaattgggggattccggc
ccaagagactcaacttcaagctcttcaacatccaagtcaaggaggtcacgacg
aatgatggcgtcacgaccatcgctaataaccttaccagcacggttcaagtctt
ctcggactcggagtaccagttgccgtacgtcctcggctctgcgcaccagggct
gcctccctccgttcccggcggacgtgttcatgattccgcagtacggctaccta
acgctcaacaatggcagccaggcagtgggacggtcatccttttactgcctgga
atatttcccatcgcagatgctgagaacgggcaataactttaccttcagctaca
ccttcgaggacgtgcctttccacagcagctacgcgcacagccagagcctggac
cggctgatgaatcctctcatcgaccagtacctgtattacctgaacagaactca
gaatcagtccggaagtgcccaaaacaaggacttgctgtttagccgggggtctc
cagctggcatgtctgttcagcccaaaaactggctacctggaccctgttaccgg
cagcagcgcgtttctaaaacaaaaacagacaacaacaacagcaactttacctg
gactggtgcttcaaaatataaccttaatgggcgtgaatctataatcaaccctg
gcactgctatggcctcacacaaagacgacaaagacaagttctttcccatgagc
ggtgtcatgattttggaaaggagagcgccggagcttcaaacactgcattgga
caatgtcatgatcacagacgaagaggaaatcaaagccactaaccccgtggcca
ccgaaagatttgggactgtggcagtcaatctccagagcagcagcacagaccct
gcgaccggagatgtgcatgttatgggagccttacctggaatggtgtggcaaga
cagagacgtatacctgcagggtcctatttgggccaaaattcctcacacggatg
gacactttcacccgtctcctctcatgggcggctttggacttaagcacccgcct
cctcagatcctcatcaaaaacacgcctgttcctgcgaatcctccggcagagtt
ttcggctacaaagtttgcttcattcatcacccagtattccacaggacaagtga
gcgtggagattgaatgggagctgcagaaagaaaacagcaaacgctggaatccc
gaagtgcagtatacatctaactatgcaaaatctgccaacgttgatttcactgt
ggacaacaatggactttatactgagcctcgccccattggcacccgttacctca
cccgtccctgtaattgtgtgttaatcaataaaccggttgattcgtttcagtt
gaactttggtctctgcgaagggcgaattcgtttaaacctgcaggactagaggt
cctgtattagaggtcacgtgagtgttttgcgacattttgcgacaccatgtggt
cacgctgggtatttaagcccgagtgagcacgcagggtctccattttgaagcgg
gaggtttgaacgcgcagccgccaagccgaattctgcagatatccatcacactg
gcggccgctcgactagagcggccgccaccgcggtggagctccagcttttgttc
cctttagtgagggttaattgcgcgcttggcgtaatcatggtcatagctgtttc
ctgtgtgaaattgttatccgctcacaattccacacaacatacgagccggaagc
ataaagtgtaaagcctggggtgcctaatgagtgagctaactcacattaattgc
gttgcgctcactgcccgctttccagtcgggaaacctgtcgtgccagctgcatt
aatgaatcggccaacgcgcggggagaggcggtttgcgtattgggcgctcttcc
gcttcctcgctcactgactcgctgcgctcggtcgttcggctgcggcgagcggt
atcagctcactcaaaggcggtaatacggttatccacagaatcaggggataacg
caggaaagaacatgtgagcaaaaggccagcaaaaggccaggaaccgtaaaaag
gccgcgttgctggcgtttttccataggctccgcccccctgacgagcatcacaa
aaatcgacgctcaagtcagaggtggcgaaacccgacaggactataaagatacc
aggcgtttccccctggaagctccctcgtgcgctctcctgttccgaccctgccg
cttaccggatacctgtccgcctttctcccttcgggaagcgtggcgctttctca
tagctcacgctgtaggtatctcagttcggtgtaggtcgttcgctccaagctgg
gctgtgtgcacgaaccccccgttcagcccgaccgctgcgccttatccggtaac
tatcgtcttgagtccaacccggtaagacacgacttatcgccactggcagcagc
cactggtaacaggattagcagagcgaggtatgtaggcggtgctacagagttct
tgaagtggtggcctaactacggctacactagaagaacagtatttggtatctgc
gctctgctgaagccagttaccttcggaaaaagagttggtagctcttgatccgg
caaacaaaccaccgctggtagcggtggtttttttgttgcaagcagcagatta
cgcgcagaaaaaaaggatctcaagaagatcctttgatcttttctacggggtct
gacgctcagtggaacgaaaactcacgttaagggattttggtcatgagattatc |

TABLE 13 -continued

Chimeric AAV Vectors

| SEQ ID NO | Construct | Sequence |
|---|---|---|
| | | aaaaaggatcttcacctagatccttttaaattaaaaatgaagttttaaatcaa<br>tctaaagtatatatgagtaaacttggtctgacagttaccaatgcttaatcagt<br>gaggcacctatctcagcgatctgtctatttcgttcatccatagttgcctgact<br>ccccgtcgtgtagataactacgatacgggagggcttaccatctggccccagtg<br>ctgcaatgataccgcgagacccacgctcaccggctccagatttatcagcaata<br>aaccagccagccggaagggccgagcgcagaagtggtcctgcaactttatccgc<br>ctccatccagtctattaattgttgccgggaagctagagtaagtagttcgccag<br>ttaatagtttgcgcaacgttgttgccattgctacaggcatcgtggtgtcacgc<br>tcgtcgtttggtatggcttcattcagctccggttcccaacgatcaaggcgagt<br>tacatgatcccccatgttgtgcaaaaaagcggttagctccttcggtcctccga<br>tcgttgtcagaagtaagttggccgcagtgttatcactcatggttatggcagca<br>ctgcataattctcttactgtcatgccatccgtaagatgcttttctgtgactgg<br>tgagtactcaaccaagtcattctgagaatagtgtatgcggcgaccgagttgct<br>cttgcccggcgtcaatacgggataataccgcgccacatagcagaactttaaaa<br>gtgctcatcattggaaaacgttcttcggggcgaaaactctcaaggatcttacc<br>gctgttgagatccagttcgatgtaacccactcgtgcacccaactgatcttcag<br>catcttttactttcaccagcgtttctgggtgagcaaaaacaggaaggcaaaat<br>gccgcaaaaaagggaataagggcgacacgaaatgttgaatactcatactctt<br>cctttttcaatattattgaagcatttatcagggttattgtctcatgagcggat<br>acatatttgaatgtatttagaaaaataaacaaataggggttccgcgcacattt<br>ccccgaaaagtgccacctaaattgtaagcgttaatattttgttaaaattcgcg<br>ttaaatttttgttaaatcagctcatttttaaccaataggccgaaatcggcaa<br>aatcccttataaatcaaaagaatagaccgagatagggttgagtgttgttccag<br>tttggaacaagagtccactattaaagaacgtggactccaacgtcaaagggcga<br>aaaaccgtctatcagggcgatggcccactacgtgaaccatcaccctaatcaag<br>ttttttggggtcgaggtgccgtaaagcactaaatcggaaccctaaagggagcc<br>cccgatttagagcttgacggggaaagccggcgaacgtggcgagaaaggaaggg<br>aagaaagcgaaaggagcgggcgctagggcgctggcaagtgtagcggtcacgct<br>gcgcgtaaccaccacacccgccgcgcttaatgcgccgctacagggcgcgtccc<br>attcgccattcaggctgcgcaactgttgggaagggcgatcggtgcgggcctct<br>tcgctattacgccagctggcgaaaggggggatgtgctgcaaggcgattaagttg<br>ggtaacgccagggttttcccagtcacgacgttgtaaaacgacggccagtgagc<br>gcgcgtaatacgactcactatagggcgaattgggtaccgggccccccctcgat<br>cgaggtcgacggtatcggggagctcgcagggtctccattttgaagcgggagg<br>tttgaacgcgcag |
| 215 | 2_rAAV4P12-<br>AAV6VP3 | ccgccatgccggggttttacgagattgtgattaaggtccccagcgaccttgac<br>gagcatctgcccggcatttctgacagctttgtgaactgggtggccgagaagga<br>atgggagttgccgccagattctgacatggatctgaatctgattgagcaggcac<br>ccctgaccgtggccgagaagctgcagcgcgactttctgacggaatggcgccgt<br>gtgagtaaggccccggaggccccttttcttttgtgcaatttgagaagggagagag<br>ctacttccacatgcacgtgctcgtggaaaccaccggggtgaaatccatggttt<br>tgggacgtttcctgagtcagattcgcgaaaaactgattcagagaatttaccgc<br>gggatcgagccgactttgccaaactggttcgcggtcacaaagaccagaaatgg<br>cgccggaggcgggaacaaggtggtggatgagtgctacatccccaattacttgc<br>tccccaaaacccagcctgagctccagtgggcgtggactaatatggaacagtat<br>ttaagcgcctgtttgaatctcacggagcgtaaacggttggtggcgcagcatct<br>gacgcacgtgtcgcagacgcaggagcagaacaaagagaatcagaatcccaatt<br>ctgatgcgccggtgatcagatcaaaaacttcagccaggtacatggagctggtc<br>gggtggctcgtggacaagggattacctcggagaagcagtggatccaggagga<br>ccaggcctcatacatctccttcaatgcggcctccaactcgcggtcccaaatca<br>aggctgccttggacaatgcgggaaagattatgagcctgactaaaaccgcccc<br>gactacctggtgggccagcagcccgtggaggacatttccagcaatcggattta<br>taaaattttggaactaaacgggtacgatcccaatatgcggcttccgtctttc<br>tgggatgggccacgaaaaagttcggcaagaggaacaccatctggctgtttggg<br>cctgcaactaccggggaagaccaacatcgcggaggccatagcccacactgtgcc<br>cttctacgggtgcgtaaactggaccaatgagaactttcccttcaacgactgtg<br>tcgacaagatggtgatctggtgggaggaggggaagatgaccgccaaggtcgtg<br>gagtcggccaaagccattctcggaggaagcaaggtgcgcgtggaccagaaatg<br>caagtcctcggcccagatagacccgactcccgtgatcgtcacctccaacacca<br>acatgtgcgccgtgattgacgggaactcaacgaccttcgaacaccagcagccg<br>ttgcaagaccggatgttcaaatttgaactcacccgccgtctggatcatgactt<br>tgggaaggtcaccaagcaggaagtcaaagactttttccggtgggcaaaggatc<br>acgtggttgaggtggagcatgaattctacgtcaaaaagggtggagccaagaaa<br>agacccgcccccagtgacgcagatataagtgagcccaaacgggtgcgcgagtc<br>agttgcgcagccatcgacgtcagacgcggaagcttcgatcaactacgcagaca<br>ggtaccaaaacaaatgttctcgtcacgtgggcatgaatctgatgctgtttccc<br>tgcagacaatgcgagagaatgaatcagaattcaaatatctgcttcactcacgg<br>acagaaagactgtttagagtgctttcccgtgtcagaatctcaacccgtttctg<br>tcgtcaaaaaggcgtatcagaaactgtgctacattcatcatatcatgggaaag<br>gtgccagacgcttgcactgcctgcgatctggtcaatgtggatttggatgactg<br>catctttgaacaataaatgatttaaatcaggtatgactgacggttaccttcca<br>gattggctagaggacaacctctctgaaggcgttcgagagtggtgggcgctgca<br>acctggagcccctaaacccaaggcaaatcaacaacatcaggacaacgctcggg<br>gtcttgtgcttccgggttacaaatacctcggacccggcaacggactcgacaag |

TABLE 13 -continued

Chimeric AAV Vectors

| SEQ ID NO | Construct | Sequence |
|---|---|---|
| | | ggggaacccgtcaacgcagcggacgcggcagccctcgagcacgacaaggccta |
| | | cgaccagcagctcaaggccggtgacaacccctacctcaagtacaaccacgccg |
| | | acgcggagttccagcagcggcttcagggcgacacatcgtttgggggcaacctc |
| | | ggcagagcagttcttccaggccaaaaagagggttcttgaacctcttggtctggt |
| | | tgagcaagcgggtgagacggctcctggaaagaagagaccgttgattgaatccc |
| | | cccagcagcccgactcctccacgggtatcggcaaaaaaggcaagcagccggct |
| | | aaaaagaagctcgttttcgaagacgaaactggagcaggcgacggaccccctga |
| | | gggatcaacttccggagccatgtctgatgacagtgagatggcttcaggcggtg |
| | | gcgcaccaatggcagacaataacgaaggcgccgacggagtgggtaatgcctca |
| | | ggaaattggcattgcgattccacatggctgggcgacagagtcatcaccaccag |
| | | cacccgaacatgggccttgcccacctataacaaccacctctacaagcaaatct |
| | | ccagtgcttcaacgggggccagcaacgacaaccactacttcggctacagcacc |
| | | ccctgggggtattttgattttcaacagattccactgccatttctcaccacgtga |
| | | ctggcagcgactcatcaacaacaattggggattccggcccaagagactcaact |
| | | tcaagctcttcaacatccaagtcaaggaggtcacgacgaatgatggcgtcacg |
| | | accatcgctaataaccttaccagcacggttcaagtcttctcggactcggagta |
| | | ccagttgccgtacgtcctcggctctgcgcaccagggctgcctccctccgttcc |
| | | cggcggacgtgttcatgattccgcagtacggctacctaacgctcaacaatggc |
| | | agccaggcagtgggacggtcatcctttttactgcctggaatatttcccatcgca |
| | | gatgctgagaacgggcaataactttaccttcagctacaccttcgaggacgtgc |
| | | ctttccacagcagctacgcgcacagccagagcctggaccggctgatgaatcct |
| | | ctcatcgaccagtacctgtattacctgaacagaactcagaatcagtccggaag |
| | | tgcccaaaacaaggacttgctgtttagccgggggtctccagctggcatgtctg |
| | | ttcagcccaaaaactggctacctggaccctgttaccggcagcagcgcgtttct |
| | | aaaacaaaaacagacaacaacaacagcaactttacctggactggtgcttcaaa |
| | | atataaccttaatgggcgtgaatctataatcaaccctggcactgctatggcct |
| | | cacacaaagacgacaaagacaagttctttcccatgagcggtgtcatgatttt |
| | | ggaaaggagagcgccggagcttcaaacactgcattggacaatgtcatgatcac |
| | | agacgaagaggaaatcaaagccactaaccccgtggccaccgaaagatttggga |
| | | ctgtggcagtcaatctccagagcagcagcacagaccctgcgaccggagatgtg |
| | | catgttatgggagccttacctggaatggtgtggcaagacagagacgtatacct |
| | | gcagggtcctatttgggccaaaattcctcacacggatggacactttcacccgt |
| | | ctcctctcatgggcggcttttggacttaagcacccgcctcctcagatcctcatc |
| | | aaaaacacgcctgttcctgcgaatcctccggcagagttttcggctacaaagtt |
| | | tgcttcattcatcacccagtattccacaggacaagtgagcgtggagattgaat |
| | | gggagctgcagaaagaaaacagcaaacgctggaatcccgaagtgcagtataca |
| | | tctaactatgcaaaatctgccaacgttgatttcactgtggacaacaatggact |
| | | ttatactgagcctcgcccattggcacccgttacctcacccgtccctgtaat |
| | | tgtgtgttaatcaataaaccggttgattcgtttcagttgaactttggtctctg |
| | | cgaagggcgaattcgtttaaacctgcaggactagaggtcctgtattagaggtc |
| | | acgtgagtgttttgcgacattttgcgacaccatgtggtcacgctgggtattta |
| | | agcccgagtgagcacgcagggtctccattttgaagcggggaggtttgaacgcgc |
| | | agccgccaagccgaattctgcagatatccatcacactggcggccgctcgacta |
| | | gagcggccgccaccgcggtggagctccagcttttgttccctttagtgagggtt |
| | | aattgcgcgcttggcgtaatcatggtcatagctgtttcctgtgtgaaattgtt |
| | | atccgctcacaattccacacaacatacgagccggaagcataaagtgtaaagcc |
| | | tggggtgcctaatgagtgagctaactcacattaattgcgttgcgctcactgcc |
| | | cgctttccagtcgggaaacctgtcgtgccagctgcattaatgaatcggccaac |
| | | gcgcggggagaggcggtttgcgtattgggcgctcttccgcttcctcgctcact |
| | | gactcgctgcgctcggtcgttcggctgcggcgagcggtatcagctcactcaaa |
| | | ggcggtaatacggttatccacagaatcaggggataacgcaggaaagaacatgt |
| | | gagcaaaaggccagcaaaaggccaggaaccgtaaaaaggccgcgttgctggcg |
| | | tttttccataggctccgcccccctgacgagcatcacaaaaatcgacgctcaag |
| | | tcagaggtggcgaaacccgacaggactataaagataccaggcgtttccccctg |
| | | gaagctccctcgtgcgctctcctgttccgaccctgccgcttaccggatacctg |
| | | tccgcctttctcccttcgggaagcgtggcgctttctcatagctcacgctgtag |
| | | gtatctcagttcggtgtaggtcgttcgctccaagctgggctgtgtgcacgaac |
| | | cccccgttcagcccgaccgctgcgccttatccggtaactatcgtcttgagtcc |
| | | aacccggtaagacacgacttatcgccactggcagcagccactggtaacaggat |
| | | tagcagagcgaggtatgtaggcggtgctacagagttcttgaagtggtggccta |
| | | actacggctacactagaagaacagtatttggtatctgcgctctgctgaagcca |
| | | gttaccttcggaaaaagagttggtagctcttgatccggcaaacaaaccaccgc |
| | | tggtagcggtggtttttttgtttgcaagcagcagattacgcgcagaaaaaaag |
| | | gatctcaagaagatcctttgatcttttctacggggtctgacgctcagtggaac |
| | | gaaaactcacgttaagggattttggtcatgagattatcaaaaaggatcttcac |
| | | ctagatcctttttaaattaaaaatgaagttttaaatcaatctaaagtatatatg |
| | | agtaaacttggtctgacagttaccaatgcttaatcagtgaggcacctatctca |
| | | gcgatctgtctatttcgttcatccatagttgcctgactccccgtcgtgtagat |
| | | aactacgatacgggagggcttaccatctggccccagtgctgcaatgataccgc |
| | | gagacccacgctcaccggctccagatttatcagcaataaaccagccagccgga |
| | | agggccgagcgcagaagtggtcctgcaactttatccgcctccatccagtctat |
| | | taattgttgccgggaagctagagtaagtagttcgccagttaatagtttgcgca |
| | | acgttgttgccattgctacaggcatcgtggtgtcacgctcgtcgtttggtatg |
| | | gcttcattcagctccggttcccaacgatcaaggcgagttacatgatcccccat |
| | | gttgtgcaaaaaagcggttagctccttcggtcctccgatcgttgtcagaagta |

TABLE 13 -continued

Chimeric AAV Vectors

| SEQ ID NO | Construct | Sequence |
|---|---|---|
| | | agttggccgcagtgttatcactcatggttatggcagcactgcataattctctt<br>actgtcatgccatccgtaagatgcttttctgtgactggtgagtactcaaccaa<br>gtcattctgagaatagtgtatgcggcgaccgagttgctcttgcccggcgtcaa<br>tacgggataataccgcgccacatagcagaactttaaaagtgctcatcattgga<br>aaacgttcttcggggcgaaaactctcaaggatcttaccgctgttgagatccag<br>ttcgatgtaacccactcgtgcacccaactgatcttcagcatcttttactttca<br>ccagcgtttctgggtgagcaaaaacaggaaggcaaatgccgcaaaaaggga<br>ataagggcgacacgaaatgttgaatactcatactcttcctttttcaatatta<br>ttgaagcatttatcaggggttattgtctcatgagcggatacatatttgaatgta<br>tttagaaaaataaacaaatagggggttccgcgcacatttccccgaaaagtgcca<br>cctaaattgtaagcgttaatattttgttaaaattcgcgttaaattttgttaa<br>atcagctcatttttaaccaataggccgaaatcggcaaaatcccttataaatc<br>aaaagaatagaccgagatagggttgagtgttgttccagtttggaacaagagtc<br>cactattaaagaacgtggactccaacgtcaaagggcgaaaaaccgtctatcag<br>ggcgatggcccactacgtgaaccatcaccctaatcaagttttttgggggtcgag<br>gtgccgtaaagcactaaatcggaaccctaaagggagcccccgatttagagctt<br>gacggggaaagccggcgaacgtggcgagaaaggaagggaagaaagcgaaagga<br>gcgggcgctagggcgctggcaagtgtagcggtcacgctgcgcgtaaccaccac<br>acccgccgcgcttaatgcgccgctacagggcgcgtcccattcgccattcaggc<br>tgcgcaactgttgggaagggcgatcggtgcgggcctcttcgctattacgccag<br>ctggcgaaaggggggatgtgctgcaaggcgattaagttgggtaacgccagggtt<br>ttcccagtcacgacgttgtaaaacgacggccagtgagcgcgcgtaatacgact<br>cactataggcgaattgggtaccgggccccccctcgatcgaggtcgacggtat<br>cggggggagctcgcagggtctccattttgaagcgggaggtttgaacgcgcag |
| 216 | 3_rAAV5VP1/<br>2-AAV6VP3 | ccgccatgccggggttttacgagattgtgattaaggtccccagcgaccttgac<br>gagcatctgcccggcatttctgacagctttgtgaactgggtggccgagaagga<br>atgggagttgccgcagattctgacatggatctgaatctgattgagcaggcac<br>ccctgaccgtggccgagaagctgcagcgcgactttctgacggaatggcgccgt<br>gtgagtaaggccccggaggcccttttctttgtgcaatttgagaagggagagag<br>ctacttccacatgcacgtgctcgtggaaaccaccggggtgaaatccatggttt<br>tgggacgtttcctgagtcagattcgcgaaaaactgattcagagaatttaccgc<br>gggatcgagccgactttgccaaactggttcgcggtcacaaagaccagaaatgg<br>cgccggaggcgggaacaaggtggtggatgagtgctacatccccaattacttgc<br>tccccaaaacccagcctgagctccagtgggcgtggactaatatgaacagtat<br>ttaagcgcctgtttgaatctcacggagcgtaaacggttggtggcgcagcatct<br>gacgcacgtgtcgcagacgcaggagcagaacaaagagaatcagaatcccaatt<br>ctgatgcgccggtgatcagatcaaaaacttcagccaggtacatggagctggtc<br>gggtggctcgtggacaaggggattacctcggagaagcagtggatccaggagga<br>ccaggcctcatacatctccttcaatgcggcctccaactcgcggtcccaaatca<br>aggctgccttggacaatgcgggaaagattatgagcctgactaaaaccgccccc<br>gactacctggtgggccagcagcccgtggaggacatttccagcaatcggatta<br>taaaatttggaactaaacgggtacgatcccaatatgcggcttccgtctttc<br>tgggatgggccacgaaaaagttcggcaagaggaacaccatctggctgtttggg<br>cctgcaactaccgggaagaccaacatcgcggaggccatagcccacactgtgcc<br>cttctacggggtgcgtaaactggaccaatgagaactttcccttcaacgactgtg<br>tcgacaagatggtgatctggtgggaggagggggaagatgaccgccaaggtcgtg<br>gagtcggccaaagccattctcggaggaagcaaggtgcgcgtggaccagaaatg<br>caagtcctcggcccagatagaccgactcccgtgatcgtcacctccaacacca<br>acatgtgcgccgtgattgacgggaactcaacgaccttcgaacaccagcagccg<br>ttgcaagaccggatgttcaaatttgaactcacccgccgtctggatcatgactt<br>tgggaaggtcaccaagcaggaagtcaaagacttttttccggtgggcaaaggatc<br>acgtggttgaggtggagcatgaattctacgtcaaaaagggtggagccaagaaa<br>agacccgccccagtgacgcagatataagtgagcccaaacgggtgcgcgagtc<br>agttgccgcagccatcgacgtcagacgcggaagcttcgatcaactacgcagaca<br>ggtaccaaaacaaatgttctcgtcacgtgggcatgaatctgatgctgtttccc<br>tgcagacaatgcgagagaatgaatcagaattcaaatatctgcttcactcacgg<br>acagaaagactgtttagagtgctttcccgtgtcagaatctcaacccgtttctg<br>tcgtcaaaaaggcgtatcagaaactgtgctacattcatcatatcatgggaaag<br>gtgccagacgcttgcactgcctgcgatctggtcaatgtggatttggatgactg<br>catctttgaacaataaatgatttaaatcaggtatgtcttttgttgatcaccct<br>ccagattggttggaagaagttggtgaaggtcttcgcgagttttttgggccttga<br>agcgggcccaccgaaaccaaaaacccaatcagcagcatcaagatcaagcccgtg<br>gtcttgtgctgcctggttataactatctcggaccccggaaacggtctcgatcga<br>ggagagcctgtcaacagggcagacgaggtcgcgcgagagcacgacatctcgta<br>caacgagcagcttgaggcgggagacaaccctacctcaagtacaaccacgcgg<br>acgccgagtttcaggagaagctcgccgacgacacatccttcggggggaaacctc<br>ggaaaggcagtcttcaggccaagaaaaggggttctcgaaccttttggcctggt<br>tgaagagggtgctaagacgcccctaccggaaagcggatagacgaccactttc<br>caaaaagaaagaaggctcggaccgaagaggactccaagccttccacctcgtca<br>gacgccgaagctggacccagcggatcccagcagctgcaaatcccagcccaacc<br>agcctcaagtttgggagctgatacaatggcttcaggcggtggcgcaccaatgg<br>cagacaataacgaaggcgccgacggagtgggtaatgcctcaggaaattggcat<br>tgcgattccacatggctgggcgacagagtcatcaccaccagcacccgaacatg<br>ggccttgcccacctataacaaccacctctacaagcaaatctccagtgcttcaa |

TABLE 13 -continued

Chimeric AAV Vectors

| SEQ ID NO | Construct | Sequence |
|---|---|---| cgggggccagcaacgacaaccactacttcggctacagcacccctgggggtat
tttgatttcaacagattccactgccatttctcaccacgtgactggcagcgact
catcaacaacaattggggattccggcccaagagactcaacttcaagctcttca
acatccaagtcaaggaggtcacgacgaatgatggcgtcacgaccatcgctaat
aaccttaccagcacggttcaagtcttctcggactcggagtaccagttgccgta
cgtcctcggctctgcgcaccagggctgcctccctccgttcccggcggacgtgt
tcatgattccgcagtacggctacctaacgctcaacaatggcagccaggcagtg
ggacggtcatccttttactgcctggaatatttcccatcgcagatgctgagaac
gggcaataacttttaccttcagctacaccttcgaggacgtgcctttccacagca
gctacgcgcacagccagagcctggaccggctgatgaatcctctcatcgaccag
tacctgtattacctgaacagaactcagaatcagtccggaagtgcccaaaacaa
ggacttgctgtttagccgggggtctccagctggcatgtctgttcagcccaaaa
actggctacctggaccctgttaccggcagcagcgcgtttctaaaacaaaaaca
gacaacaacaacagcaactttacctggactggtgcttcaaaatataaccttaa
tgggcgtgaatctataatcaaccctggcactgctatggcctcacacaaagacg
acaaagacaagttctttcccatgagcggtgtcatgattttttggaaaggagagc
gccggagcttcaaacactgcattggacaatgtcatgatcacagacgaagagga
aatcaaagccactaaccccgtggccaccgaaagatttgggactgtggcagtca
atctccagagcagcagcacagaccctgcgaccggagatgtgcatgttatggga
gccttacctggaatggtgtggcaagacagagacgtatacctgcagggtcctat
ttggggccaaaattcctcacacggatggacactttcacccgtctcctctcatgg
gcggctttggacttaagcacccgcctcctcagatcctcatcaaaaacacgcct
gttcctgcgaatcctccggcagagttttcggctacaaagtttgcttcattcat
cacccagtattccacaggacaagtgagcgtggagattgaatgggagctgcaga
aagaaaacagcaaacgctggaatcccgaagtgcagtacatctaactatgca
aaatctgccaacgttgatttcactgtggacaacaatggactttatactgagcc
tcgcccccattggcacccgttacctcacccgtccctgtaattgtgtgttaatc
aataaaccggttgattcgtttcagttgaactttggtctctgcgaagggcgaat
tcgtttaaacctgcaggactagaggtcctgtattagaggtcacgtgagtgttt
tgcgacattttgcgacaccatgtggtcacgctgggtatttaagcccgagtgag
cacgcagggtctccattttgaagcgggaggtttgaacgcgcagccgccaagcc
gaattctgcagatatccatcacactggcggccgctcgactagagcggccgcca
ccgcggtggagctccagcttttgttccctttagtgaggggttaattgcgcgctt
ggcgtaatcatggtcatagctgtttcctgtgtgaaattgttatccgctcacaa
ttccacacaacatacgagccggaagcataaagtgtaaagcctggggtgcctaa
tgagtgagctaactcacattaattgcgttgcgctcactgcccgctttccagtc
gggaaacctgtcgtgccagctgcattaatgaatcggccaacgcgcggggagag
gcggtttgcgtattgggcgctcttccgcttcctcgctcactgactcgctgcgc
tcggtcgttcggctgcggcgagcggtatcagctcactcaaaggcggtaatacg
gttatccacagaatcaggggataacgcaggaaagaacatgtgagcaaaaggcc
agcaaaaggccaggaaccgtaaaaaggccgcgttgctggcgtttttccatagg
ctccgcccccctgacgagcatcacaaaaatcgacgctcaagtcagaggtggcg
aaacccgacaggactataaagataccaggcgtttccccctggaagctccctcg
tgcgctctcctgttccgaccctgccgcttaccggatacctgtccgcctttctc
ccttcgggaagcgtggcgctttctcatagctcacgctgtaggtatctcagttc
ggtgtaggtcgttcgctccaagctgggctgtgtgcacgaaccccccgttcagc
ccgaccgctgcgccttatccggtaactatcgtcttgagtccaacccggtaaga
cacgacttatcgccactggcagcagccactggtaacaggattagcagagcgag
gtatgtaggcggtgctacagagttcttgaagtggtggcctaactacggctaca
ctagaagaacagtatttggtatctgcgctctgctgaagccagttaccttcgga
aaaagagttggtagctcttgatccggcaaacaaaccaccgctggtagcggtgg
tttttttgtttgcaagcagcagattacgcgcagaaaaaaaggatctcaagaag
atcctttgatcttttctacggggtctgacgctcagtggaacgaaaactcacgt
taagggattttggtcatgagattatcaaaaaggatcttcacctagatcctttt
aaattaaaaatgaagttttaaatcaatctaaagtatatatgagtaaacttggt
ctgacagttaccaatgcttaatcagtgaggcacctatctcagcgatctgtcta
tttcgttcatccatagttgcctgactccccgtcgtgtagataactacgatacg
ggagggcttaccatctggccccagtgctgcaatgataccgcgagacccacgct
caccggctccagatttatcagcaataaaccagccagccggaagggccgagcgc
agaagtggtcctgcaactttatccgcctccatccagtctattaattgttgccg
ggaagctagagtaagtagttcgccagttaatagtttgcgcaacgttgttgcca
ttgctacaggcatcgtggtgtcacgctcgtcgtttggtatggcttcattcagc
tccggttcccaacgatcaaggcgagttacatgatcccccatgttgtgcaaaaa
agcggttagctccttcggtcctccgatcgttgtcagaagtaagttggccgcag
tgttatcactcatggttatggcagcactgcataattctcttactgtcatgcca
tccgtaagatgcttttctgtgactggtgagtactcaaccaagtcattctgaga
atagtgtatgcggcgaccgagttgctcttgcccggcgtcaatacgggataata
ccgcgccacatagcagaactttaaaagtgctcatcattggaaaacgttcttcg
gggcgaaaactctcaaggatcttaccgctgttgagatccagttcgatgtaacc
cactcgtgcacccaactgatcttcagcatcttttactttcaccagcgtttctg
ggtgagcaaaaacaggaaggcaaaatgccgcaaaaaagggaataagggcgaca
cggaaatgttgaatactcatactcttcctttttcaatattattgaagcattta
tcagggttattgtctcatgagcggatacatatttgaatgtatttagaaaaata
aacaaataggggttccgcgcacatttccccgaaaagtgccacctaaattgtaa
gcgttaatattttgttaaaattcgcgttaaattttttgttaaatcagctcattt TABLE 13 -continued Chimeric AAV Vectors

| SEQ ID NO | Construct | Sequence |
|---|---|---|
| | | tttaaccaataggccgaaatcggcaaaatcccttatNaatcaaaagaatagac cgagatagggttgagtgttgttccagtttggaacaagagtccactattaaaga acgtggactccaacgtcaaagggcgaaaaaccgtctatcagggcgatggccca ctacgtgaaccatcaccctaatcaagttttttggggtcgaggtgccgtaaagc actaaatcggaaccctaaagggagcccccgatttagagcttgacggggaaagc cggcgaacgtggcgagaaaggaagggaagaaagcgaaaggagcgggcgctagg gcgctggcaagtgtagcggtcacgctgcgcgtaaccaccacacccgccgcgct taatgcgccgctacagggcgcgtcccattcgccattcaggctgcgcaactgtt gggaagggcgatcggtgcgggcctcttcgctattacgccagctggcgaaaggg ggatgtgctgcaaggcgattaagttgggtaacgccagggttttcccagtcacg acgttgtaaaacgacggccagtgagcgcgcgtaatacgactcactatagggcg aattgggtaccgggccccccctcgatcgaggtcgacggtatcggggagctcg cagggtctccatttgaagcgggaggtttgaacgcgcag |
| 217 | 4_prAAV11VP12-AAV6VP3 | ccgccatgccgggGttttacgagattgtgattaaggtccccagcgaccttgac gagcatctgccggcatttctgacagcttTgtgaactgggtggccgagaagga atgggagttgccgccagattctgacatggatctgaatctgattgagcaggcac ccctgaccgtggccgagaagctgcagcgcgacttctgacggaatggcgccgt gtgagtaaggccccggaggccccttttctttgtgcaatttgagaagggagagag ctacttccacatgcacgtgctcgtggaaaccaccggggtgaaatccatggttt tgggacgtttcctgagtcagattcgcgaaaaactgattcagagaatttaccgc gggatcgagccgactttgccaaactggttcgcggtcacaaagaccagaaatgg cgccggaggcgggaacaaggtggtggatgagtgctacatccccaattacttgc tccccaaaaccagcctgagctccagtgggcgtggactaatatggaacagtat ttaagcgcctgtttgaatctcacggagcgtaaacggttggtggcgcagcatct gacgcacgtgtcgcagacgcaggagcagaacaaagagaatcagaatcccaatt ctgatgcgccggtgatcagatcaaaaacttcagccaggtacatggagctggtc gggtggctcgtggacaaggggattacctcggagaagcagtggatccaggagga ccaggcctcatacatctccttcaatgcggcctccaactcgcggtcccaaatca aggctgcctggacaatgcgggaaagattatgagcctgactaaaaccgccccc gactacctggtgggccagcagcccgtggaggacatttccagcaatcggatTta taaaattttggaactaaacgggtacgatcccaatatgcggcttccgtctttc tgggatgggccacgaaaaagttcggcaagaggaacaccatctggctgtttggg cctgcaactaccggGaagaccaacatcgcggaggccatagcccacactgtgcc cttctacgggtgcgtaaactggaccaatgagaactttccCttcaacgactgtg tcgacaagatggtgatctggtggaggaggggaagatgaccgccaaggtcgtg gagtcggccaaagccattctcggaggaagcaaggtgcgcgtggaccagaaatg caagtcctcggcccagatagacccgactccCgtgatcgtcacctccaacacca catgtgcgccgtgattgacgggaactcaacgaccttcgaacaccagcagccg ttgcaagaccggatgttcaaatttgaactcacccgccgtctggatcatgactt tgggaaggtcaccaagcaggaagtcaaagacttttttCcggtgggcaaaggatc acgtggttgaggtggagcatgaattctacgtcaaaaagggtggagccaagaaa agacccgccccagtgacgcagatataagtgagcccaaacgggtgcgcgagtc agttgcgcagccatcgacgtcagacgcggaagcttcgatcaactacgcagaca ggtaccaaaacaaatgttctcgtcacgtgggcatgaatctgatgctgtttccc tgcagacaatgcgagagaatgaatcagaattcaaatatctgcttcactcacgg acagaaaagactgtttagagtgcttTcccgtgtcagaatctcaacccgtttctg tcgtcaaaaaggcgtatcagaaactgtgctacattcatcatatcatgggaaag gtgccagacgcttgcactgcctgcgatctggtcaatgtggatttggatgactg catctttgaacaataaatgattTaaatcaggtatggctgctgacggttatctt ccagattggctcgaggacaacctctctgagggcattcgcgagtggtgggacct gaaacctggagccccgaagcccaaggccaaccagcagaagcaggacgacggcc ggggtctggtgcttcctggctacaagtacctcggaccccttcaacggactcgac aagggggagcccgtcaacgcggcggacgcagcggccctcgagcacgacaaggc ctacgaccagcagctcaaagcgggtgacaatccgtacctgcggtataaccacg ccgacgccgagtttcaggagcgtctgcaagaagatacgtcttttggggggcaac ctcgggcgagcagtcttccaggccaagaagagggtactcgaacctctgggcct ggttgaagaaggtgctaaaacggctcctggaaagaagaagaccgttagagtcac cacaagagcccgactcctcctcgggcatcggcaaaaaggcaaacaaccagcc agaaagaggctcaactttgaagaggacactggagccggagacggaccccctga aggatcagataccagccatgtcttcagacattgaaatggcttcaggcggtg gcgcaccaatggcagacaataacgaaggcgccgacggagtgggtaatgcctca ggaaattggcattgcgattccacatggctgggcgacagagtcatcaccaccag cacccgaacatgggccttgcccacctataacaaccacctctacaagcaaatct ccagtgcttcaacggggccagcaacgacaaccactacttcggctacagcacc cctgggggtatttttgatttcaacagattccactgccatttctcaccacgtga ctggcagcgactcatcaacaacaattggggattccggcccaagagactcaact tcaagctcttcaacatccaagtcaaggaggtcacgacgaatgatggcgtcacg accatcgctaataaccttaccagcacggttcaagtcttctcggactcggagta ccagttgccgtacgtcctcggctctgcgcaccagggtgcctccctccgttcc cggcggacgtgttcatgattccgcagtacggctacctaacgctcaacaatggc agccaggcagtgggacggtcatcctttttactgcctggaatattttcccatcgca gatgctgagaacggcaataactttacctcagctacaccttcgaggacgtgc cttTccacagcagctacgcgcacagccagagcctggaccggctgatgaatcct ctcatcgaccagtacctgtattacctgaacagaactcagaatcagtccggaag |

TABLE 13 -continued

Chimeric AAV Vectors

| SEQ ID NO | Construct | Sequence |
|---|---|---|
| | | tgcccaaaacaaggacttgctgtttagccgggggtctccagctggcatgtctg
ttcagcccaaaaactggctacctggaccctgttaccggcagcagcgcgtttct
aaaacaaaaacagacaacaacaacagcaactttacctggactggtgcttcaaa
atataaccttaatgggcgtgaatctataatcaaccctggcactgctatggcct
cacacaaagacgacaaagacaagttctttcccatgagcggtgtcatgattttt
ggaaaggagagcgccggagcttcaaacactgcattggacaatgtcatgatcac
agacgaagaggaaatcaaagccactaaccccgtggccaccgaaagatttggga
ctgtggcagtcaatctccagagcagcagcacagaccctgcgaccggagatgtg
catgttatgggagccttacctggaatggtgtggcaagacagagacgtatacct
gcagggtcctatttgggccaaaattcctcacacggatggacacttttcacccgt
ctcctctcatgggcggctttggacttaagcacccgcctcctcagatcctcatc
aaaaacacgcctgttcctgcgaatcctccggcagagttttcggctacaaagtt
tgcttcattcatcacccagtattccacaggacaagtgagcgtggagattgaat
gggagctgcagaaagaaaacagcaaacgctggaatcccgaagtgcagtataca
tctaactatgcaaaatctgccaacgttgatttcactgtggacaacaatggact
ttatactgagcctcgcccccattggcacccgttacctcacccgtccctgtaat
tgtgtgttaatcaataaaccggttgattcgtttcagttgaactttggtctctg
cgaagggcgaattcgtttaaacctgcaggactagaggtcctgtattagaggtc
acgtgagtgttttgcgacattttgcgacaccatgtggtcacgctgggtattta
agcccgagtgagcacgcagggtctccattttgaagcgggagtttgaacgcgc
agccgccaagccgaattctgcagatatccatcacactggcggccgctcgacta
gagcggccgccaccgcggtggagctccagcttttgttcccttagtgagggtt
aattgcgcgcttggcgtaatcatggtcatagctgtttcctgtgtgaaattgtt
atccgctcacaattccacacaacatacgagccggaagcataaagtgtaaagcc
tggggtgcctaatgagtgagctaactcacattaattgcgttgcgctcactgcc
cgctttccagtcgggaaacctgtcgtgccagctgcattaatgaatcggccaac
gcgcggggagaggcggtttgcgtattgggcgctcttccgcttcctcgctcact
gactcgctgcgctcggtcgttcggctgcggcgagcggtatcagctcactcaaa
ggcggtaatacggttatccacagaatcaggggataacgcaggaaagaacatgt
gagcaaaaggccagcaaaaggccaggaaccgtaaaaaggccgcgttgctggcg
tttttccataggctccgcccccctgacgagcatcacaaaaatcgacgctcaag
tcagaggtggcgaaacccgacaggactataaagataccaggcgtttccccctg
gaagctccctcgtgcgctctcctgttccgaccctgccgcttaccggatacctg
tccgcctttctcccttcgggaagcgtggcgctttctcatagctcacgctgtag
gtatctcagttcggtgtaggtcgttcgctccaagctgggctgtgtgcacgaac
cccccgttcagcccgaccgctgcgccttatccggtaactatcgtcttgagtcc
aacccggtaagacacgacttatcgccactggcagcagccactggtaacaggat
tagcagagcgaggtatgtaggcggtgctacagagttcttgaagtggtggccta
actacggctacactagaagaacagtatttggtatctgcgctctgctgaagcca
gttaccttcggaaaaagagttggtagctcttgatccggcaaacaaaccaccgc
tggtagcggtggtttttttgtttgcaagcagcagattacgcgcagaaaaaaag
gatctcaagaagatcctttgatcttttctacggggtctgacgctcagtggaac
gaaaactcacgttaagggattttggtcatgagattatcaaaaaggatcttcac
ctagatccttttaaattaaaaatgaagttttaaatcaatctaaagtatatatg
agtaaacttggtctgacagttaccaatgcttaatcagtgaggcacctatctca
gcgatctgtctatttcgttcatccatagttgcctgactccccgtcgtgtagat
aactacgatacgggagggcttaccatctggccccagtgctgcaatgataccgc
gagacccacgctcaccggctccagatttatcagcaataaaccagccagccgga
agggccgagcgcagaagtggtcctgcaactttatccgcctccatccagtctat
taattgttgccgggaagctagagtaagtagttcgccagttaatagtttgcgca
acgttgttgccattgctacaggcatcgtggtgtcacgctcgtcgtttggtatg
gcttcattcagctccggttcccaacgatcaaggcgagttacatgatcccccat
gttgtgcaaaaaagcggttagctccttcggtcctccgatcgttgtcagaagta
agttggccgcagtgttatcactcatggttatggcagcactgcataattctctt
actgtcatgccatccgtaagatgcttttctgtgactggtgagtactcaaccaa
gtcattctgagaatagtgtatgcggcgaccgagttgctcttgcccggcgtcaa
tacgggataataccgcgccacatagcagaactttaaaagtgctcatcattgga
aaacgttcttcggggcgaaaactctcaaggatcttaccgctgttgagatccag
ttcgatgtaacccactcgtgcacccaactgatcttcagcatcttttactttca
ccagcgtttctgggtgagcaaaaacaggaaggcaaaatgccgcaaaaaaggga
ataagggcgacacggaaatgttgaatactcatactcttcctttttcaatatta
ttgaagcatttatcaggtttattgtctcatgagcggatacatatttgaatgta
tttagaaaataaacaaataggggttccgcgcacatttccccgaaaagtgcca
cctaaattgtaagcgttaatattttgttaaaattcgcgttaaattttttgttaa
atcagctcatttttaaccaataggccgaaatcggcaaaatcccttataaatc
aaaagaatagaccgagatagggttgagtgttgttccagtttggaacaagagtc
cactattaaagaacgtggactccaacgtcaaagggcgaaaaaccgtctatcag
ggcgatggcccactacgtgaaccatcaccctaatcaagttttttggggtcgag
gtgccgtaaagcactaaatcggaacctaaagggagcccccgatttagagctt
gacgggaaagccggcgaacgtggcgagaaaggaagggaagaaagcgaaagga
gcgggcgctagggcgctggcaagtgtagcggtcacgctgcgcgtaaccaccac
acccgccgcgcttaatgcgccgctacagggcgcgtcccattcgccattcaggc
tgcgcaactgttgggaagggcgatcggtgcgggcctcttcgctattacgccag
ctggcgaaggggggatgtgctgcaaggcgattaagttgggtaacgccagggtt
ttcccagtcacgacgttgtaaaacgacggccagtgagcgcgcgtaatacgact |

TABLE 13 -continued

Chimeric AAV Vectors

| SEQ ID NO | Construct | Sequence |
|---|---|---|
| | | cactatagggcgaattgggtaccgggccccccctcgatcgaggtcgacggtat cgggggagctcgcagggtctccattttgaagcgggaggtttgaacgcgcag |
| 218 | 5_prAAV12VP12-AAV6VP3 | ccgccatgccggggttttacgagattgtgattaaggtccccagcgaccttgac gagcatctgcccggcatttctgacagctttgtgaactgggtggccgagaagga atgggagttgccgccagattctgacatggatctgaatctgattgagcaggcac ccctgaccgtggccgagaagctgcagcgcgactttctgacggaatggcgccgt gtgagtaaggccccggaggcccttttctttgtgcaatttgagaagggagagag ctacttccacatgcacgtgctcgtggaaaccaccggggtgaaatccatggttt tgggacgtttcctgagtcagattcgcgaaaaactgattcagagaatttaccgc gggatcgagccgactttgccaaactggttcgcggtcacaaagaccagaaatgg cgccggaggcgggaacaaggtggtggatgagtgctacatccccaattacttgc tcccaaaacccagcctgagctccagtgggcgtggactaatatggaacagtat ttaagcgcctgtttgaatctcacggagcgtaaacggttggtggcgcagcatct gacgcacgtgtcgcagacgcaggagcagaacaaagagaatcagaatcccaatt ctgatgcgccggtgatcagatcaaaaacttcagccaggtacatggagctggtc gggtggctcgtggacaaggggattacctcggagaagcagtggatccaggagga ccaggcctcatacatctccttcaatgcggcctccaactcgcggtcccaaatca aggctgccttggacaatgcgggaaagattatgagcctgactaaaaccgcccc gactacctggtgggccagcagcccgtggaggacatttccagcaatcggattta taaaattttggaactaaacgggtacgatccccaatatgcggcttccgtctttc tgggatgggccacgaaaaagttcggcaagaggaacaccatctggctgtttggg cctgcaactaccgggaagaccaacatcgcggaggccatagcccacactgtgcc cttctacgggtgcgtaaactggaccaatgagaactttcccttcaacgactgtg tcgacaagatggtgatctggtggggaggaggggaagatgaccgccaaggtcgtg gagtcggccaaagccattctcggaggaagcaaggtgcgcgtggaccagaaatg caagtcctcggcccagatagacccgactcccgtgatcgtcacctccaacacca acatgtgcgccgtgattgacgggaactcaacgaccttcgaacaccagcagccg ttgcaagaccggatgttcaaatttgaactcaccccgccgtcctggatcatgactt tgggaaggtcaccaagcaggaagtcaaagactttttccggtgggcaaaggatc acgtggttgaggtggagcatgaattctacgtcaaaaagggtggagccaagaaa agacccgcccccagtgacgcagatataagtgagcccaaacgggtgcgcgagtc agttgcgcagccatcgacgtcagacgcggaagcttcgatcaactacgcagaca ggtaccaaaacaaatgttctcgtcacgtgggcatgaatctgatgctgtttccc tgcagacaatgcgagagaatgaatcagaattcaaatatctgcttcactcacgg acagaaagactgtttagagtgctttcccgtgtcagaatctcaacccgtttctg tcgtcaaaaaggcgtatcagaaactgtgctacattcatcatatcatgggaaag gtgccagacgcttgcactgcctgcgatctggtcaatgtggatttggatgactg catctttgaacaataaatgatttaaatcaggtatggctgctgacggttatctt ccagattggctcgaggacaacctctctgaaggcattcgcgagtggtgggcgct gaaacctggagctccacaacccaaggccaaccaacagcatcaggacaacggca ggggtcttgtgcttcctgggtacaagtacctcggacccttcaacggactcgac aagggagagccggtcaacgaggcagacgccgcggccctcgagcacgacaaggc ctacgacaagcagctcgagcaggggggacaacccgtatctcaagtacaaccacg ccgacgccgagttccagcagcgcttggcgaccgacacctcttttgggggcaac ctcgggcgagcagtcttccaggccaaaaagaggattctcgagcctctgggtct ggttgaagagggcgttaaaacggctcctggaaagaaacgcccattagaaaaga ctccaaatcggccgaccaacccggactctgggaaggccccggccaagaaaaag caaaaagacggcgaaccagccgactctgctagaaggacactcgactttgaaga ctctgagcaggagacggaccccctgagggatcatcttccggagaaatgtctc atgatgctgagatggcttcaggcggtggcgcaccaatggcagacaataacgaa ggcgccgacggagtgggtaatgcctcaggaaattggcattgcgattccacatg gctgggcgacagagtcatcaccaccagcacccgaacatgggccttgcccacct ataacaaccacctctacaagcaaatctccagtgcttcaacggggggccagcaac gacaaccactacttcggctacagcacccctgggggtattttgatttcaacag attccactgccatttctcaccacgtgactggcagcgactcatcaacaacaatt ggggattccggcccaagagactcaacttcaagctcttcaacatccaagtcaag gaggtcacgacgaatgatggcgtcacgaccatcgctaataaccttaccagcac ggttcaagtcttctcggactcggagtaccagttgccgtacgtcctccggctctg cgcaccagggctgcctccctccgttcccggcggacgtgttcatgattccgcag tacggctacctaacgctcaacaatggcagccaggcagtgggacggtcatcctt ttactgcctggaatatttccctcgcagatgctgagaacgggcaataacttta ccttcagctacaccttcgaggacgtgccttttccacacagcagctacgcgcacagc cagagcctggaccggctgatgaatcctctcatcgaccagtacctgtattacct gaacagaactcagaatcagtccggaagtgcccaaaacaaggacttgctgttta gccggggtctccagctggcatgtctgttcagcccaaaaactggctacctgga ccctgttaccggcagcagcgcgtttctaaaacaaaaacagacaacaacaacag caactttacctggactggtgcttcaaaatataaccttaatgggcgtgaatcta taatcaaccctggcactgctatggcctcacacaaagacgacaaagacaagttc tttcccatgagcggtgtcatgattttttggaaaggagagcgccggaacttcaaa cactgcattggacaatgtcatgatcacagacgaagaggaaatcaaagccacta acccccgtggccaccgaaagatttgggactgtggcagtcaatctccagagcagc agcacagaccctgcgaccggagatgtgcatgttatgggagccttacctggaat ggtgtggcaagacagagacgtatacctgcagggtcctatttgggccaaaattc ctcacacggatggacactttcacccgtctcctctcatgggcggctttggactt |

TABLE 13 -continued

Chimeric AAV Vectors

| SEQ ID NO | Construct | Sequence |
|---|---|---|
| | | aagcacccgcctcctcagatcctcatcaaaaacacgcctgttcctgcgaatcc<br>tccggcagagttttcggctacaaagtttgcttcattcatcacccagtattcca<br>caggacaagtgagcgtggagattgaatgggagctgcagaaagaaaacagcaaa<br>cgctggaatcccgaagtgcagtatacatctaactatgcaaaatctgccaacgt<br>tgatttcactgtggacaacaatggactttatactgagcctcgccccattggca<br>cccgttacctcacccgtccctgtaattgtgtgttaatcaataaaccggttga<br>ttcgtttcagttgaactttggtctctgcgaagggcgaattcgtttaaacctgc<br>aggactagaggtcctgtattagaggtcacgtgagtgttttgcgacattttgcg<br>acaccatgtggtcacgctgggtatttaagcccgagtgagcacgcagggtctcc<br>atttgaagcgggaggtttgaacgcgcagccgccaagccgaattctgcagata<br>tccatcacactggcggccgctcgactagagcggccgccaccgcggtggagctc<br>cagcttttgttcccttagtgaggggttaattgcgcgcttggcgtaatcatggt<br>catagctgtttcctgtgtgaaattgttatccgctcacaattccacacaacata<br>cgagccggaagcataaagtgtaaagcctggggtgcctaatgagtgagctaact<br>cacattaattgcgttgcgctcactgcccgctttccagtcgggaaacctgtcgt<br>gccagctgcattaatgaatcggccaacgcgcgggagaggcggtttgcgtatt<br>gggcgctcttccgcttcctcgctcactgactcgctgcgctcggtcgttcggct<br>gcggcgagcggtatcagctcactcaaaggcggtaatacggttatccacagaat<br>caggggataacgcaggaaagaacatgtgagcaaaaggccagcaaaaggccagg<br>aaccgtaaaaaggccgcgttgctggcgtttttccataggctccgcccccctga<br>cgagcatcacaaaaatcgacgctcaagtcagaggtggcgaaacccgacaggac<br>tataaagataccaggcgtttccccctggaagctccctcgtgcgctctcctgtt<br>ccgaccctgccgcttaccggatacctgtccgcctttctcccttcgggaagcgt<br>ggcgctttctcatagctcacgctgtaggtatctcagttcggtgtaggtcgttc<br>gctccaagctgggctgtgtgcacgaaccccccgttcagcccgaccgctgcgcc<br>ttatccggtaactatcgtcttgagtccaacccggtaagacacgacttatcgcc<br>actggcagcagccactggtaacaggattagcagagcgaggtatgtaggcggtg<br>ctacagagttcttgaagtggtggcctaactacggctacactagaagaacagta<br>tttggtatctgcgctctgctgaagccagttaccttcggaaaaagagttggtag<br>ctcttgatccggcaaacaaaccaccgctggtagcggtggtttttttgtttgca<br>agcagcagattacgcgcagaaaaaaaggatctcaagaagatcctttgatctt<br>tctacggggtctgacgctcagtggaacgaaaactcacgttaagggattttggt<br>catgagattatcaaaaaggatcttcacctagatcctttaaattaaaaatgaa<br>gttttaaatcaatctaaagtatatatgagtaaacttggtctgacagttaccaa<br>tgcttaatcagtgaggcacctatctcagcgatctgtctatttcgttcatccat<br>agttgcctgactccccgtcgtgtagataactacgatacgggagggcttaccat<br>ctggccccagtgctgcaatgataccgcgagacccacgctcaccggctccagat<br>ttatcagcaataaaccagccagccggaagggccgagcgcagaagtggtcctgc<br>aactttatccgcctccatccagtctattaattgttgccgggaagctagagtaa<br>gtagttcgccagttaatagtttgcgcaacgttgttgccattgctacaggcatc<br>gtggtgtcacgctcgtcgtttggtatggcttcattcagctccggttcccaacg<br>atcaaggcgagttacatgatcccccatgttgtgcaaaaaagcggttagctcct<br>tcggtcctccgatcgttgtcagaagtaagttggccgcagtgttatcactcatg<br>gttatggcagcactgcataattctcttactgtcatgccatccgtaagatgctt<br>ttctgtgactggtgagtactcaaccaagtcattctgagaatagtgtatgcggc<br>gaccgagttgctcttgcccggcgtcaatacgggataataccgcgccacatagc<br>agaactttaaaagtgctcatcattggaaaacgttcttcggggcgaaaactctc<br>aaggatcttaccgctgttgagatccagttcgatgtaacccactcgtgcaccca<br>actgatcttcagcatcttttactttcaccagcgtttctgggtgagcaaaaaca<br>ggaaggcaaaatgccgcaaaaaagggaataagggcgacacggaaatgttgaat<br>actcatactcttcctttttcaatattattgaagcatttatcagggttattgtc<br>tcatgagcggatacatatttgaatgtatttagaaaaataaacaaatagggggtt<br>ccgcgcacatttccccgaaaagtgccacctaaattgtaagcgttaatattttg<br>ttaaaattcgcgttaaatttttgttaaatcagctcattttttaaccaataggc<br>cgaaatcggcaaaatcccttataaatcaaaagaatagaccgagatagggttga<br>gtgttgttccagtttggaacaagagtccactattaaagaacgtggactccaac<br>gtcaaagggcgaaaaaccgtctatcagggcgatggcccactacgtgaaccatc<br>accctaatcaagttttttggggtcgaggtgccgtaaagcactaaatcggaacc<br>ctaaagggagccccgatttagagcttgacggggaaagccggcgaacgtggcg<br>agaaaggaagggaagaaagcgaaaggagcgggcgctagggcgctggcaagtgt<br>agcggtcacgctgcgcgtaaccaccacacccgccgcgcttaatgcgccgctac<br>agggcgcgtcccattcgccattcaggctgcgcaactgttgggaagggcgatcg<br>gtgcgggcctcttcgctattacgccagctggcgaaaggggatgtgctgcaag<br>gcgattaagttgggtaacgccagggttttcccagtcacgacgttgtaaaacga<br>cggccagtgagcgcgcgtaatacgactcactatagggcgaattgggtaccggg<br>ccccccctcgatcgaggtcgacggtatcggggagctcgcagggtctccattt<br>tgaagcgggaggtttgaacgcgcag |
| 219 | AAV12VP1u-<br>AAV6VP2/3 | ccgccatgccggggttttacgagattgtgattaaggtccccagcgaccttgac<br>gagcatctgccggcatttctgacagctttgtgaactgggtggccgagaagga<br>atgggagttgccgccagattctgacatggatctgaatctgattgagcaggcac<br>ccctgaccgtggccgagaagctgcagcgcgacttctgacggaatggcgccgt<br>gtgagtaaggccccggaggcccttttctttgtgcaatttgagaagggagagag<br>ctactccacatgcacgtgctcgtggaaaccaccggggtgaaatccatggttt<br>tgggacgtttcctgagtcagattcgcgaaaaactgattcagagaatttaccgc |

TABLE 13 -continued

Chimeric AAV Vectors

| SEQ ID NO | Construct | Sequence |
|---|---|---|
| | | gggatcgagccgactttgccaaactggttcgcggtcacaaagaccagaaatgg cgccggaggcgggaacaaggtggtggatgagtgctacatccccaattacttgc tccccaaaacccagcctgagctccagtgggcgtggactaatatggaacagtat ttaagcgcctgtttgaatctcacggagcgtaaacggttggtggcgcagcatct gacgcacgtgtcgcagacgcaggagcagaacaaagagaatcagaatcccaatt ctgatgcgccggtgatcagatcaaaaacttcagccaggtacatggagctggtc gggtggctcgtggacaaggggattacctcggagaagcagtggatccaggagga ccaggcctcatacatctccttcaatgcggcctccaactcgcggtcccaaatca aggctgccttggacaatgcgggaaagattatgagcctgactaaaaccgccccc gactacctggtgggccagcagcccgtggaggacatttccagcaatcggatttaa taaaattttggaactaaacgggtacgatcccaatatgcggcttccgtctttc tgggatgggccacgaaaaagttcggcaagaggaacaccatctggctgtttggg cctgcaactaccgggaagaccaacatcgcggaggccatagcccacactgtgcc cttctacgggtgcgtaaactggaccaatgagaactttcccttcaacgactgtg tcgacaagatggtgatctggtgggaggaggggaagatgaccgccaaggtcgtg gagtcggccaaagccattctcggaggaagcaaggtgcgcgtggaccagaaatg caagtcctcggcccagatagaccccgactcccgtgatcgtcacctccaacacca acatgtgcgccgtgattgacgggaactcaacgaccttcgaacaccagcagccg ttgcaagaccggatgttcaaatttgaactcacccgccgtctggatcatgactt tgggaaggtcaccaagcaggaagtcaaagacttttttccggtgggcaaaggatc acgtggttgaggtggagcatgaattctacgtcaaaaagggtggagccaagaaa agacccgccccccagtgacgcagatataagtgagcccaaacgggtgcgcgagtc agttgcgcagccatcgacgtcagacgcggaagcttcgatcaactacgcagaca ggtaccaaaacaaatgttctcgtcacgtgggcatgaatctgatgctgtttccc tgcagacaatgcgagagaatgaatcagaattcaaatatctgcttcactcacgg acagaaagactgtttagagtgctttcccgtgtcagaatctcaacccgtttctg tcgtcaaaaaggcgtatcagaaactgtgctacattcatcatatcatgggaaag gtgccagacgcttgcactgcctgcgatctggtcaatgtggatttggatgactg catctttgaacaataaatgatttaaatcaggtatggctgctgacggttatctt ccagattggctcgaggacaacctctctgaaggcattcgcgagtggtgggcgct gaaacctggagctccacaacccaaggccaaccaacagcatcaggacaacggca ggggtcttgtgcttcctgggtacaagtacctcggaccccttcaacggactcgac aagggagagccggtcaacgaggcagacgccgcggccctcgagcacgacaaggc ctacgacaagcagctcgagcaggggacaacccgtatctcaagtacaaccacg ccgacgccgagttccagcagcgcttggcgaccgacacctcttttgggggcaac ctcgggcgagcagtcttccaggccaaaaagaggattctcgagcctctgggtct ggttgaagagggcgttaaaacggctcctggaaagaaacgtccggtagagcagt cgccacaagagccagactcctcctcgggcattggcaagacaggccagcagccc gctaaaaagagactcaattttggtcagactggcgactcagagtcagtccccga cccacaacctctcggagaacctccagcaaccccgctgctgtgggacctacta caatggcttcaggcggtggcgcaccaatggcagacaataacgaaggcgccgac ggagtgggtaatgcctcaggaaattggcattgcgattccacatggctgggcga cagagtcatcaccaccagcacccgaacatgggcctttgcccacctataacaacc acctctacaagcaaatctccagtgcttcaacgggggccagcaacgacaaccac tacttcggctacagcaccccctgggggtattttgatttcaacagattccactg ccatttctcaccacgtgactggcagcgactcatcaacaacaattggggattcc ggcccaagagactcaacttcaagctcttcaacatccaagtcaaggaggtcacg acgaatgatggcgtcacgaccatcgctaataaccttaccagcacggttcaagt cttctcggactcggagtaccagttgccgtacgtcctcggctctgcgcaccagg gctgcctccctccgttcccggcggacgtgttcatgattccgcagtacggctac ctaacgctcaacaatggcagccaggcagtgggacggtcatcctttactgcct ggaatatttcccatcgcagatgctgagaacgggcaataacttaccttcagct acaccttcgaggacgtgcctttccacagcagctacgcgcacagccagagcctg gaccggctgatgaatcctctcatcgaccagtacctgtattacctgaacagaac tcagaatcagtccggaagtgcccaaaacaaggacttgctgtttagccgggggt ctccagctggcatgtctgttcagcccaaaaactggctacctggaccctgttac cggcagcagcgcgtttctaaaacaaaaacagacaacaacaacagcaactttac ctggactggtgcttcaaaatataaccttaatgggcgtgaatctataatcaacc ctggcactgctatggcctcacacaaagacgacaaagacaagttctttcccatg agcggtgtcatgattttggaaaggagagcgccggagcttcaaacactgcatt ggacaatgtcatgatcacagacgaagaggaaatcaaagccactaaccccgtgg ccaccgaaagatttgggactgtggcagtcaatctccagagcagcagcacagac cctgcgaccggagatgtgcatgttatgggagccttacctggaatggtgtggca agacagagacgtataacctgcagggtcctatttgggccaaaattcctcacacgg atggacactttcacccgtctcctctcatgggcggctttggacttaagcacccg cctcctcagatcctcatcaaaaacacgcctgttcctgcgaatcctccggcaga gttttcggctacaaagtttgcttcattcatcccagtattccacaggacaag tgagcgtggagattgaatgggagctgcagaaagaaaacagcaaacgctggaat cccgaagtgcagtatacatctaactatgcaaaatctgccaacgttgatttcac tgtggacaacaatggacttttatactgagcctcgccccattggcacccgttacc tcacccgtccctgtaattgtgtgttaatcaataaaccggttgattcgtttca gttgaactttggtctctgcgaagggcgaattcgtttaaacctgcaggactaga ggtcctgtattagaggtcacgtgagtgttttgcgacattttgcgacaccatgt ggtcacgctgggtatttaagcccgagtgagcacgcagggtctccattttgaag cgggaggtttgaacgcgcagccgccaagccgaattctgcagatatccatcaca |

TABLE 13 -continued

Chimeric AAV Vectors

| SEQ ID NO | Construct | Sequence |
|---|---|---|
| | | ctggcggccgctcgactagagcggccgccaccgcggtggagctccagcttttg
ttcccttagtgagggttaattgcgcgcttggcgtaatcatggtcatagctgt
ttcctgtgtgaaattgttatccgctcacaattccacacaacatacgagccgga
agcataaagtgtaaagcctggggtgcctaatgagtgagctaactcacattaat
tgcgttgcgctcactgcccgctttccagtcgggaaacctgtcgtgccagctgc
attaatgaatcggccaacgcgcggggagaggcggtttgcgtattgggcgctct
tccgcttcctcgctcactgactcgctgcgctcggtcgttcggctgcggcgagc
ggtatcagctcactcaaaggcggtaatacggttatccacagaatcaggggata
acgcaggaaagaacatgtgagcaaaaggccagcaaaaggccaggaaccgtaaa
aaggccgcgttgctggcgtttttccataggctccgcccccctgacgagcatca
caaaaatcgacgctcaagtcagaggtggcgaaacccgacaggactataaagat
accaggcgtttccccctggaagctccctcgtgcgctctcctgttccgaccctg
ccgcttaccggatacctgtccgcctttctcccttcgggaagcgtggcgctttc
tcatagctcacgctgtaggtatctcagttcggtgtaggtcgttcgctccaagc
tgggctgtgtgcacgaaccccccgttcagcccgaccgctgcgccttatccggt
aactatcgtcttgagtccaacccggtaagacacgacttatcgccactggcagc
agccactggtaacaggattagcagagcgaggtatgtaggcggtgctacagagt
tcttgaagtggtggcctaactacggctacactagaagaacagtatttggtatc
tgcgctctgctgaagccagttaccttcggaaaaagagttggtagctcttgatc
cggcaaacaaaccaccgctggtagcggtggtttttttgtttgcaagcagcaga
ttacgcgcagaaaaaaaggatctcaagaagatcctttgatcttttctacgggg
tctgacgctcagtggaacgaaaactcacgttaagggattttggtcatgagatt
atcaaaaaggatcttcacctagatccttttaaattaaaaatgaagttttaaat
caatctaaagtatatatgagtaaacttggtctgacagttaccaatgcttaatc
agtgaggcacctatctcagcgatctgtctatttcgttcatccatagttgcctg
actccccgtcgtgtagataactacgatacgggagggcttaccatctggcccca
gtgctgcaatgataccgcgagacccacgctcaccggctccagatttatcagca
ataaaccagccagccggaagggccgagcgcagaagtggtcctgcaactttatc
cgcctccatccagtctattaattgttgccgggaagctagagtaagtagttcgc
cagttaatagtttgcgcaacgttgttgccattgctacaggcatcgtggtgtca
cgctcgtcgtttggtatggcttcattcagctccggttcccaacgatcaaggcg
agttacatgatcccccatgttgtgcaaaaaagcggttagctccttcggtcctc
cgatcgttgtcagaagtaagttggccgcagtgttatcactcatggttatggca
gcactgcataattctcttactgtcatgccatccgtaagatgcttttctgtgac
tggtgagtactcaaccaagtcattctgagaatagtgtatgcggcgaccgagtt
gctcttgcccggcgtcaatacgggataataccgcgccacatagcagaacttta
aaagtgctcatcattggaaaacgttcttcggggcgaaaactctcaaggatctt
accgctgttgagatccagttcgatgtaacccactcgtgcacccaactgatctt
cagcatcttttactttcaccagcgtttctgggtgagcaaaaacaggaaggcaa
aatgccgcaaaaaagggaataagggcgacacggaaatgttgaatactcatact
cttcctttttcaatattattgaagcatttatcagggttattgtctcatgagcg
gatacatatttgaatgtatttagaaaaataaacaatagggggttccgcgcaca
tttccccgaaaagtgccacctaaattgtaagcgttaatattttgttaaaattc
gcgttaaattttgttaaatcagctcatttttaaccaataggccgaaatcgg
caaaatcccttataaatcaaaagaatagaccgagatagggttgagtgttgttc
cagtttggaacaagagtccactattaaagaacgtggactccaacgtcaaaggg
cgaaaaaccgtctatcagggcgatggcccactacgtgaaccatcaccctaatc
aagttttttggggtcgaggtgccgtaaagcactaaatcggaaccctaaaggga
gcccccgatttagagcttgacggggaaagccggcgaacgtggcgagaaaggaa
gggaagaaagcgaaaggagcgggcgctagggcgctggcaagtgtagcggtcac
gctgcgcgtaaccaccacacccgccgcgcttaatgcgccgctacagggcgcgt
cccattcgccattcaggctgcgcaactgttgggaagggcgatcggtgcgggcc
tcttcgctattacgccagctggcgaaagggggatgtgctgcaaggcgattaag
ttgggtaacgccagggttttcccagtcacgacgttgtaaaacgacggccagtg
agcgcgcgtaatacgactcactatagggcgaattgggtaccgggccccccctc
gatcgaggtcgacggtatcggggagctcgcagggtctccattttgaagcggg
aggtttgaacgcgcag |
| 220 | 7_AAV4VP1u-AAV6VP2/3 | ccgccatgccgggtttacgagattgtgattaaggtccccagcgaccttgac
gagcatctgccggcatttctgacagctttgtgaactgggtggccgagaagga
atgggagttgccgccagattctgacatggatctgaatctgattgagcaggcac
ccctgaccgtggccgagaagctgcagcgcgactttctgacggaatggcgcgt
gtgagtaaggccccggaggcccttttctttgtgcaatttgagaagggagagag
ctacttccacatgcacgtgctcgtggaaaccaccggggtgaaatccatggttt
tgggacgtttcctgagtcagattcgcgaaaaactgattcagagaatttaccgc
gggatcgagccgactttgccaaactggttcgcggtcacaaagaccagaaatgg
cgccggaggcgggaacaaggtggtggatgagtgctacatccccaattacttgc
tccccaaaacccagcctgagctccagtgggcgtgactaatatgaacagtat
ttaagcgcctgtttgaatctcacggagcgtaaacggttggtggcgcagcatct
gacgcacgtgtcgcagacgcaggagcagaacaaagagaatcagaatcccaatt
ctgatgcgccggtgatcagatcaaaaacttcagccaggtacatggagctggtc
gggtggctcgtggacaaggggattacctcggagaagcagtggatccaggagga
ccaggcctcatacatctccttcaatgcggcctccaactcgcggtcccaaatca
aggctgccttggacaatgcgggaaagattatgagcctgactaaaaccgccccc
gactacctggtgggccagcagcccgtggaggacatttccagcaatcggattta |

TABLE 13 -continued

Chimeric AAV Vectors

| SEQ ID NO | Construct | Sequence |
|---|---|---|
| | | taaaattttggaactaaacgggtacgatccccaatatgcggcttccgtctttc<br>tgggatgggccacgaaaaagttcggcaagaggaacaccatctggctgtttggg<br>cctgcaactaccgggaagaccaacatcgcggaggccatagcccacactgtgcc<br>cttctacgggtgcgtaaactggacccaatgagaacttcccttcaacgactgtg<br>tcgacaagatggtgatctggtgggaggaggggaagatgaccgccaaggtcgtg<br>gagtcggccaaagccattctcggaggaagcaaggtgcgcgtggaccagaaatg<br>caagtcctcggcccagatagacccgactcccgtgatcgtcacctccaacacca<br>acatgtgcgccgtgattgacgggaactcaacgaccttcgaacaccagcagccg<br>ttgcaagaccggatgttcaaatttgaactcacccgccgtctggatcatgactt<br>tgggaaggtcaccaagcaggaagtcaaagacttttccggtgggcaaaggatc<br>acgtggttgaggtggagcatgaattctacgtcaaaaagggtggagccaagaaa<br>agacccgccccagtgacgcagatataagtgagcccaaacgggtgcgcgagtc<br>agttgcgcagccatcgacgtcagacgcggaagcttcgatcaactacgcagaca<br>ggtaccaaaacaaatgttctcgtcacgtgggcatgaatctgatgctgtttccc<br>tgcagacaatgcgagagaatgaatcagaattcaaatatctgcttcactcacgg<br>acagaaagactgtttagagtgctttcccgtgtcagaatctcaacccgtttctg<br>tcgtcaaaaaggcgtatcagaaactgtgctacattcatcatatcatgggaaag<br>gtgccagacgcttgcactgcctgcgatctggtcaatgtggatttggatgactg<br>catctttgaacaataaatgatttaaatcaggtatgactgacggttaccttcca<br>gattggctagaggacaacctctctgaaggcgttcgagagtggtgggcgctgca<br>acctggagcccctaaacccaaggcaaatcaacaacatcaggacaacgctcggg<br>gtcttgtgcttccgggttacaaatacctcggacccggcaacggactcgacaag<br>ggggaacccgtcaacgcagcggacgcggcagccctcgagcacgacaaggccta<br>cgaccagcagctcaaggccggtgacaaccctacctcaagtacaaccacgccg<br>acgcggagttccagcagcggcttcagggcgacacatcgtttgggggcaacctc<br>ggcagagcagtcttccaggccaaaaagagggttcttgaacctcttggtctggt<br>tgagcaagcgggtgagacggctcctggaaagaaacgtccggtagagcagtcgc<br>cacaagagccagactcctcctcgggcattggcaagacaggccagcagcccgct<br>aaaaagagactcaattttggtcagactggcgactcagagtcagtccccgaccc<br>acaacctctcggagaacctccagcaacccccgctgctgtgggacctactacaa<br>tggcttcaggcggtggcgcaccaatggcagacaataacgaaggcgccgacgga<br>gtgggtaatgcctcaggaaattggcattgcgattccacatggctgggcgacag<br>agtcatcaccaccagcacccgaacatgggccttgcccacctataacaaccacc<br>tctacaagcaaatctccagtgcttcaacggggggccagcaacgacaaccactac<br>ttcggctacagcacccctgggggtattttgatttcaacagattccactgcca<br>tttctcaccacgtgactggcagcgactcatcaacaacaattgggggattccggc<br>ccaagagactcaactttcaagctcttcaacatccaagtcaaggaggtcacgacg<br>aatgatggcgtcacgaccatcgctaataaccttaccagcacggttcaagtctt<br>ctcggactcggagtaccagttgccgtacgtcctcggctctgcgcaccagggct<br>gcctccctccgttcccggcggacgtgttcatgattccgcagtacggctaccta<br>acgctcaacaatggcagccaggcagtgggacggtcatccttttactgcctgga<br>atatttcccatcgcagatgctgagaacgggcaataactttaccttcagctaca<br>ccttcgaggacgtgcctttccacagcagctacgcgcacagccagagcctggac<br>cggctgatgaatcctctcatcgaccagtacctgtattacctgaacagaactca<br>gaatcagtccggaagtgcccaaaacaaggacttgctgtttagccggggggtctc<br>cagctggcatgtctgttcagcccaaaaactggctacctggaccctgttaccgg<br>cagcagcgcgtttctaaaacaaaaacagacaacaacaacagcaactttacctg<br>gactggtgcttcaaaatataaccttaatgggcgtgaatctataatcaaccctg<br>gcactgctatggcctcacacaaagacgacaaagacaagttctttcccatgagc<br>ggtgtcatgattttttggaaaggagagcgccggagcttcaaacactgcattgga<br>caatgtcatgatcacagacgaagaggaaatcaaagccactaaccccgtggcca<br>ccgaaagatttgggactgtggcagtcaatctccagagcagcagcacagaccct<br>gcgaccggagatgtgcatgttatgggagccttacctggaatggtgtggcaaga<br>cagagacgtatacctgcagggtcctatttgggccaaaattcctcacacggatg<br>gacactttcacccgtctcctctcatgggcggctttggacttaagcacccgcct<br>cctcagatcctcatcaaaaacacgcctgttcctgcgaatcctccggcagagtt<br>ttcggctacaaagtttgcttcattcatcacccagtattccacaggacaagtga<br>gcgtggagattgaatgggagctgcagaaagaaaacagcaaacgctggaatccc<br>gaagtgcagtatacatctaactatgcaaaatctgccaacgttgatttcactgt<br>ggacaacaatggactttatactgagcctcgccccattggcaccgttacctca<br>cccgtcccctgtaattgtgtgttaatcaataaaccggttgattcgtttcagtt<br>gaactttggtctctgcgaagggcgaattcgtttaaacctgcaggactagaggt<br>cctgtattagaggtcacgtgagtgttttgcgacattttgcgacaccatgtggt<br>cacgctgggtatttaagcccgagtgagcacgcagggtctccattttgaagcgg<br>gaggtttgaacgcgcagccgccaagccgaattctgcagatatccatcacactg<br>gcggccgctcgactagagcggccgccaccgcggtggagctccagcttttgttc<br>cctttagtgagggttaattgcgcgcttggcgtaatcatggtcatagctgtttc<br>ctgtgtgaaattgttatccgctcacaattccacacaacatacgagccggaagc<br>ataaagtgtaaagcctggggtgcctaatgagtgagctaactcacattaattgc<br>gttgcgctcactgcccgctttccagtcgggaaacctgtcgtgccagctgcatt<br>aatgaatcggccaacgcgcggggagaggcggtttgcgtattgggcgctcttcc<br>gcttcctcgctcactgactcgctgcgctcggtcgttcggctgcggcgagcggt<br>atcagctcactcaaaggcggtaatacggttatccacagaatcaggggataacg<br>caggaaagaacatgtgagcaaaaggccagcaaaaggccaggaaccgtaaaaag<br>gccgcgttgctggcgtttttccataggctccgcccccctgacgagcatcacaa |

TABLE 13 -continued

Chimeric AAV Vectors

| SEQ ID NO | Construct | Sequence |
|---|---|---|
| | | aaatcgacgctcaagtcagaggtggcgaaacccgacaggactataaagatacc<br>aggcgtttccccctggaagctccctcgtgcgctctcctgttccgaccctgccg<br>cttaccggatacctgtccgcctttctcccttcgggaagcgtggcgctttctca<br>tagctcacgctgtaggtatctcagttcggtgtaggtcgttcgctccaagctgg<br>gctgtgtgcacgaaccccccgttcagcccgaccgctgcgccttatccggtaac<br>tatcgtcttgagtccaacccggtaagacacgacttatcgccactggcagcagc<br>cactggtaacaggattagcagagcgaggtatgtaggcggtgctacagagttct<br>tgaagtggtggcctaactacggctacactagaagaacagtatttggtatctgc<br>gctctgctgaagccagttaccttcggaaaaagagttggtagctcttgatccgg<br>caaacaaaccaccgctggtagcggtggttttttttgtttgcaagcagcagatta<br>cgcgcagaaaaaaggatctcaagaagatcctttgatcttttctacggggtct<br>gacgctcagtggaacgaaaactcacgttaagggattttggtcatgagattatc<br>aaaaaggatcttcacctagatccttttaaattaaaaatgaagttttaaatcaa<br>tctaaagtatatatgagtaaacttggtctgacagttaccaatgcttaatcagt<br>gaggcacctatctcagcgatctgtctatttcgttcatccatagttgcctgact<br>ccccgtcgtgtagataactacgatacgggagggcttaccatctggccccagtg<br>ctgcaatgataccgcgagacccacgctcaccggctccagatttatcagcaata<br>aaccagccagccggaagggccgagcgcagaagtggtcctgcaactttatccgc<br>ctccatccagtctattaattgttgccgggaagctagagtaagtagttcgccag<br>ttaatagtttgcgcaacgttgttgccattgctacaggcatcgtggtgtcacgc<br>tcgtcgtttggtatggcttcattcagctccggttcccaacgatcaaggcgagt<br>tacatgatcccccatgttgtgcaaaaaagcggttagctccttcggtcctccga<br>tcgttgtcagaagtaagttggccgcagtgttatcactcatggttatggcagca<br>ctgcataattctcttactgtcatgccatccgtaagatgcttttctgtgactgg<br>tgagtactcaaccaagtcattctgagaatagtgtatgcggcgaccgagttgct<br>cttgcccggcgtcaatacgggataataccgcgccacatagcagaactttaaaa<br>gtgctcatcattggaaaacgttcttcggggcgaaaactctcaaggatcttacc<br>gctgttgagatccagttcgatgtaacccactcgtgcacccaactgatcttcag<br>catcttttactttcaccagcgtttctgggtgagcaaaaacaggaaggcaaaat<br>gccgcaaaaaagggaataagggcgacacggaaatgttgaatactcatactctt<br>cctttttcaatattattgaagcatttatcaggggttattgtctcatgagcggat<br>acatatttgaatgtatttagaaaaataaacaaatagggggttccgcgcacattt<br>ccccgaaaagtgccacctaaattgtaagcgttaatattttgttaaaattcgcg<br>ttaaattttttgttaaatcagctcattttttaaccaataggccgaaatcggcaa<br>aatccctataaatcaaaagaatagaccgagatagggttgagtgttgttccag<br>tttggaacaagagtccactattaaagaacgtggactccaacgtcaaagggcga<br>aaaaccgtctatcagggcgatggcccactacgtgaaccatcaccctaatcaag<br>ttttttggggtcgaggtgccgtaaagcactaaatcggaaccctaaagggagcc<br>cccgatttagagcttgacggggaaagccggcgaacgtggcgagaaaggaaggg<br>aagaaagcgaaaggagcgggcgctagggcgctggcaagtgtagcggtcacgct<br>gcgcgtaaccaccacaccccgccgcgcttaatgcgccgctacagggcgcgtccc<br>attcgccattcaggctgcgcaactgttgggaagggcgatcggtgcgggcctct<br>tcgctattacgccagctggcgaaaggggggatgtgctgcaaggcgattaagttg<br>ggtaacgccagggttttcccagtcacgacgttgtaaaacgacggccagtgagc<br>gcgcgtaatacgactcactatagggcgaattgggtaccgggccccccctcgat<br>cgaggtcgacggtatcggggggagctcgcagggtctccattttgaagcgggagg<br>tttgaacgcgcag |

Example 8: Recombinant AAV6 Variant Virus Production and Cellular Transduction

Virus Production

Twenty virus variants were designed to contain single, double, or triple mutations in the capsid sequence of the AAV6 protein (Table 1). HEK293 cells were co-transfected with recombinant AAV6 (plasmid containing the cap sequence specific to any one of the virus variants of Table 12), CMV-GFP, and pHelper plasmids. 72 hrs after transfection, viral particles were harvested and purified with AAVanced concentration reagent. Virus titer was calculated based on a CMV promoter standard curve (Taqman), $y=-1.0541\ln(x)+36.685$; $R^2=0.9755$.

Cellular Transduction: 20 Capsid Variants

Figure 17A:
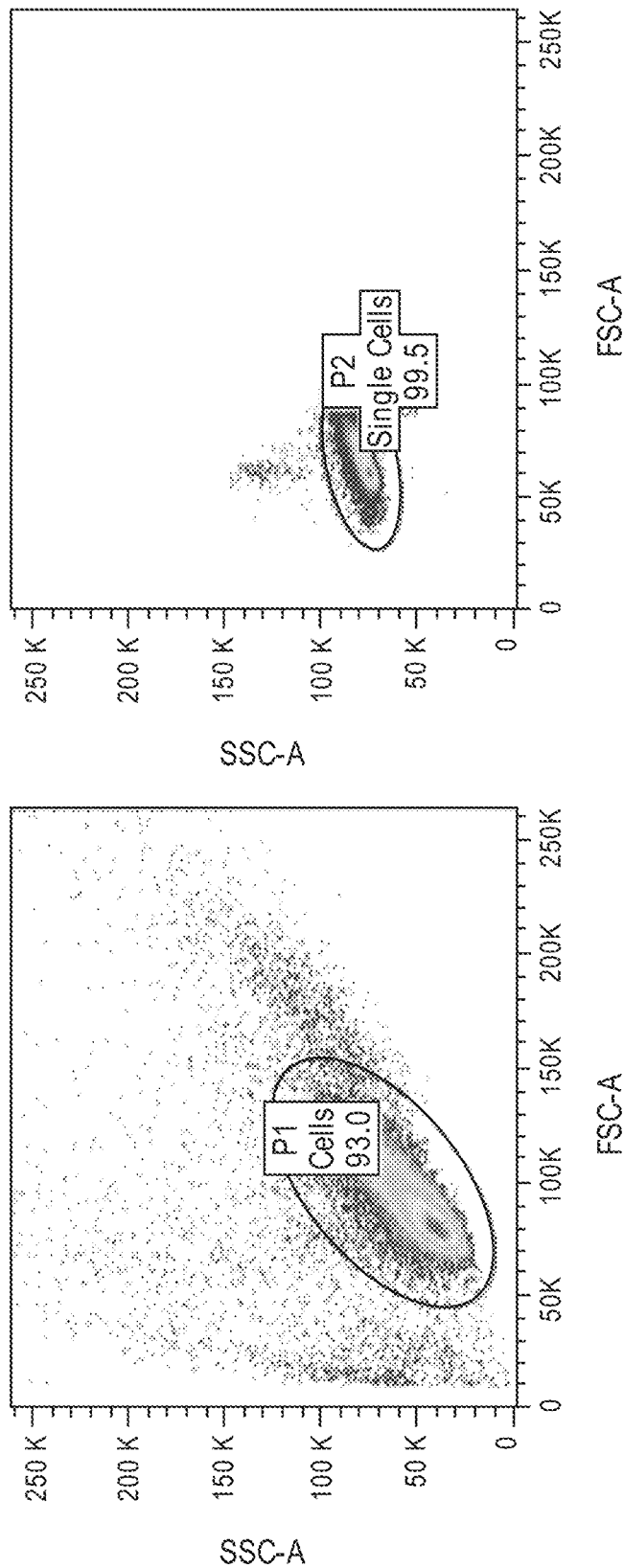
FIG. 17A shows flow cytometry results of untransduced human CD3+ cells (control).
Figure 17A:
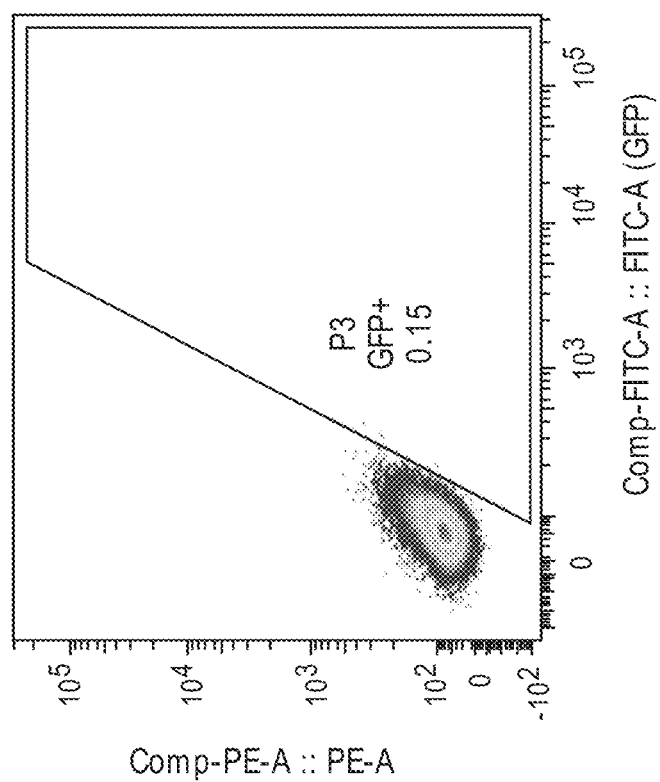
Figure 17B:
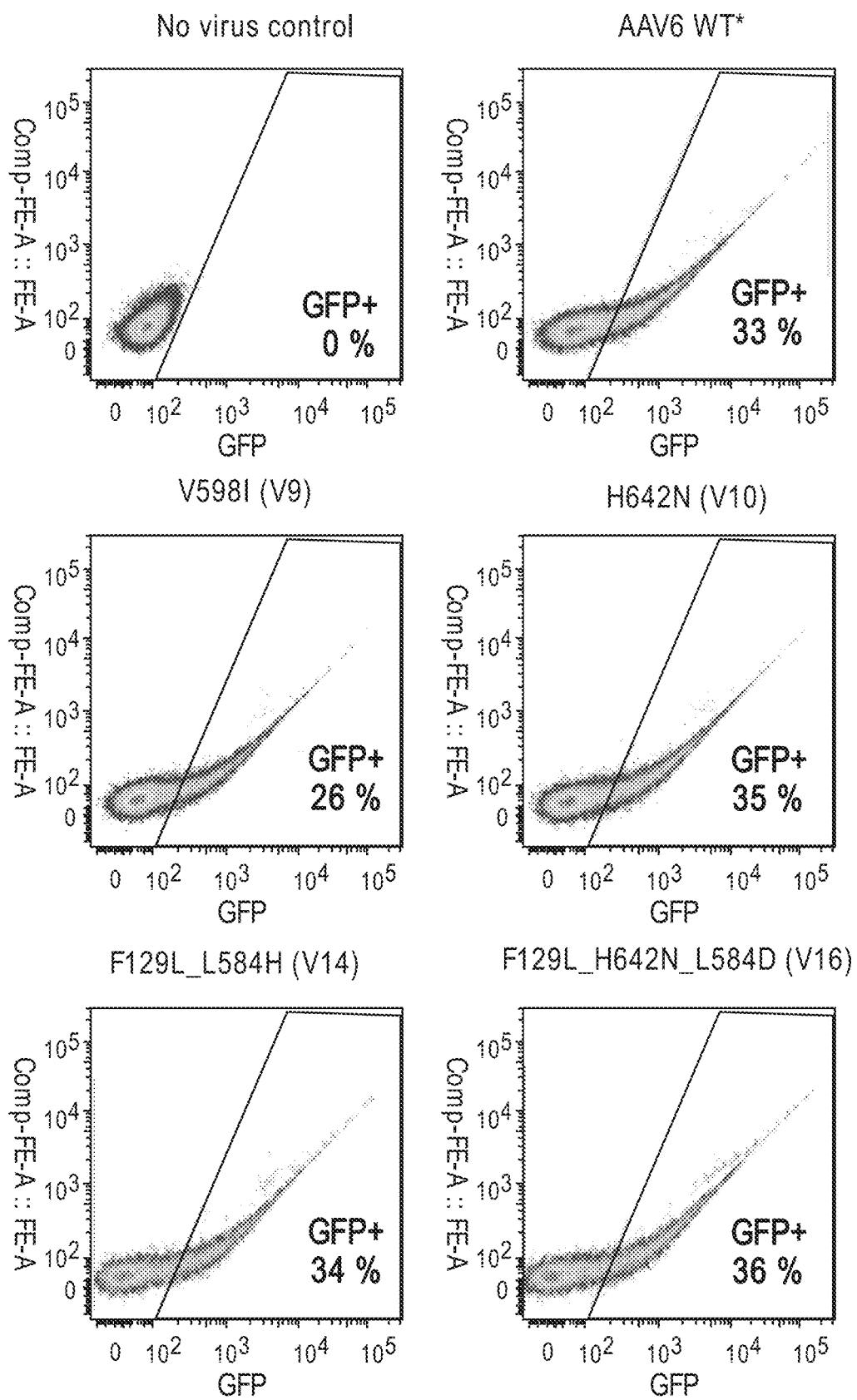
FIG. 17B shows flow cytometry results of transduced human CD3+ cells with variants 1-20 of Table 14.
Figure 17B:
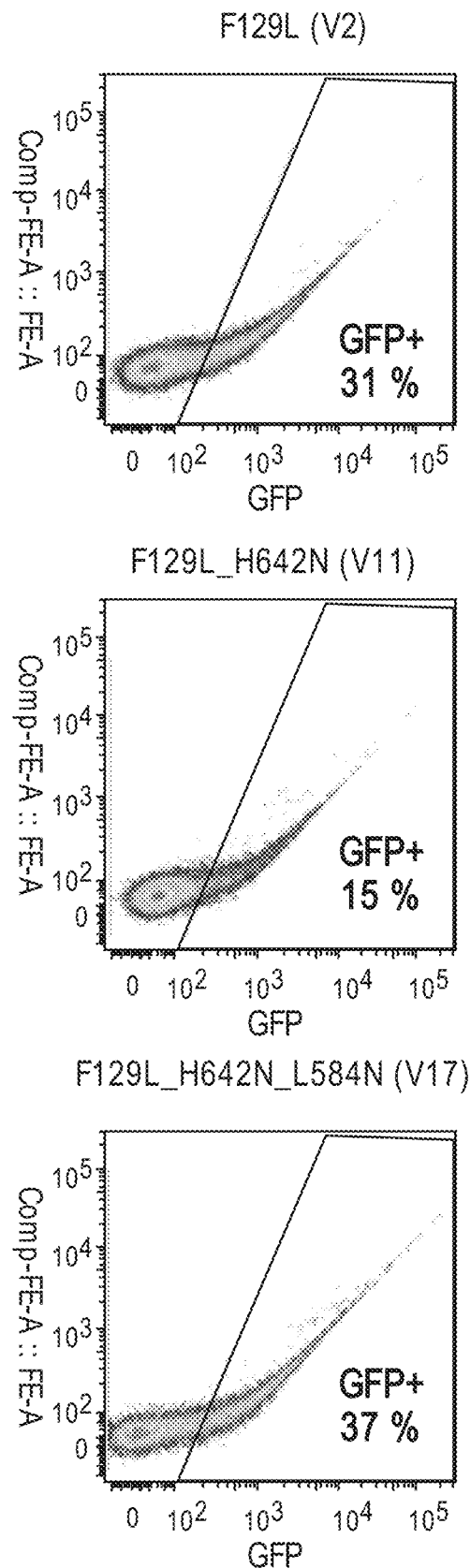
Figure 17B:
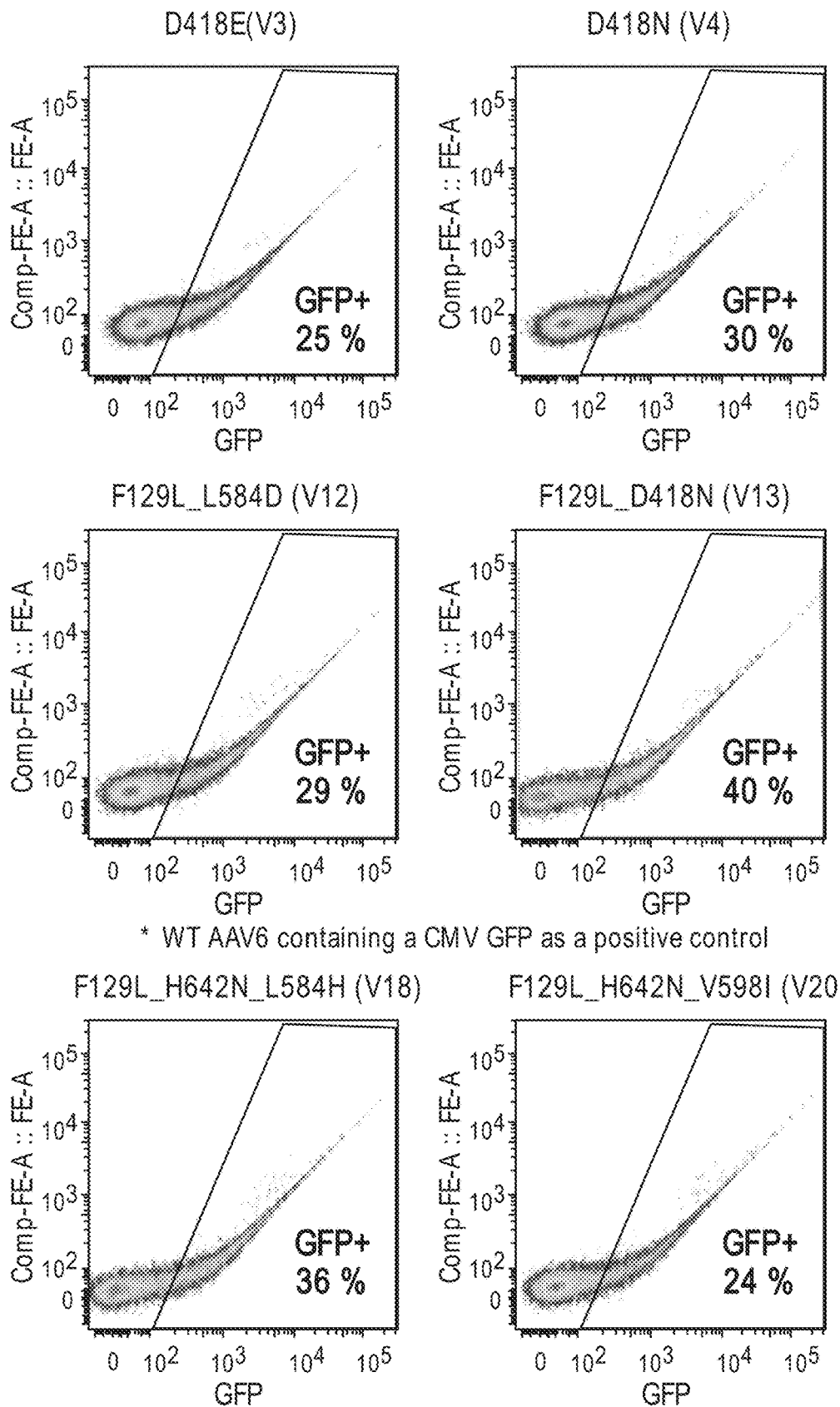
Figure 17C:
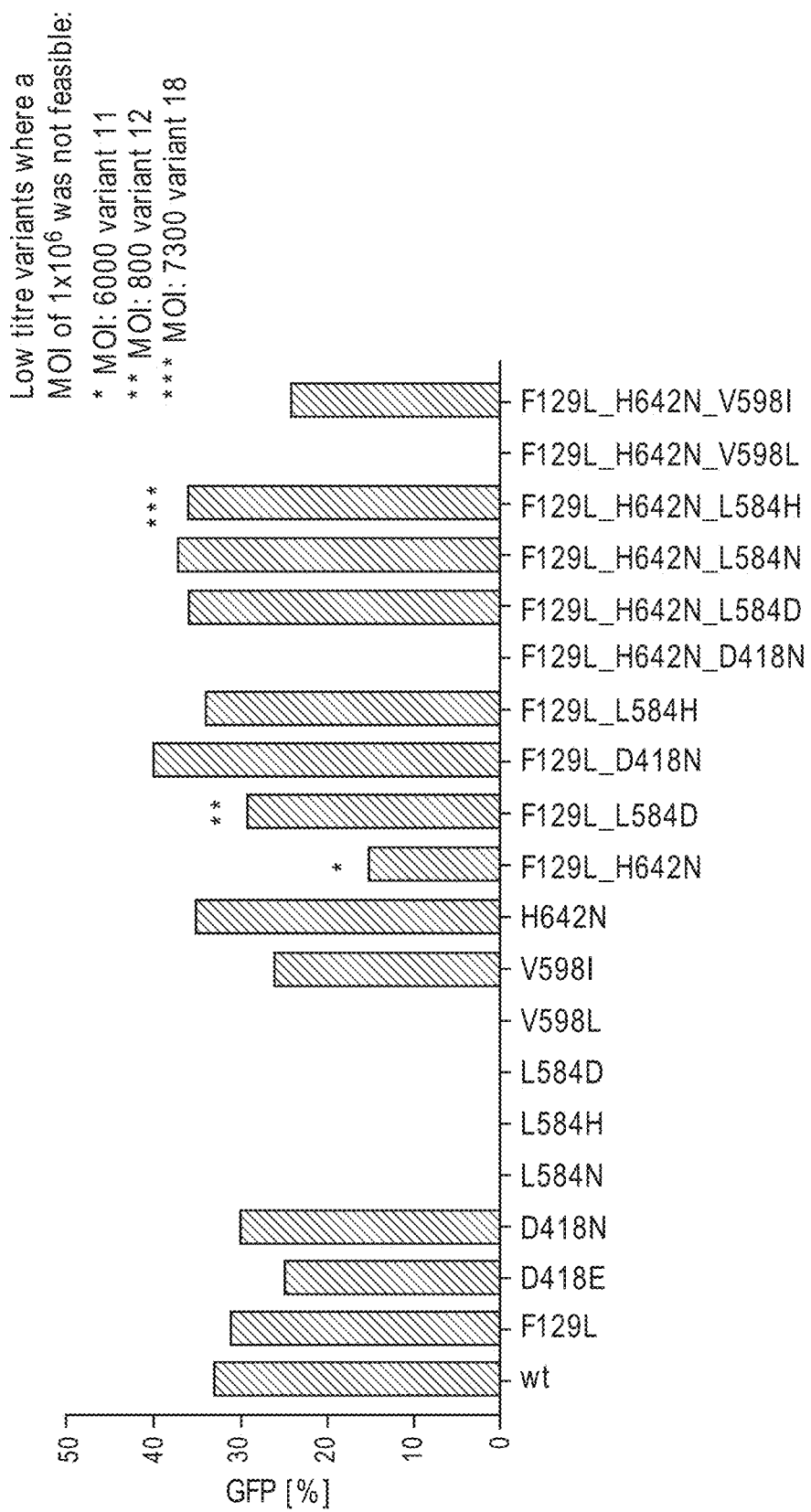
FIG. 17C shows a summary of percent GFP of the CD3+ cells transduced with variants 1-20.
Figure 18A:
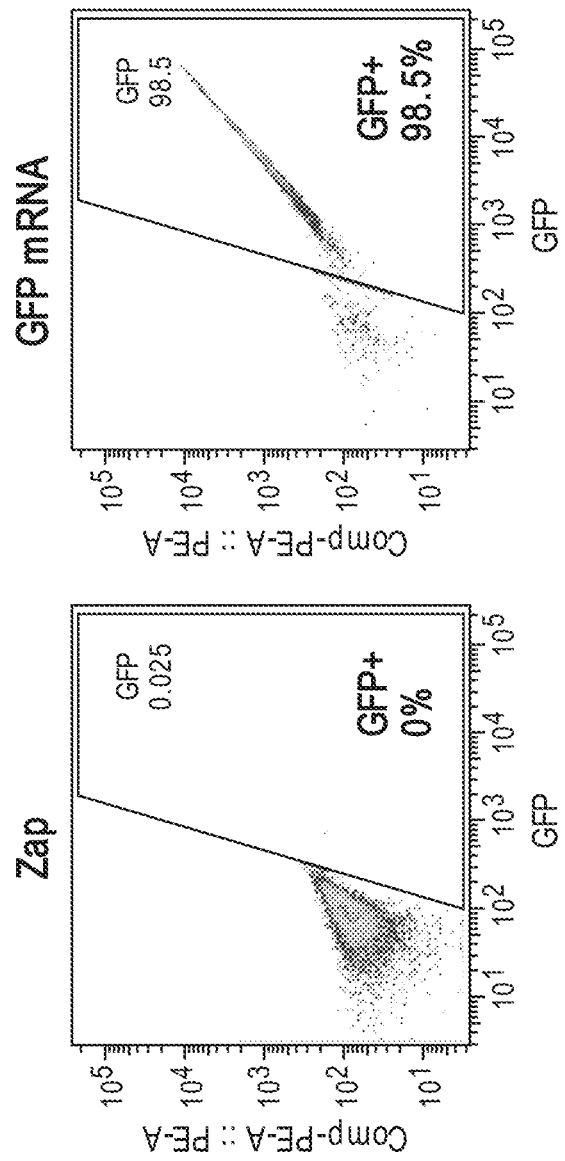
FIG. 18A shows day 3 post CRISPR/AAV flow cytometry results of different controls: untransduced human CD3+ cells that were stimulated and expanded but not electroporated with CRISPR, control AAV6 encoding for a GFP transgene, Zap (electroporation) control, GFP mRNA, AAVS1 gRNA and Cas9.
Figure 18B:
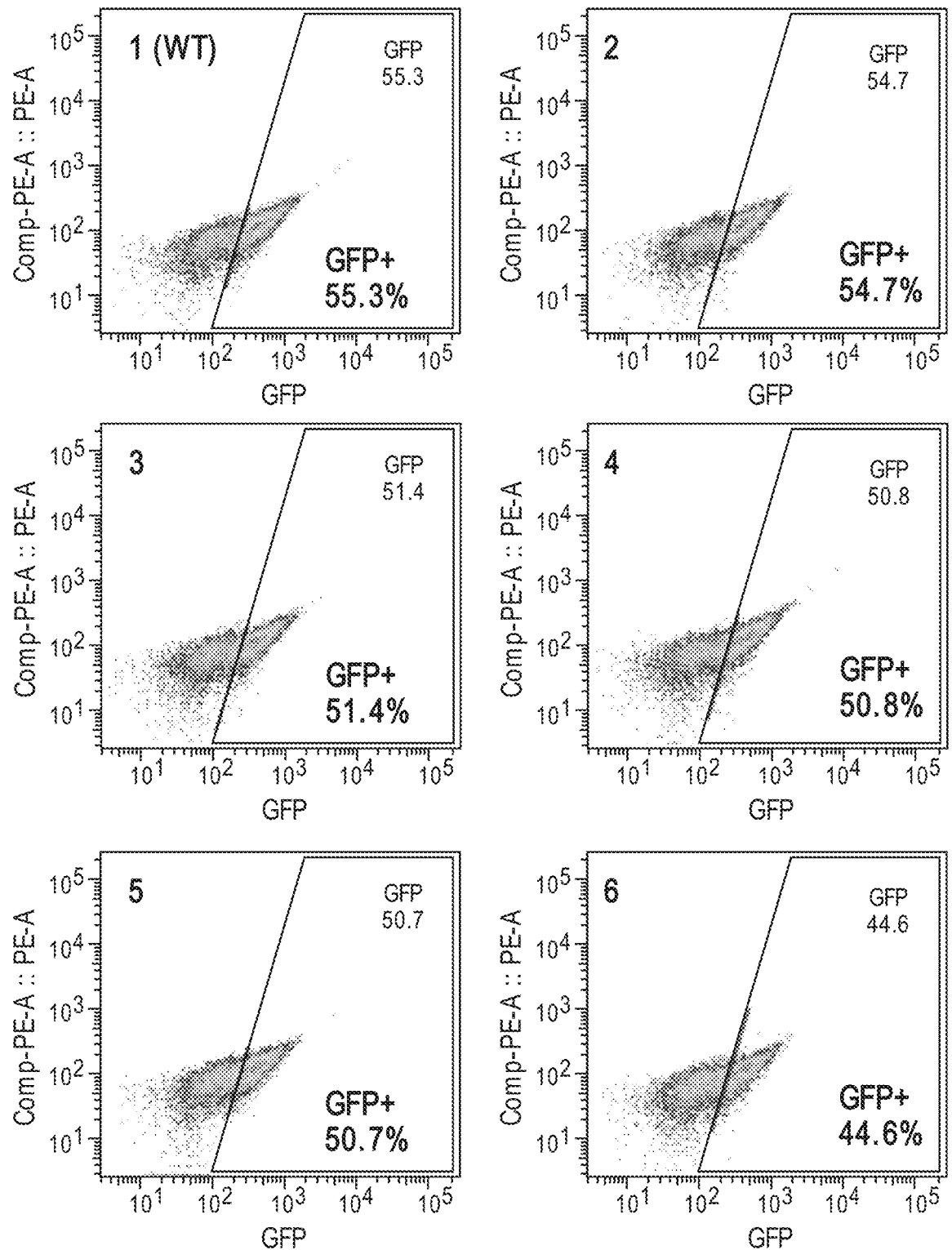
FIG. 18B shows percent GFP by flow cytometry of CRISPR modified and modified AAV (variants 1-20 of Table 14) transduced human cells.
Figure 18B:
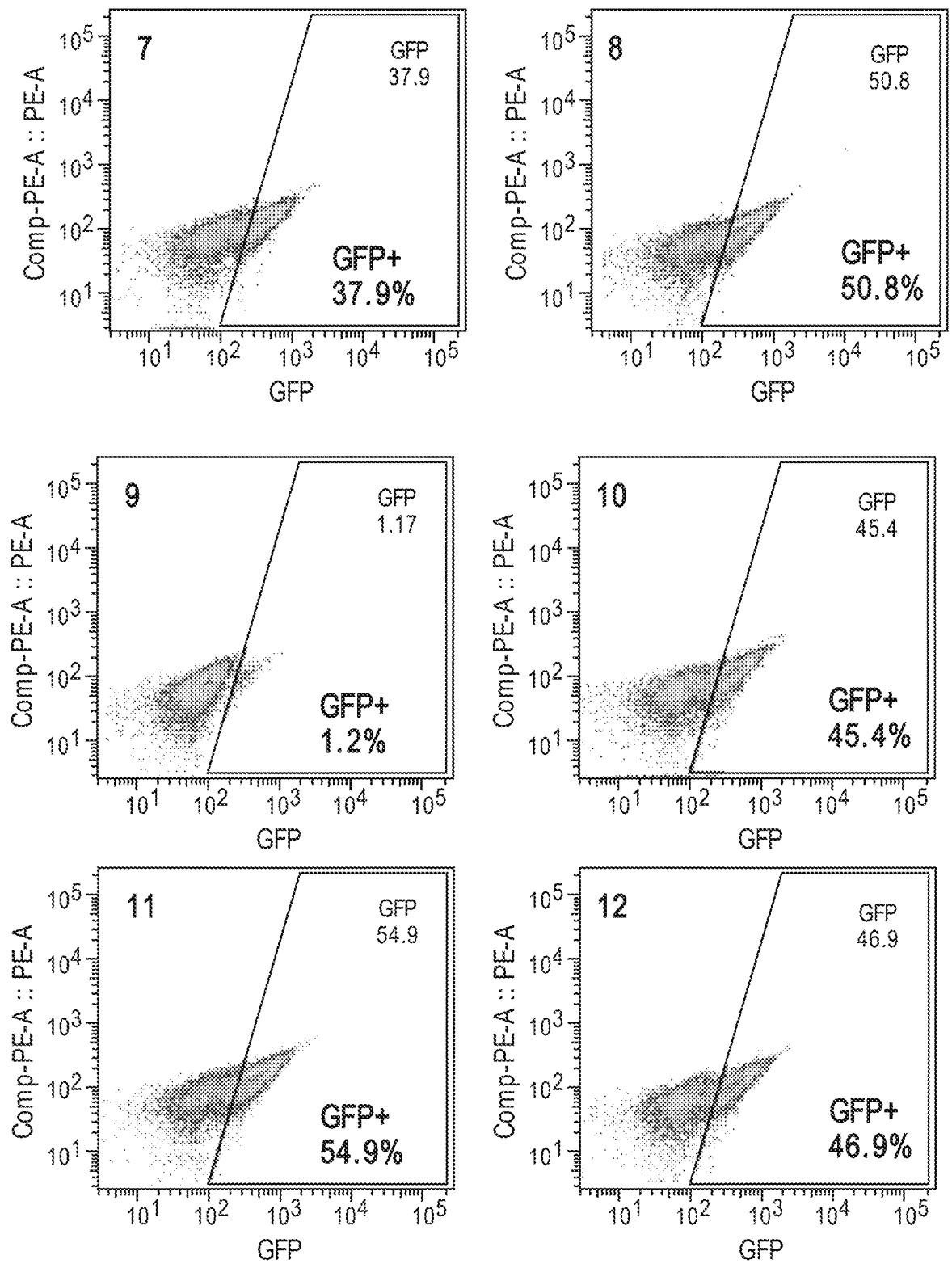
Figure 18B:
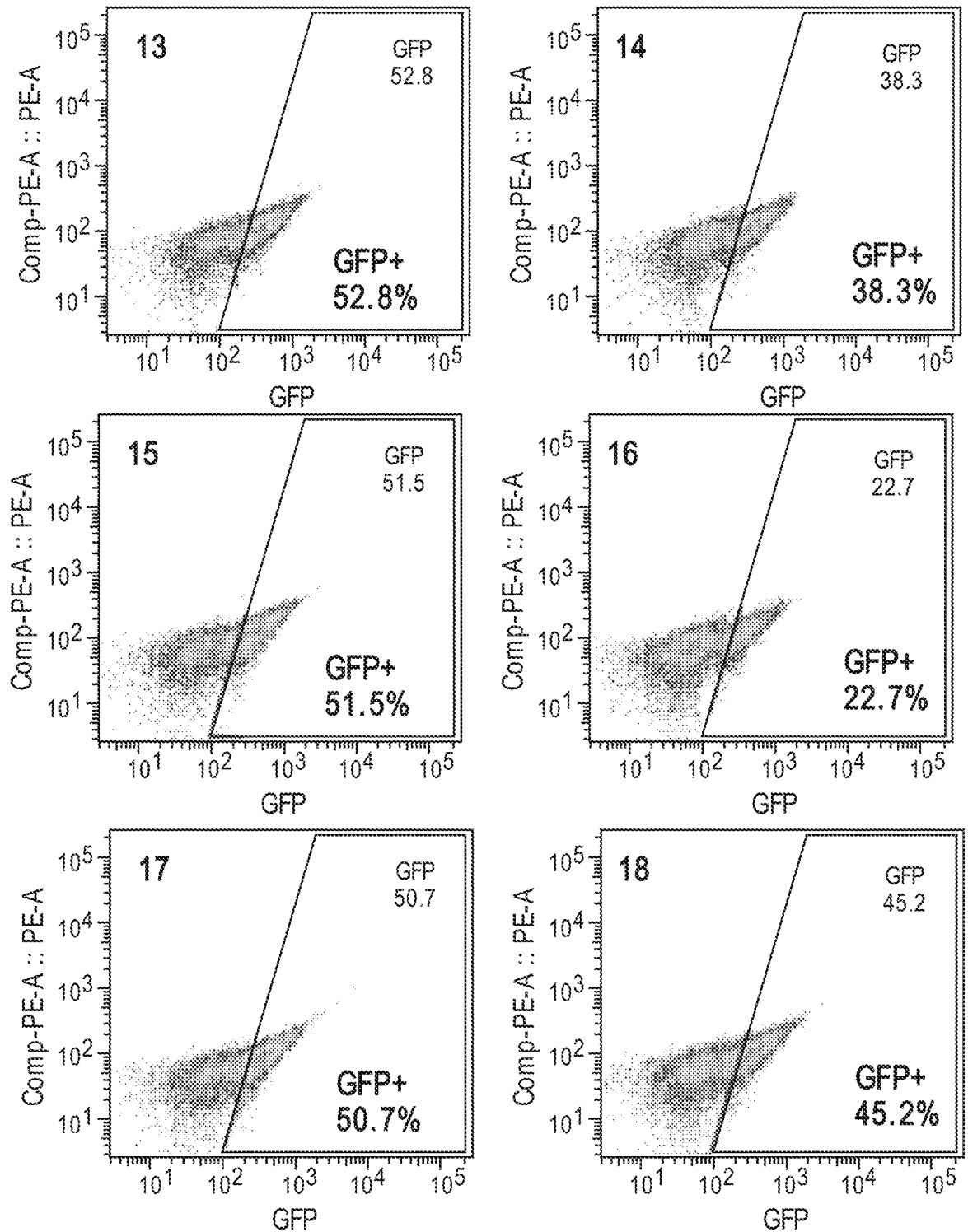
Figure 18B:
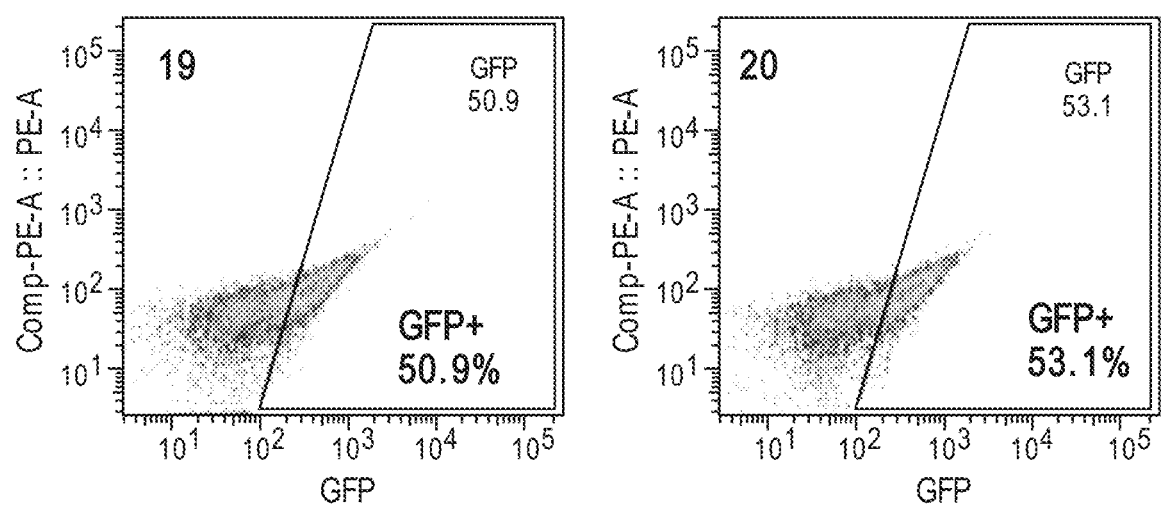
Figure 19A:
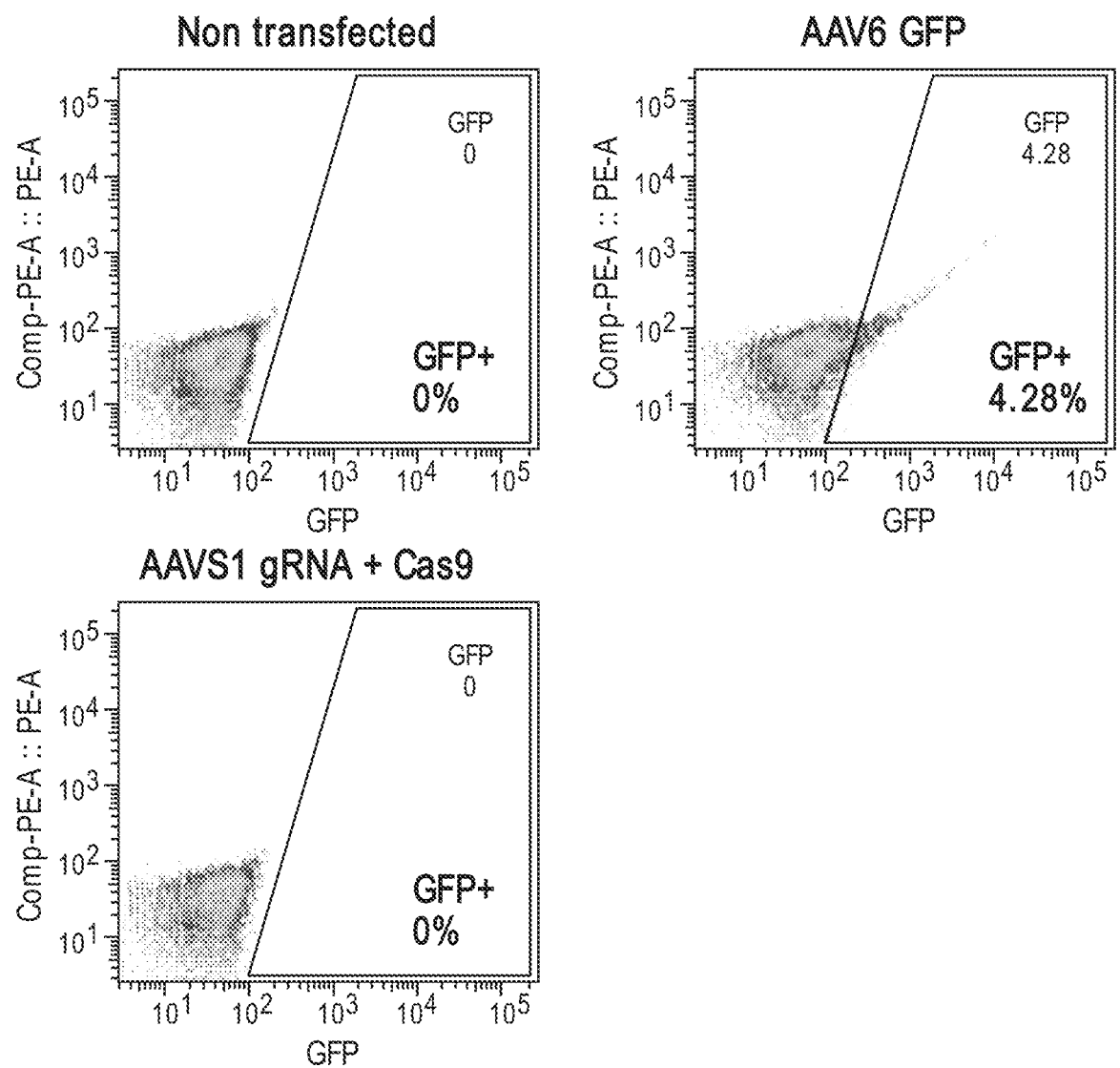
FIG. 19A shows day 7 post CRISPR/AAV flow cytometry results of different controls: untransduced human CD3+ cells that were stimulated and expanded but not electroporated with CRISPR, control AAV6 encoding for a GFP transgene, Zap (electroporation) control, GFP mRNA, AAVS1 gRNA and Cas9.
Figure 19A:
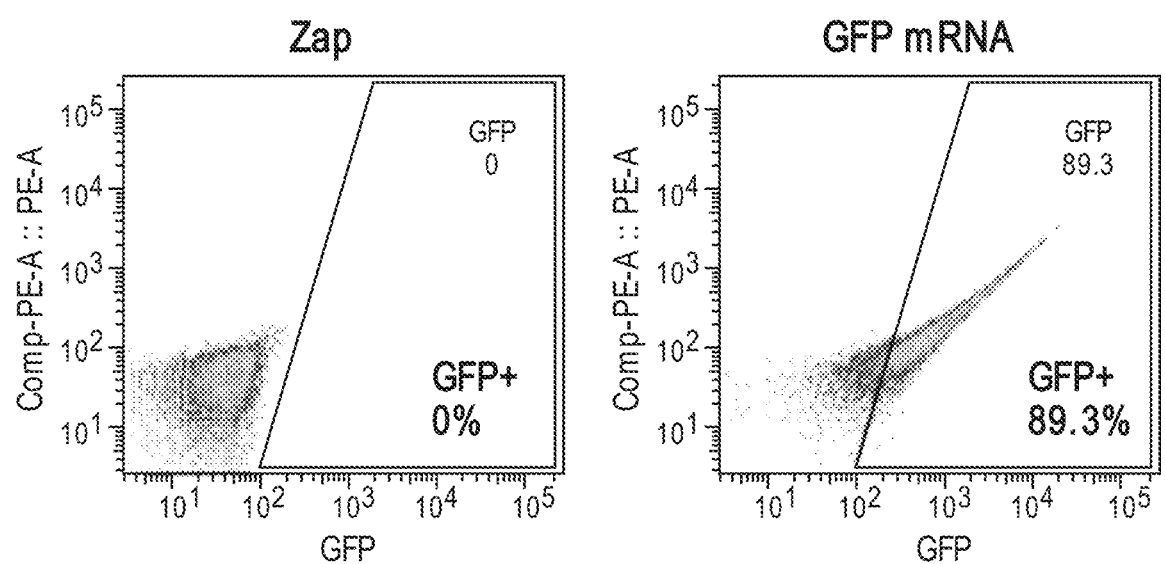
Figure 19B:
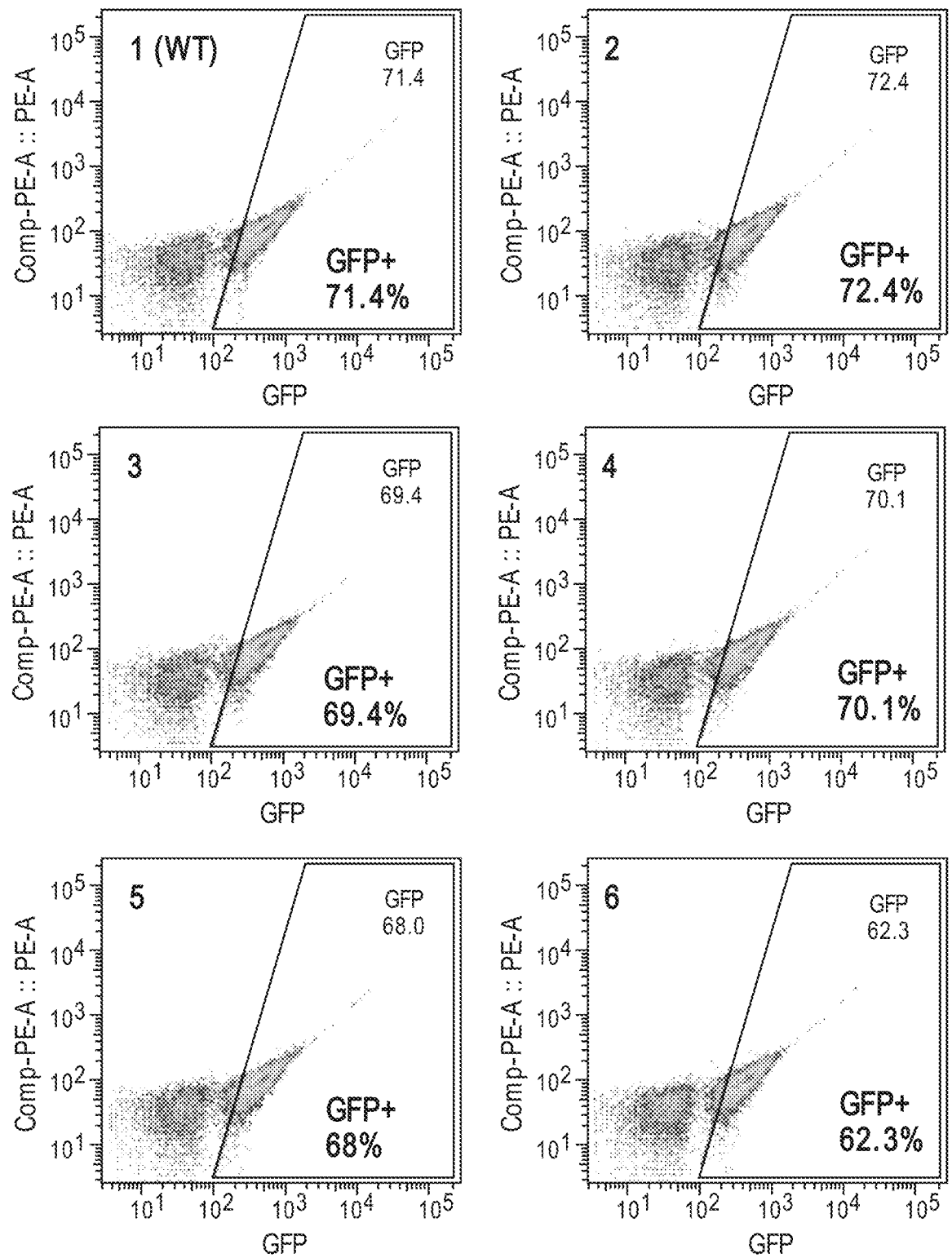
FIG. 19B shows percent GFP by flow cytometry of CRISPR modified and AAV (variants 1-20 of Table 14) transduced human cells on day 7 post CRISPR and AAV.
Figure 19B:
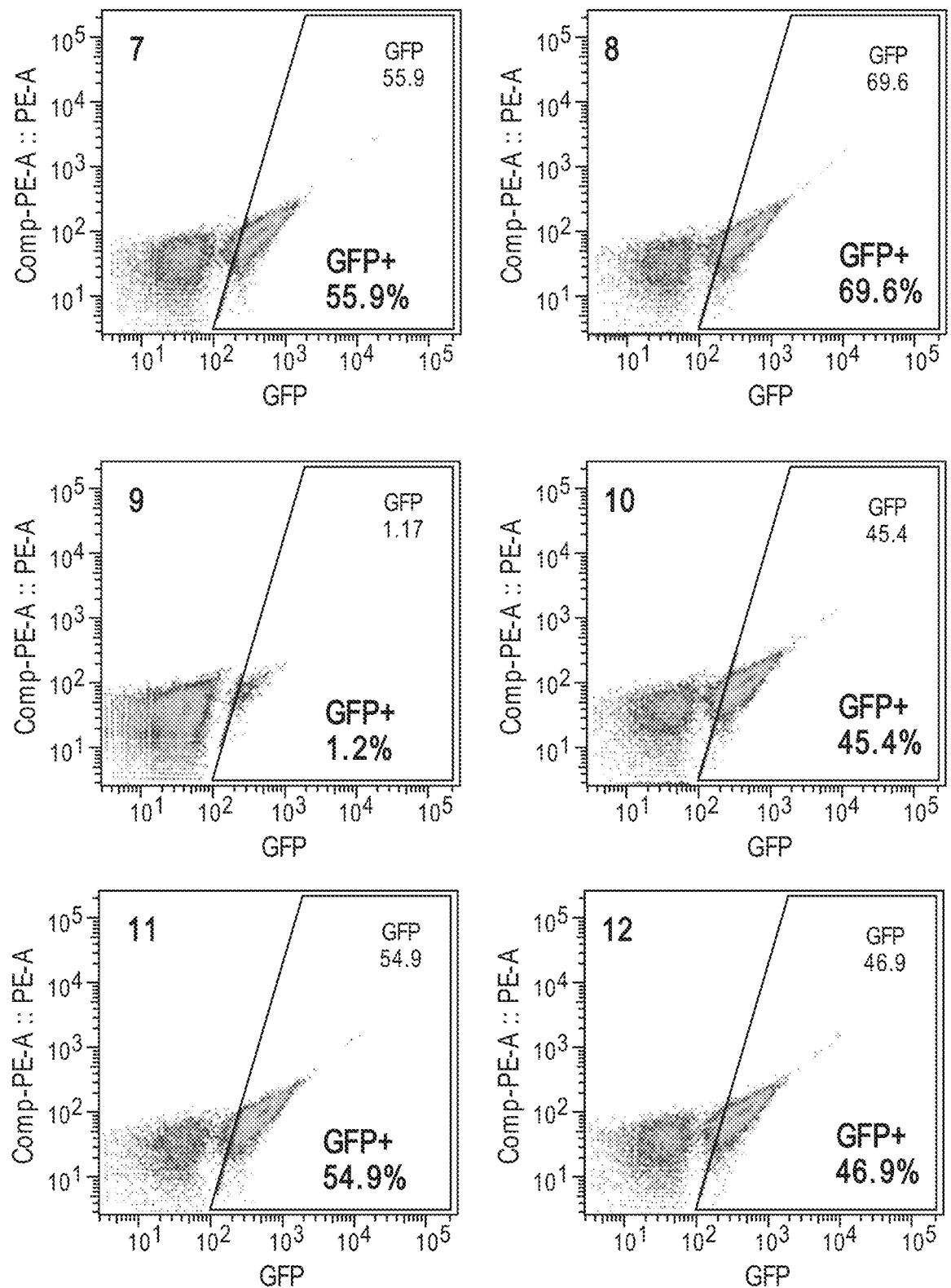
Figure 19B:
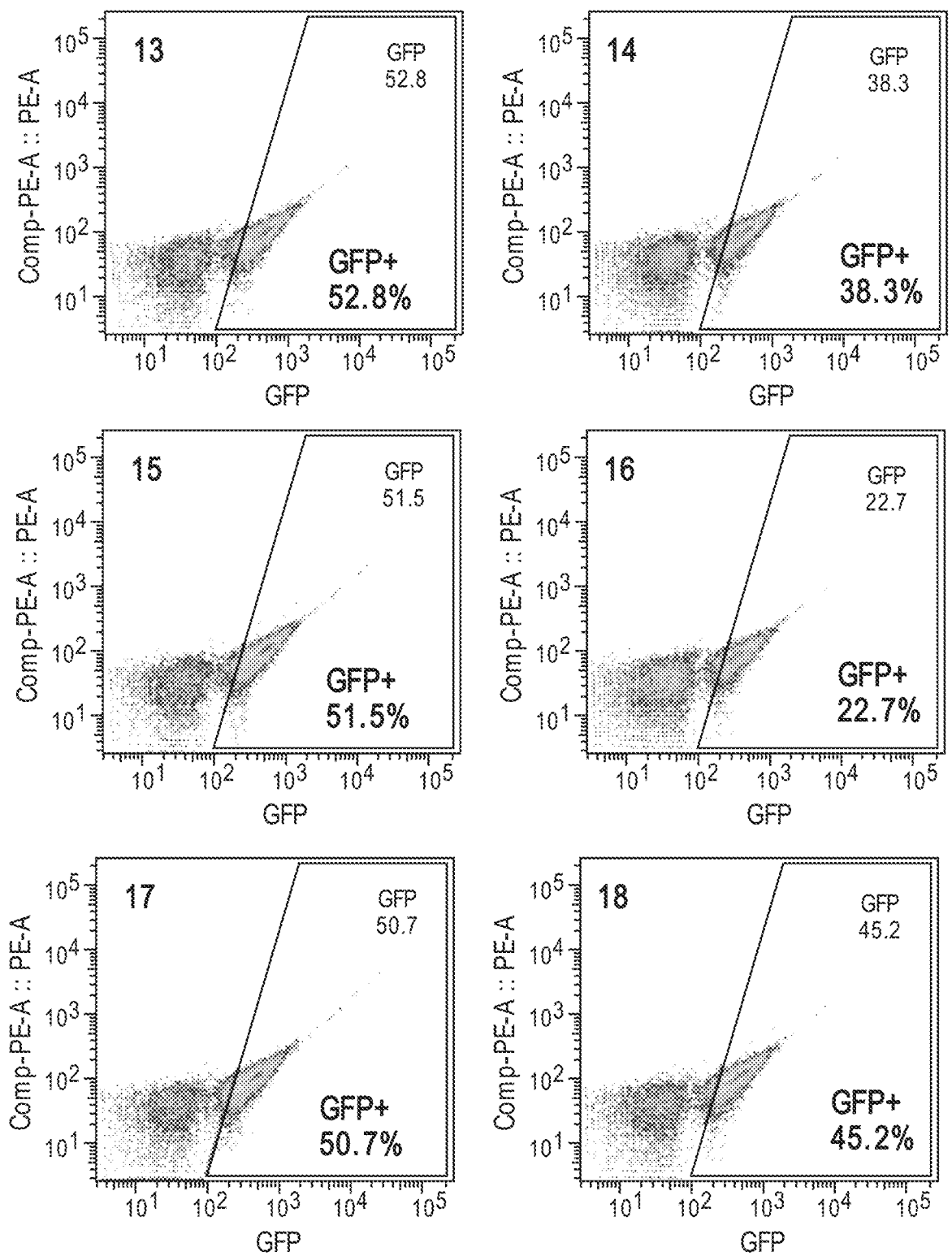
Figure 19B:
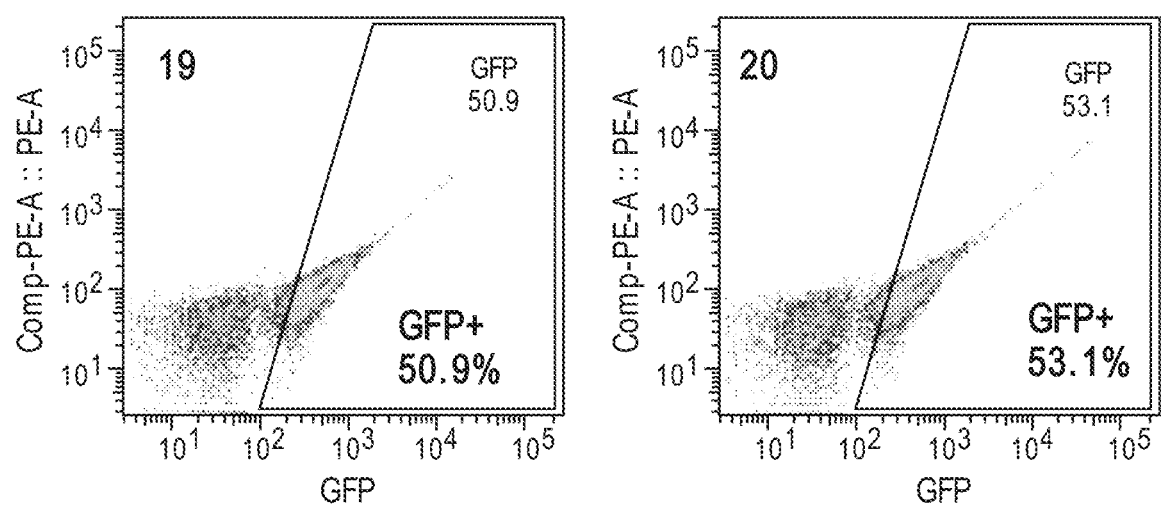
Figure 20:
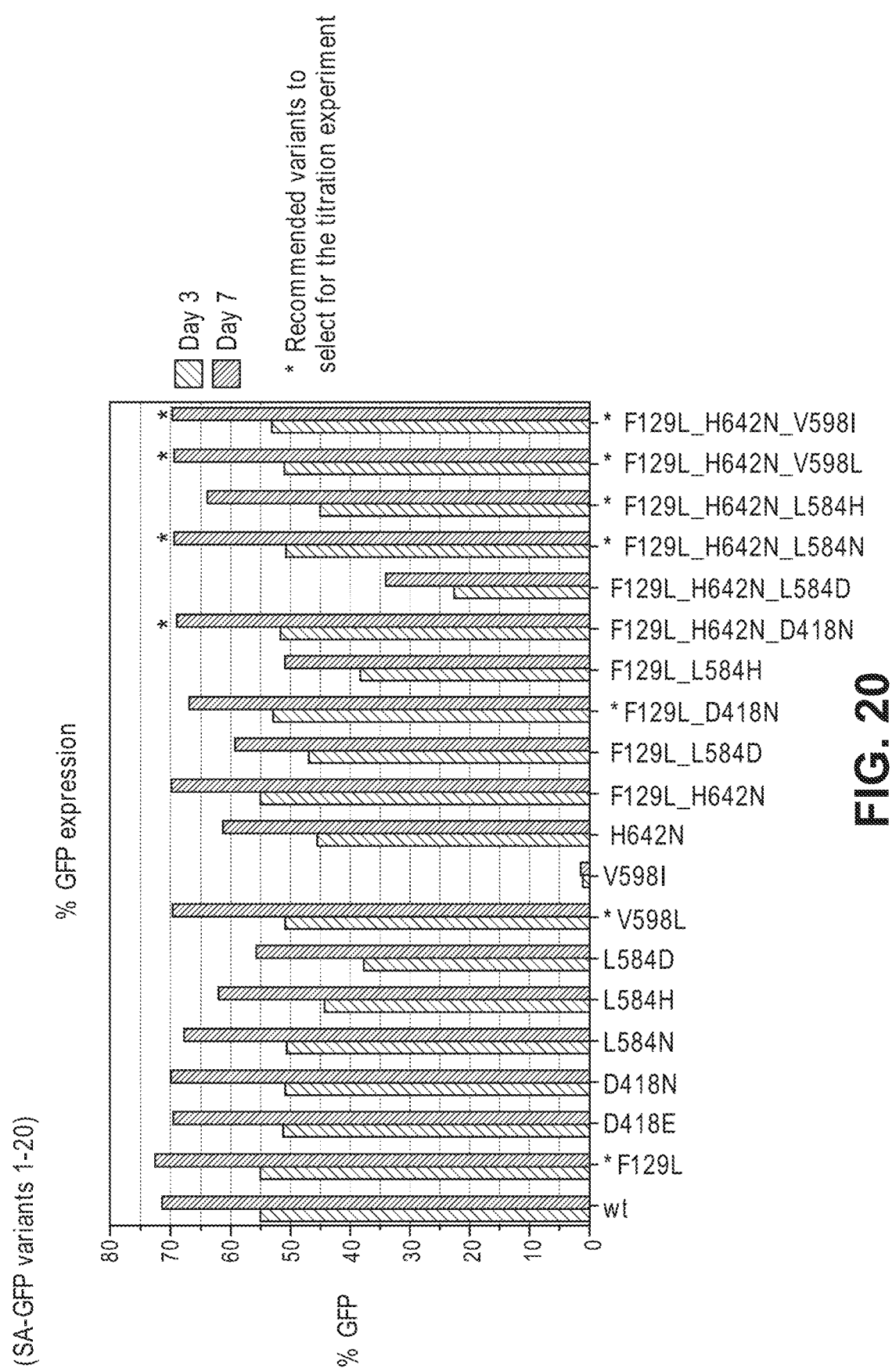
FIG. 20 shows a plot of percent GFP expression on days 3 and 7 post transduction/CRISPR editing with AAV variant particles 1-20 of Table 14 encoding for splice acceptor GFP. Cells were also edited with a CRISPR system comprising guide RNAs specific to AAVS1.
Figure 21A:
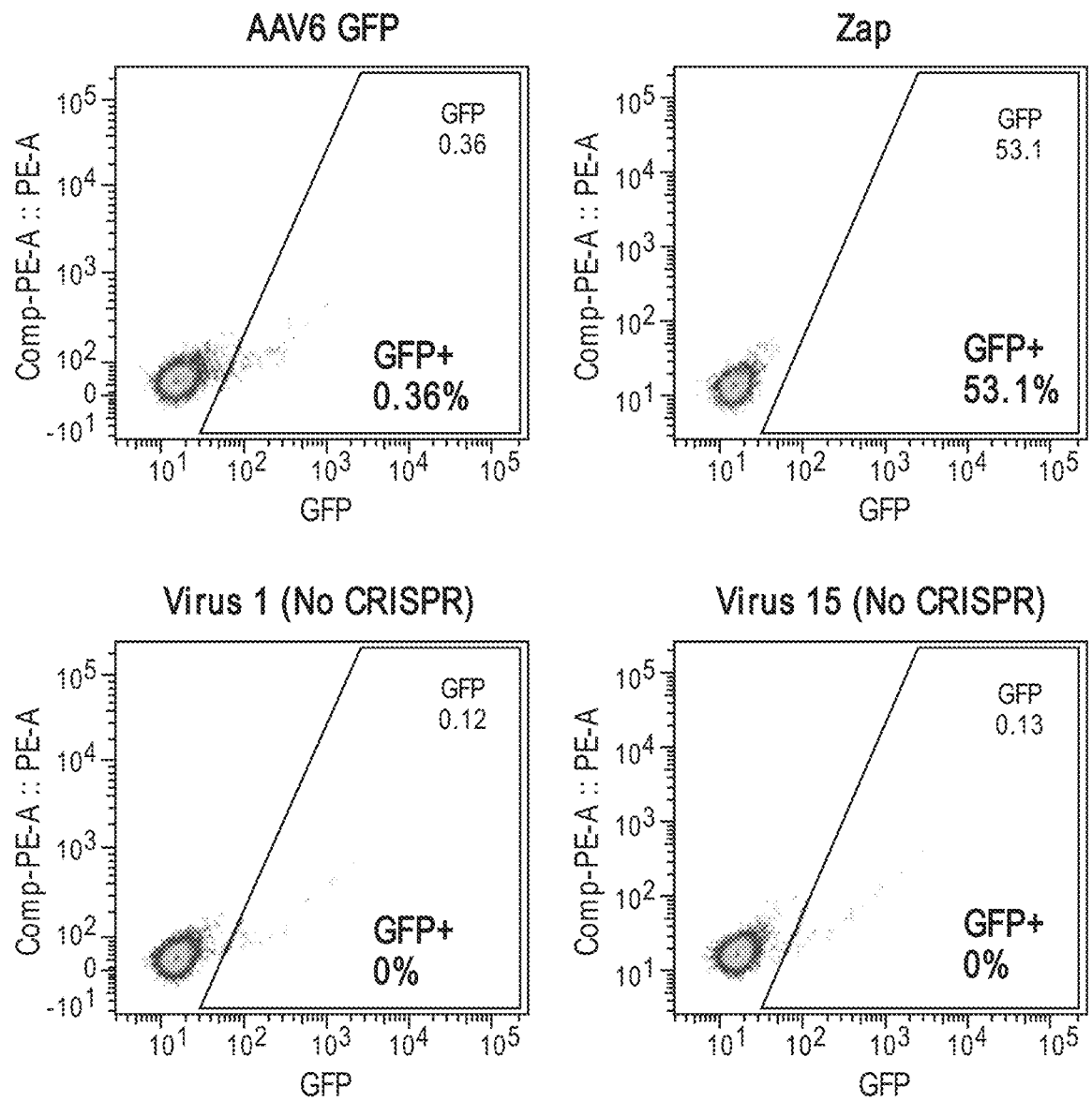
FIG. 21A shows day 14 post CRISPR/AAV flow cytometry results of different controls: untransduced human CD3+ cells that were stimulated and expanded but not electroporated with CRISPR, control AAV6 encoding for a GFP transgene, Zap, GFP mRNA, AAVS1 gRNA and Cas9.
Figure 21A:
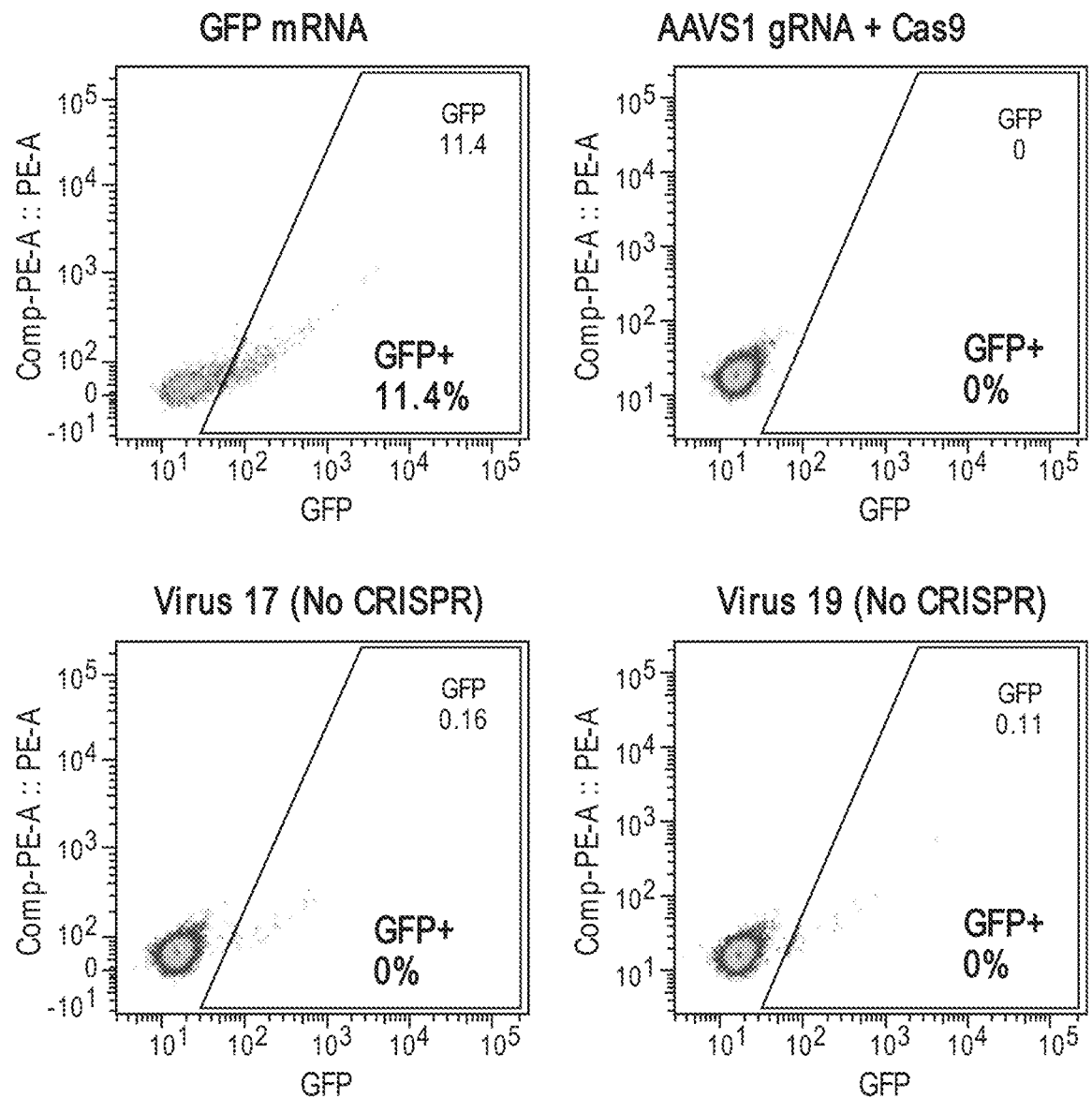
Figure 21A:
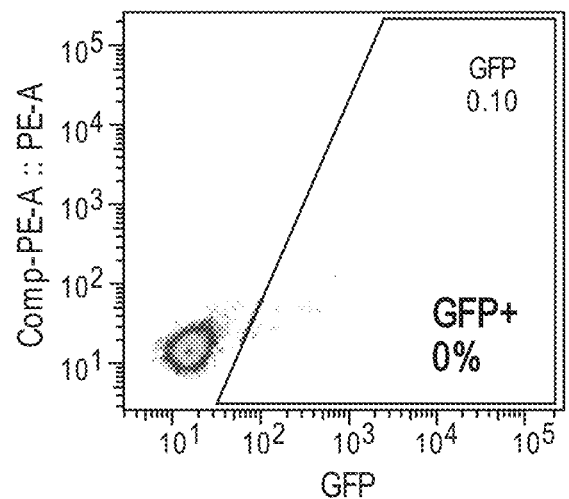
Figure 21B:
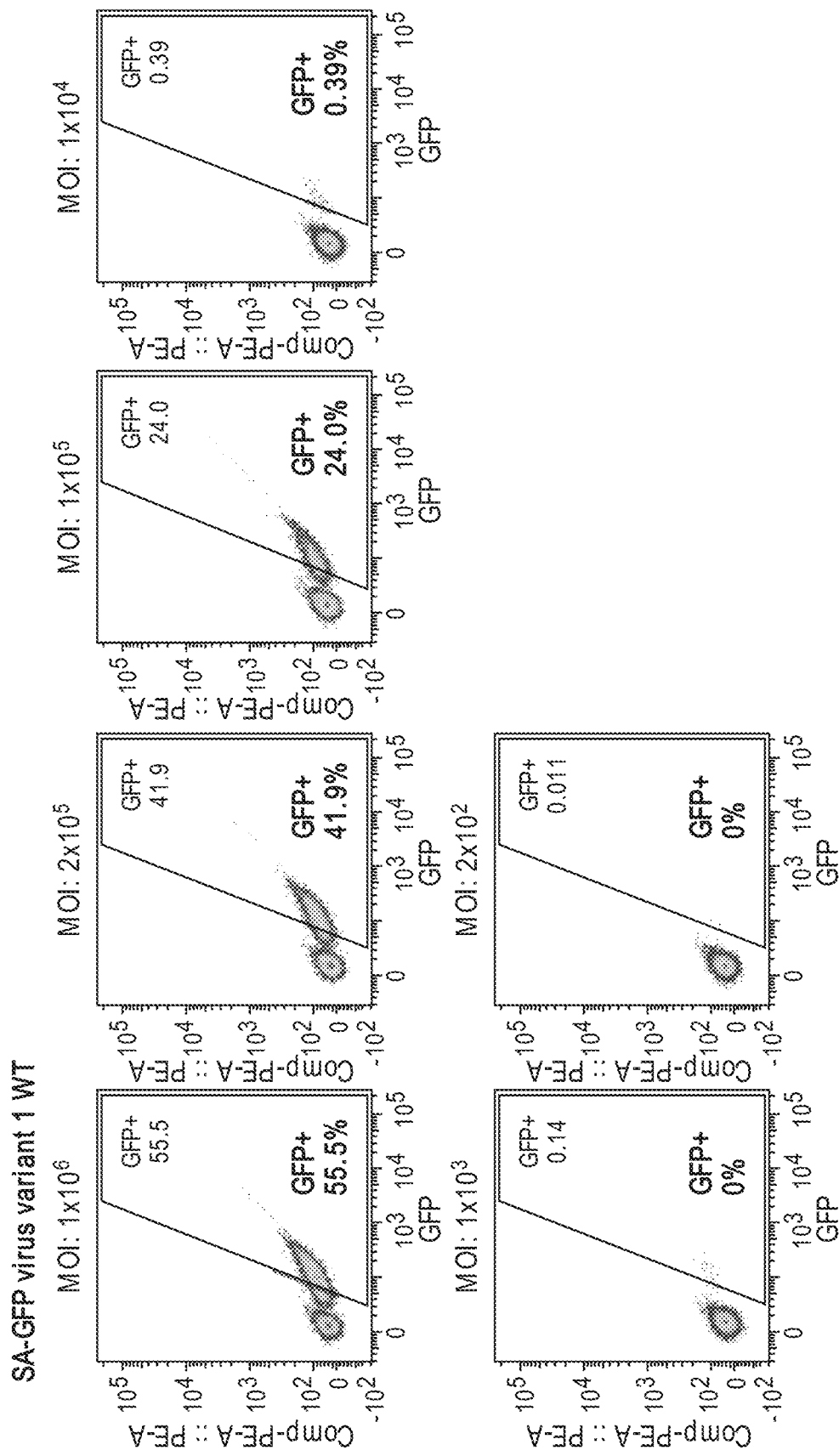
FIG. 21B shows percent splice acceptor (SA)-GFP by flow cytometry of CRISPR modified and AAV-WT cells transduced at MOIs 1×10$^6$, 2×10$^5$, 1×10$^5$, 1×10$^4$, 1×10$^3$, or 2×10$^2$.
Figure 21C:
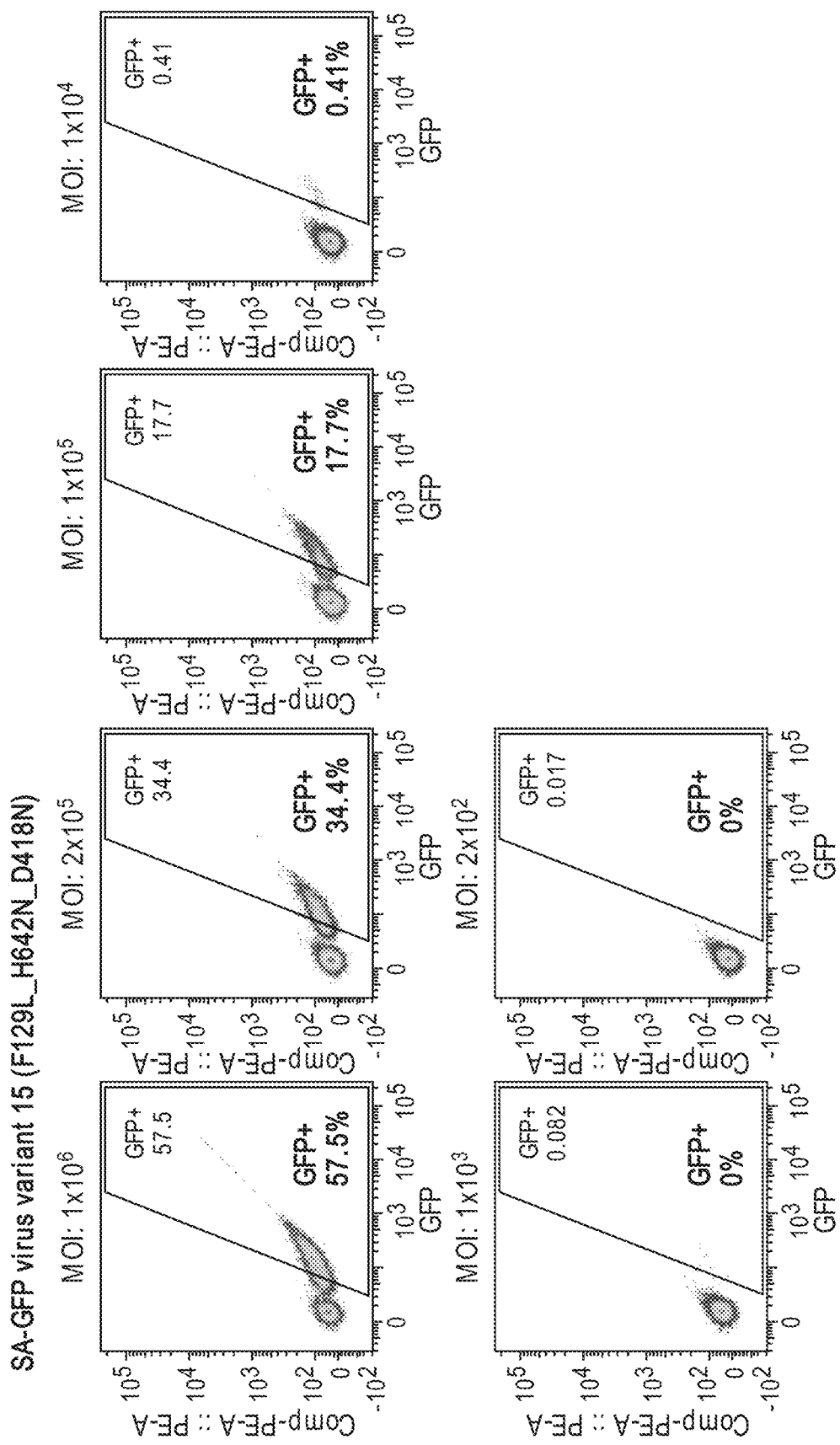
FIG. 21C shows percent SA-GFP by flow cytometry of CRISPR modified and AAV variant 15 cells transduced at MOIs 1×10$^6$, 2×10$^5$, 1×10$^5$, 1×10$^4$, 1×10$^3$, or 2×10$^2$.
Figure 21D:
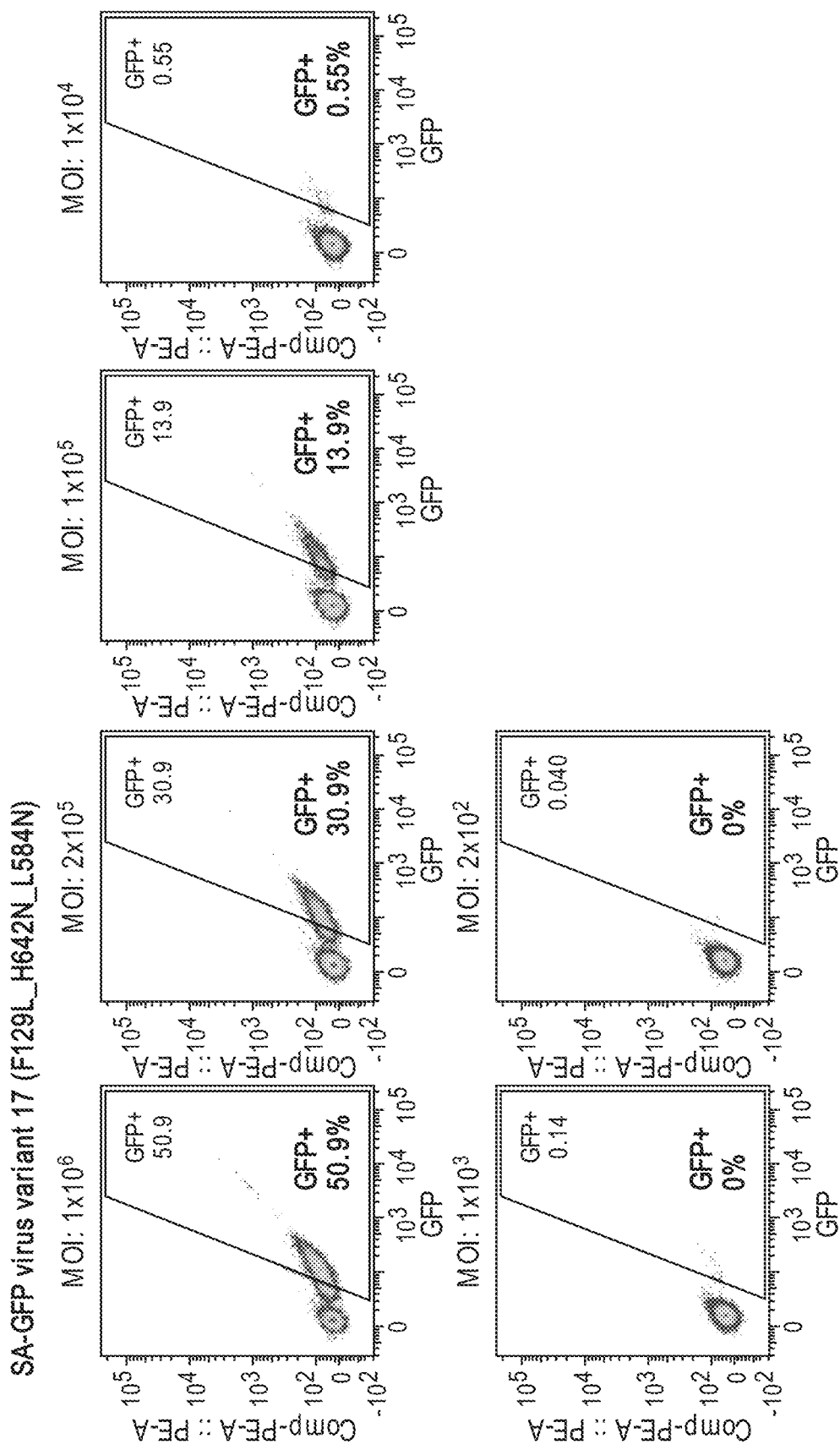
FIG. 21D shows percent SA-GFP by flow cytometry of CRISPR modified and AAV variant 17 cells transduced at MOIs 1×10$^6$, 2×10$^5$, 1×10$^5$, 1×10$^4$, 1×10$^3$, or 2×10$^2$.
Figure 21E:
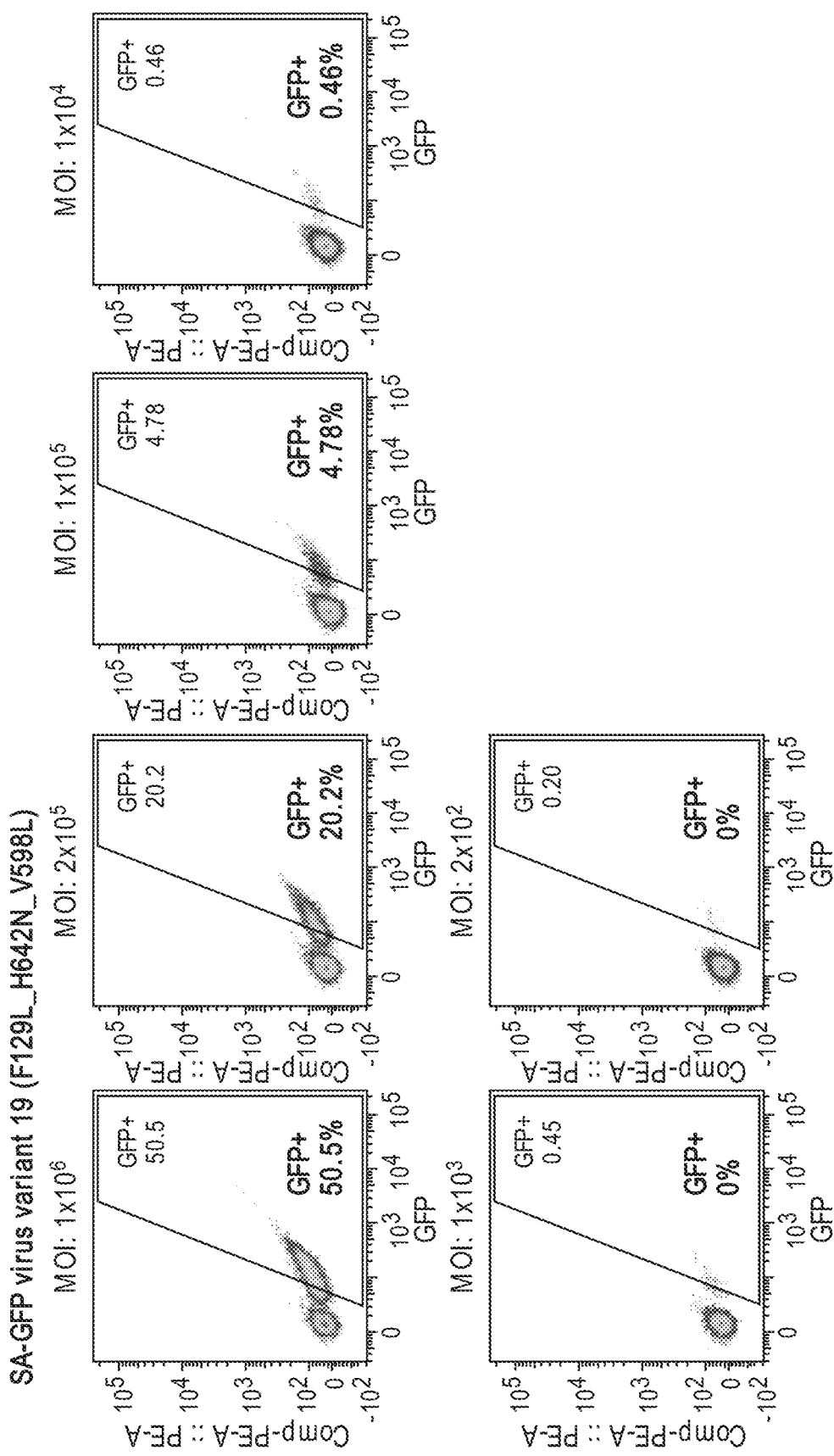
FIG. 21E shows percent SA-GFP by flow cytometry of CRISPR modified and AAV variant 19 cells transduced at MOIs 1×10$^6$, 2×10$^5$, 1×10$^5$, 1×10$^4$, 1×10$^3$, or 2×10$^2$.
Figure 21F:
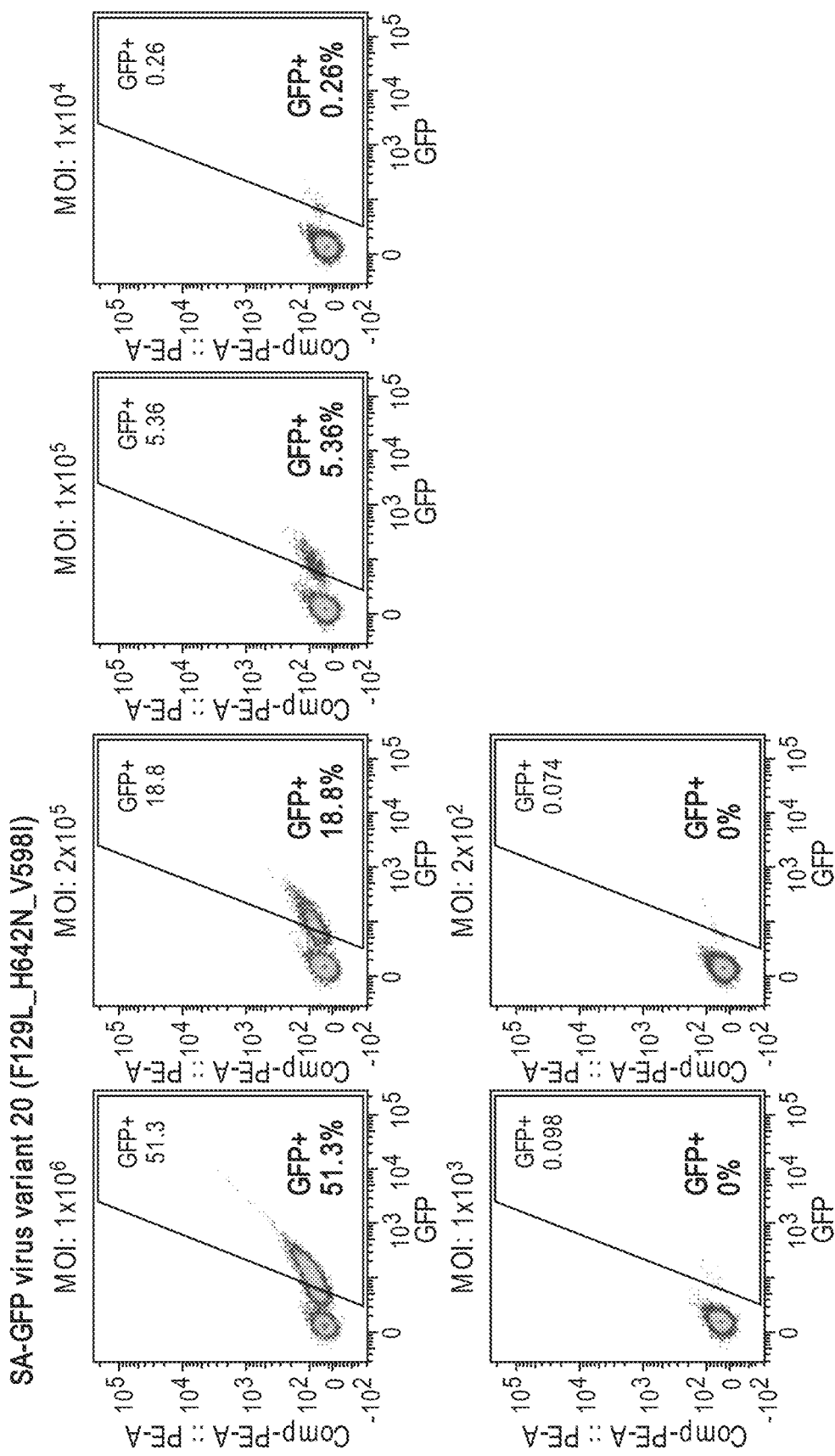
FIG. 21F shows percent SA-GFP by flow cytometry of CRISPR modified and AAV variant 20 cells transduced at MOIs 1×10$^6$, 2×10$^5$, 1×10$^5$, 1×10$^4$, 1×10$^3$, or 2×10$^2$.
Figure 21G:
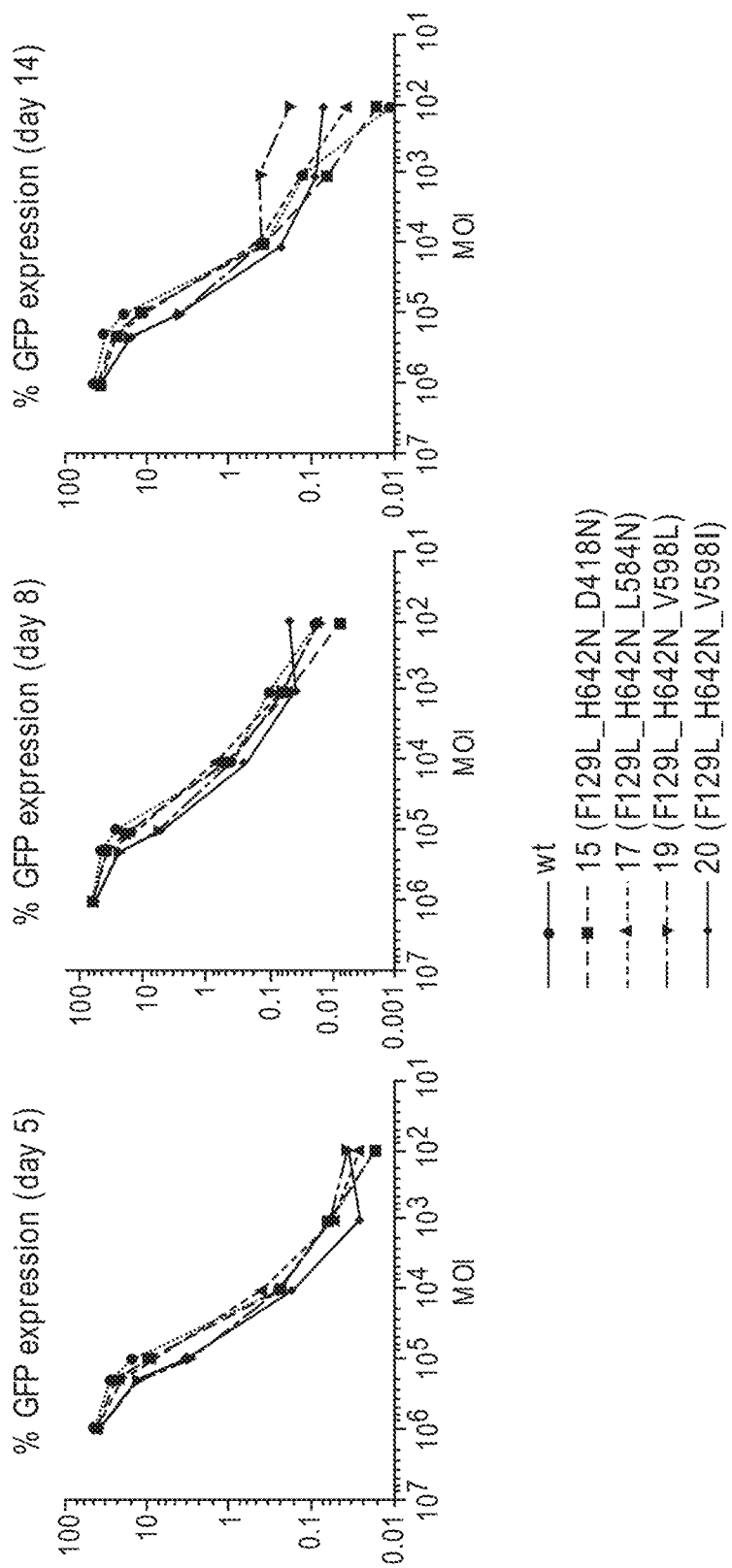
FIG. 21G shows a summary of the percent GFP expression of human CD3+ cells transduced with WT or AAV variants at different MOIs.

Cellular cultures were stimulated with anti-CD3 and anti-CD28 Dynabeads (Gibco) for three days prior to transduction. On Day 0, $4\times10^4$ CD3+ T cells were infected with virus at a MOI of $1\times10^4$ GC/mL. Cells transduced with virus 11, 12, and 18 had lower titers and therefore lower MOIs, as such 6000, 800, and 7300 GC/mL was used respectively. On Day 1 post transduction the media (X-Vivo 15 media plus 10% human serum (Sigma), IL-2 (3000U/ml), IL-7 (5 ng/mL), and IL-15 (5 ng/mL) (Peptrotech) was changed. On day 7 post transduction, GFP expression was measured by flow cytometry, FIG. 17A, FIG. 17B, and summarized in FIG. 17C.

Recombinant AAV6 Variants and CRISPR

Cellular cultures were stimulated with anti-CD3 and anti-CD28 Dynabeads (Gibco) for three days prior to editing with CRISPR. On Day 0, $3\times10^6$ CD3+ T cells were electroporated with Cas9 mRNA (15 µg), AAVS1 gRNA (10 µg) using the Neon electroporation system using parameters: pulse voltage 1400, pulse width 10 ms, 3 pulses. Cells were incubated for 2 hours post electroporation and then contacted with recombinant AAV6 variant virus.

On Day 0, upon completion of a 2 hour incubation post CRISPR, $2\times10^5$ CD3+ T cells were infected with virus, containing AAVS1 splice acceptor GFP (SA-GFP), at a MOI of $1\times10^6$ GC/mL. On Day 1 post transduction the media (X-Vivo 15 media plus 10% human serum (Sigma), IL-2 (3000U/ml), IL-7 (5 ng/mL), and IL-15 (5 ng/mL) (Peptrotech) was changed. Controls consisted of untransduced human CD3+ cells that were stimulated and expanded but not electroporated with CRISPR, AAV6 GFP: 2×10⁵ T cells infected with WT AAV6 containing a CMV GFP positive control, Zap: 2×10⁵ T cells were electroporated with Neon with 2 uL of 1×PBS, GFP mRNA: 2×10⁵ T cells electroporated with 0.35 ug GFP mRNA and 1.5 uL 1×PBS as a positive control or AAVS1 gRNA and Cas9: 2×10⁵ T cells electroporated with 1 ug of AAVS1 gRNA and 1.5 ug Cas9mRNA.

On days 3 and 7 post CRISPR and recombinant AAV6 modification, GFP expression was measured by flow cytometry (FIG. 18A, FIG. 18B, FIG. 19A, FIG. 19B, and FIG. 20 (summary of GFP expression in variants 1-20).

Recombinant AAV6 Variant Splice Acceptor GFP Titration

Four triple mutants (Virus Nos: 15, 17, 19, and 20) were selected based on percent GFP expression and were utilized in a titration assay to determine whether the mutant variants were superior to WT AAV6 at a lower MOI. Cellular cultures were stimulated with anti-CD3 and anti-CD28 Dynabeads (Gibco) for three days prior to editing with CRISPR. On Day 0, 3×10⁶ CD3+ T cells were transfected with Cas9 mRNA (15 ug) and AAVS1 gRNA (10 ug) using the Neon system at electroporation parameters of: pulse voltage 1400, pulse width 10 ms, 3 pulses. Cells were incubated for 2 hours post electroporation with CRISPR.

On Day 0, upon completion of a 2 hour incubation post CRISPR, 2×10⁵ CD3+ T cells were infected under five conditions: WT, Virus Nos: 15, 17, 19, or 20, containing AAVS1 splice acceptor GFP (SA-GFP), at a MOI of 1×10⁶, 2×10⁵, 1×10⁵, 1×10⁴, 1×10³, or 2×10². On Day 1 post transduction the media (X-Vivo 15 media plus 10% human serum (Sigma), IL-2 (3000U/ml), IL-7 (5 ng/mL), and IL-15 (5 ng/mL) (Peptrotech) was changed. On days 5, 8, and 14 a percent GFP was measured by flow cytometry, FIG. 21A-FIG. 21F, FIG. 21G shows a summary of the data.

Splice Acceptor NanoLuc Variant

Four triple mutants (Virus Nos. 15, 17, 19, and 20) were used to generate recombinant AAV6 viral particles containing an AAVS1 splice acceptor NanoLuc (CMV-NanoLuc). NanoLuc is a highly expressed reporter which increases range and sensitivity of experiments in which it is used. Cellular cultures were stimulated with anti-CD3 and anti-CD28 Dynabeads (Gibco) for three days prior to editing with CRISPR. On Day 0, 3×10⁶ CD3+ T cells were transfected with Cas9 mRNA (15 ug) and AAVS1 gRNA (10 ug) using the Neon system at electroporation parameters of: pulse voltage 1400, pulse width 10 ms, 3 pulses. Cells were incubated for 2 hours post electroporation with CRISPR.

Figure 22A:
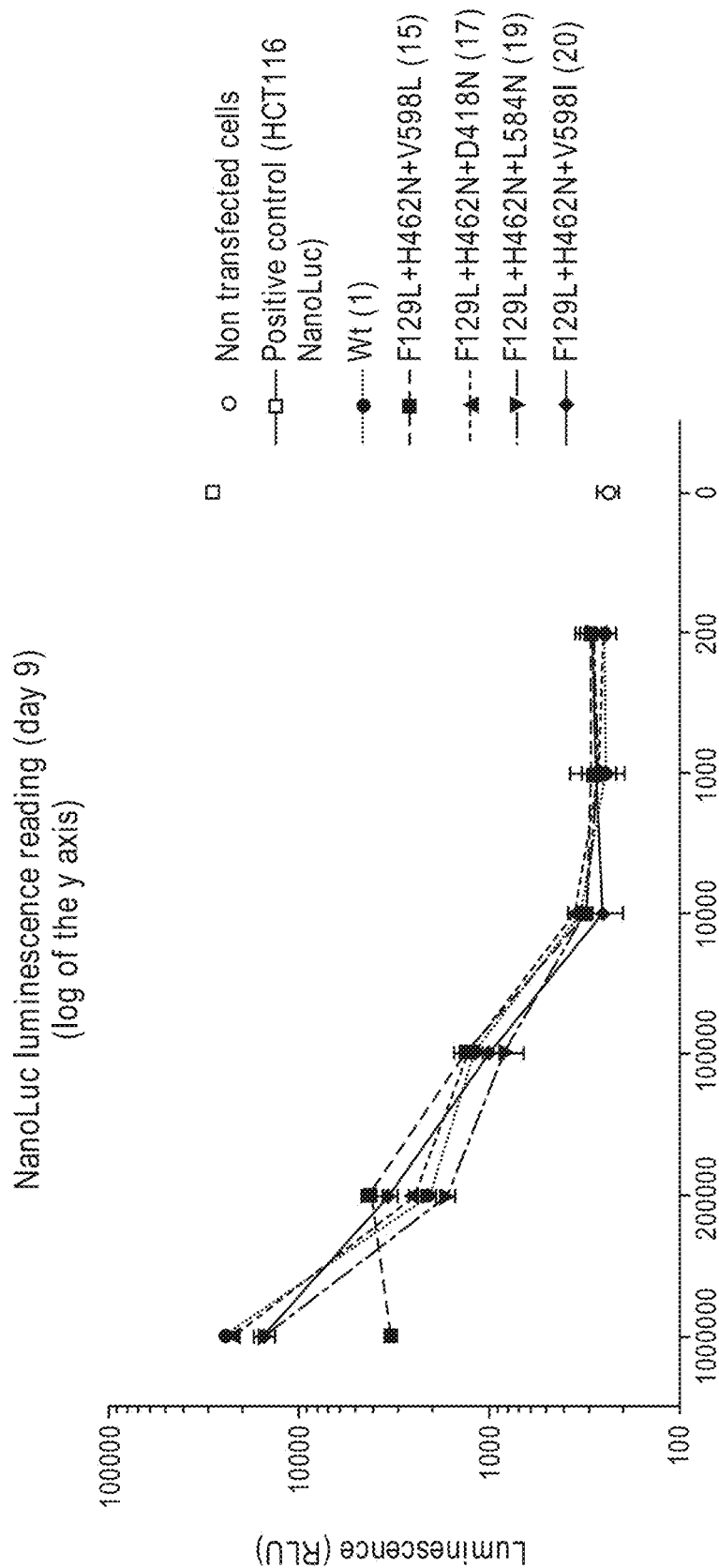
FIG. 22A shows luminescence data on Day 9 post CRISPR and AAV (WT or variant 15, 17, 19, or 20) at different MOIs. Legend is shown in FIG. 22B.
Figure 22B:
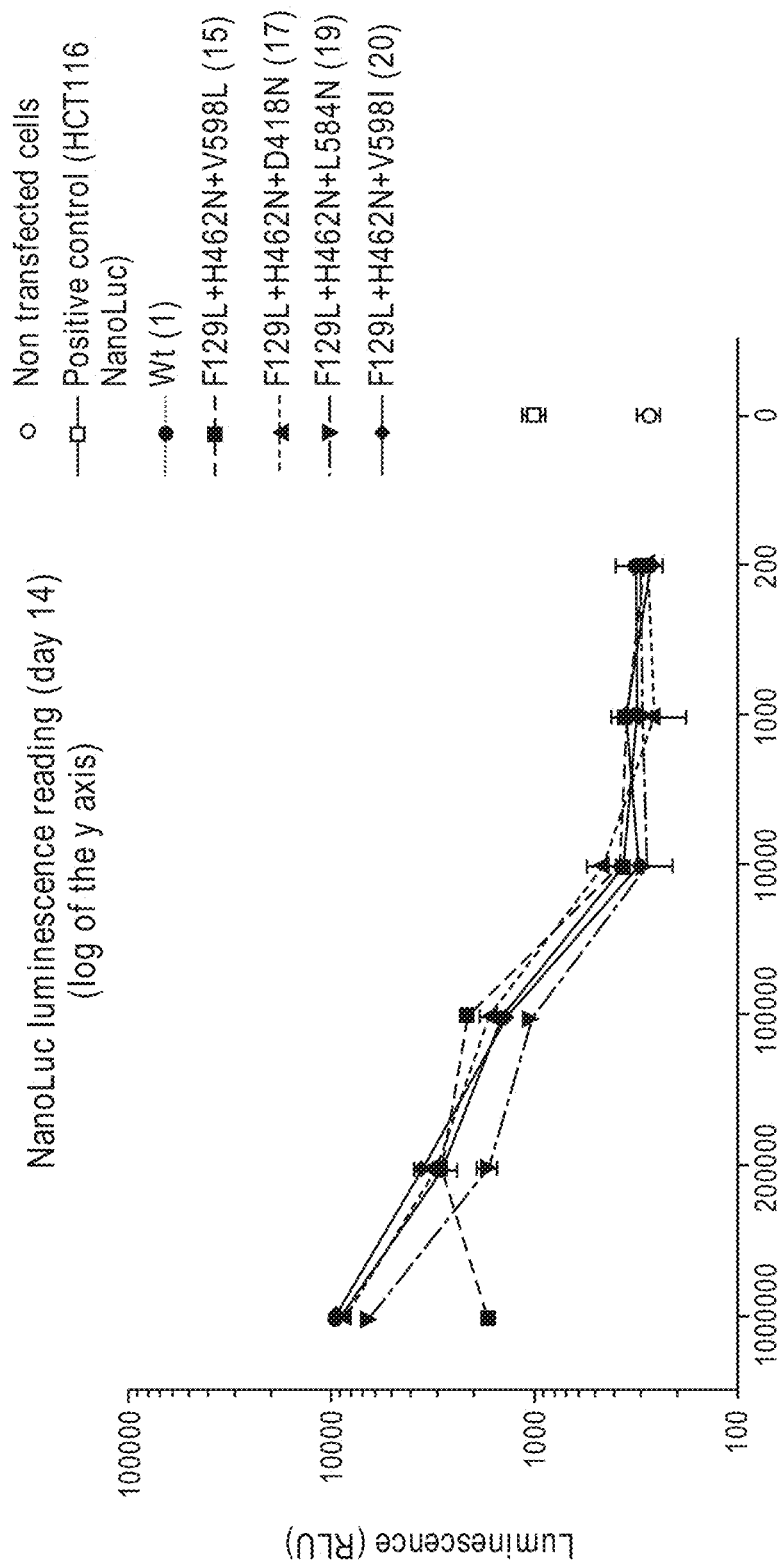
FIG. 22B shows luminescence data on Day 14 post CRISPR and AAVX (WT or variant 15, 17, 19, or 20) at different MOIs.

On Day 0, upon completion of a 2 hour incubation post CRISPR, 3×10⁵ CD3+ T cells were infected under five conditions: WT, Virus Nos. 15, 17, 19, or 20, containing SA-NanoLuc, at a MOI of 1×10⁶, 2×10⁵, 1×10⁵, 1×10⁴, 1×10³, or 2×10². Upon completion of transfection cells were incubated at 30° C. overnight. On Day 1 post transduction, the cells were transferred to 37° C. On days 9 and 14 a percent GFP was measured via luminescence (RLU) a plate reader, FIG. 22A and FIG. 22B.

Packaging efficiency for the viral variants 15, 17, 19, and 20 was calculated as viral genome to viral capsid ratio for each variant. A capsid ratio closest to 1 indicates the best packaging efficiency. qPCR was used to determine the genome titer and ADK1 ELISA (Progen) was used to quantify the capsid, FIG. 22C.

TABLE 14

Recombinant AAV6 virus variants and titer

| Virus No.: | Mutation | Titer (GC/mL) |
|---|---|---|
| Virus 1 | WT | 7.73E+09 |
| Virus 2 | F129L | 3.87E+09 |
| Virus 3 | D418E | 6.95E+09 |
| Virus 4 | D418N | 6.30E+09 |
| Virus 5 | L584N | 8.58E+08 |
| Virus 6 | L584H | 4.89E+09 |
| Virus 7 | L584D | 1.04E+10 |
| Virus 8 | V598L | 2.69E+10 |
| Virus 9 | V598I | 9.32E+09 |
| Virus 10 | H642N | 6.65E+09 |
| Virus 11 | F129L_H642N | 9.55E+08 |
| Virus 12 | F129L_L584D | 3.48E+08 |
| Virus 13 | F129L_D418N | 4.18E+09 |
| Virus 14 | F129L_L584H | 1.88E+09 |
| Virus 15 | F129L_H642N_D418N | 2.84E+09 |
| Virus 16 | F129L_H642N_L584D | 2.54E+09 |
| Virus 17 | F129L_H642N_L584N | 2.39E+09 |
| Virus 18 | F129L_H642N_L584H | 1.39E+09 |
| Virus 19 | F129L H642N V598L | 1.63E+09 |
| Virus 20 | F129L_H642N_V598I | 3.75E+09 |

Example 9: Variant rAAV6

Chimera NanoLuc Titration

Cellular cultures were stimulated with anti-CD3 and anti-CD28 Dynabeads (Gibco) for three days prior to editing with CRISPR. On Day 0, 3×10⁶ CD3+ T cells were transfected with Cas9 mRNA (15 ug), from the nucleic acid of Table 16, and AAVS1 gRNA (10 ug) using the Neon system at electroporation parameters of: pulse voltage 1400, pulse width 10 ms, 3 pulses. Cells were incubated for 2 hours post electroporation with CRISPR.

Figure 23:
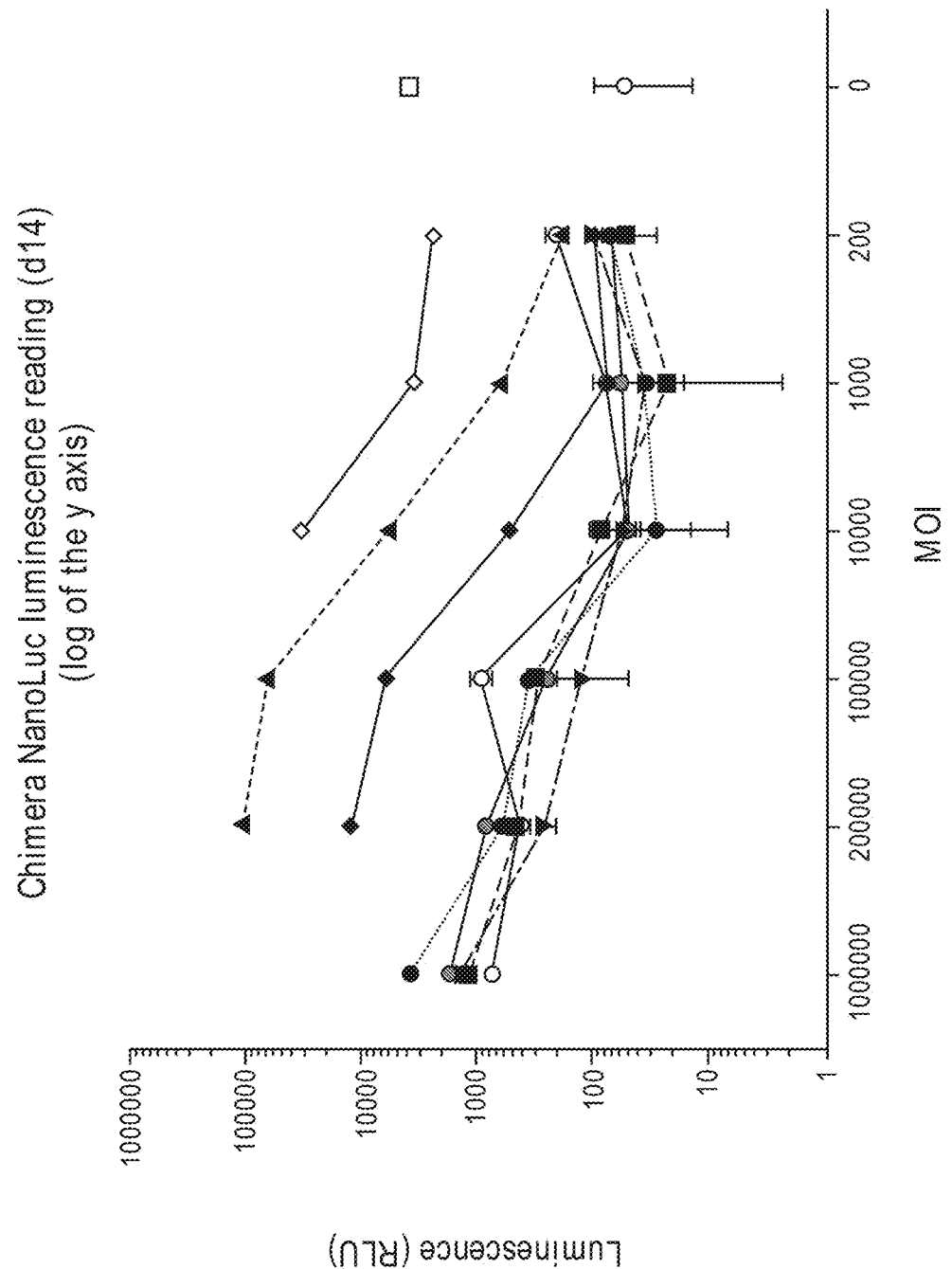
FIG. 23 shows luminescence data on day 14 after CRISPR and AAV (WT or chimera 1-8 of Table 15) at different MOIs.
Figure 24A:
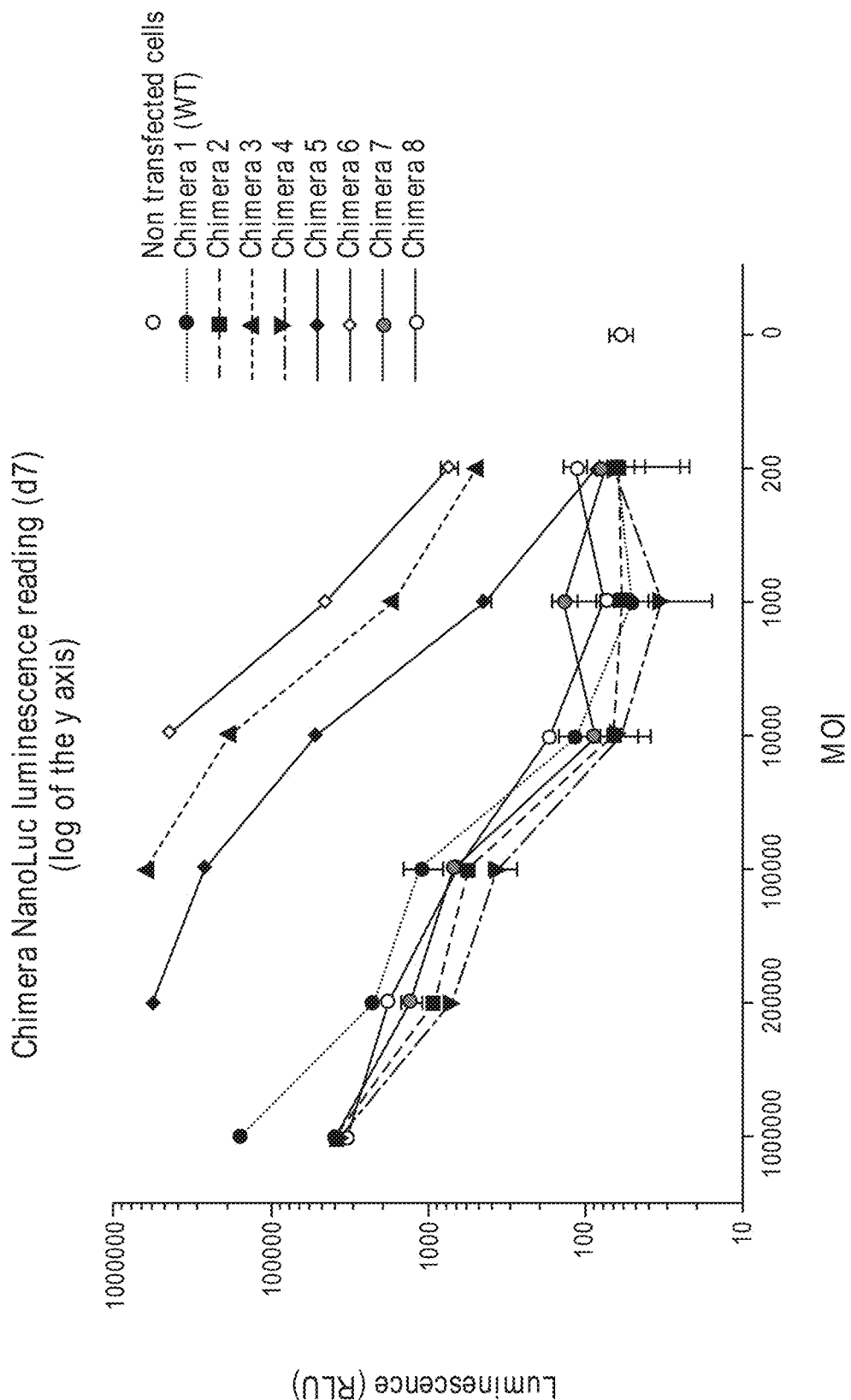
FIG. 24A shows luminescence data on day 7 after CRISPR and AAV (WT, non-transfected, or chimera 1-8 of Table 15) at different MOIs.
Figure 24B:
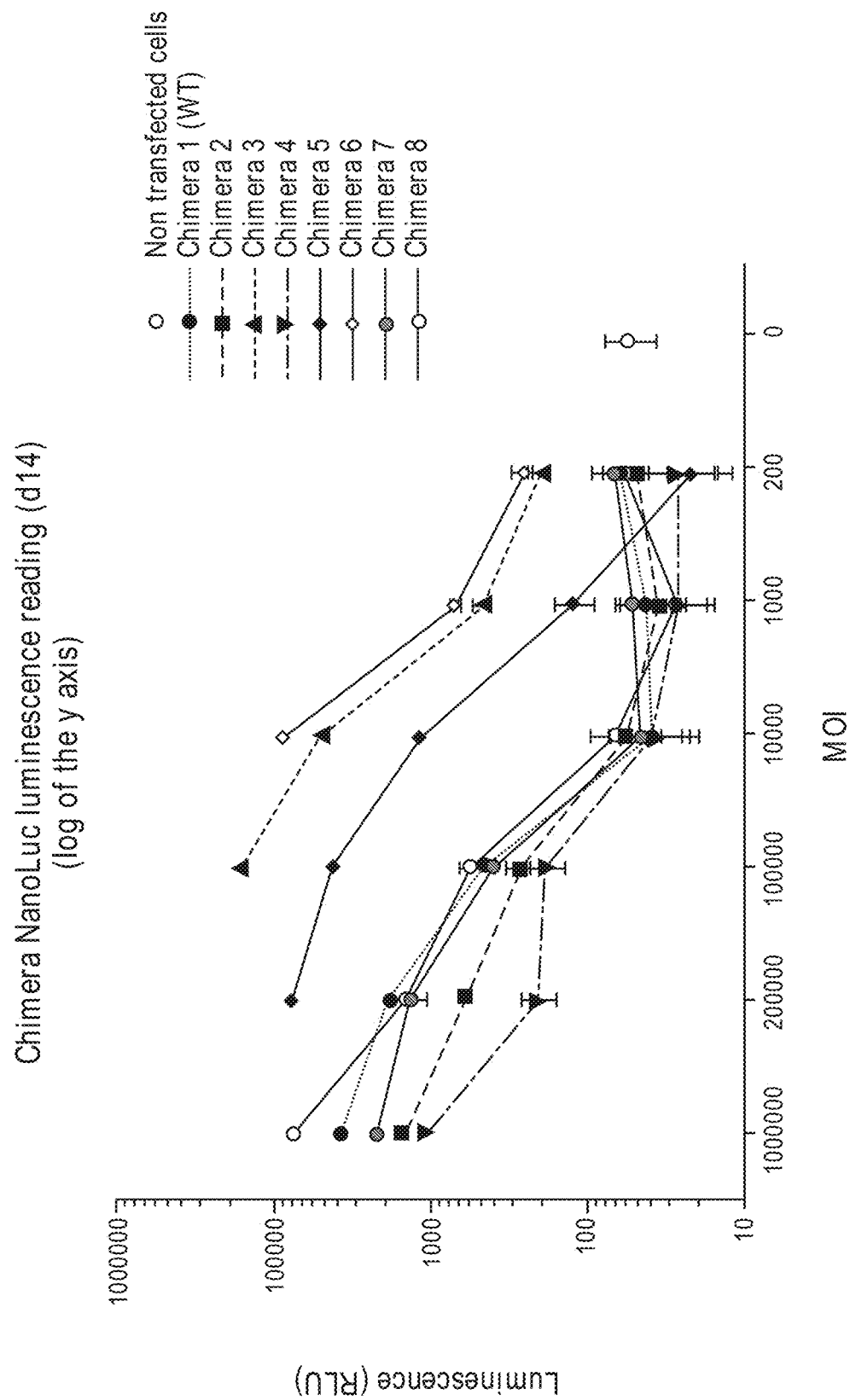
FIG. 24B shows luminescence data on day 14 after CRISPR and AAV (WT, non-transfected, or chimera 1-8 of Table 15) at different MOIs.

On Day 0, upon completion of CRISPR modified CD3+ T cells were pooled and aliquoted into a 96-well plate at 1×10⁶, 2×10⁵, 1×10⁵, 1×10⁴, 1×10³, or 2×10². Edited cells were incubated at 30° C. overnight. On Day 1 post editing, cells were transferred to 37° C. and allowed to incubate until Day 7 and Day 14. On Days 7 and 14 post editing, Nano-Glo reagent (Promega) was added and luminescence was measured from 5×10⁴ cells using a plate reader Luminescence was calculated in triplicate and compared to an HCT116 NanoLuc cell line positive control, FIG. 23, FIG. 24A, FIG. 24B Luminescence reading taken from 5×10⁴ cells after the addition of Nano-Glo reagent (Promega) at day 14 post transfection with Cas9 mRNA, AAVS1 gRNA and transduction with virus containing a NanoLuc transgene expressed from a CMV promoter. WT AAV6 is shown in red and chimeras 3, 5 and 6 are shown in light green, black and plink, respectively. Chimeras 3, 5 and 6 were too low in titer to achieve the high MOIs in the titration experiment. As compared to WT AAV6 and non-transfected cells, cells transfected with AAV chimeras 3, 5, and 6 show increased luminescence (RLU), indicating increased transfection efficiency, on days 7 and 14 post-modification at MOIs from 0 to 1,000,000. Chimeras 3, 5, and 6 showed levels of luminescence that were superior to WT AAV6, approximately 100× better than WT AAV6 that also contained the CMV-NanoLuc transgene.

Figure 27A:
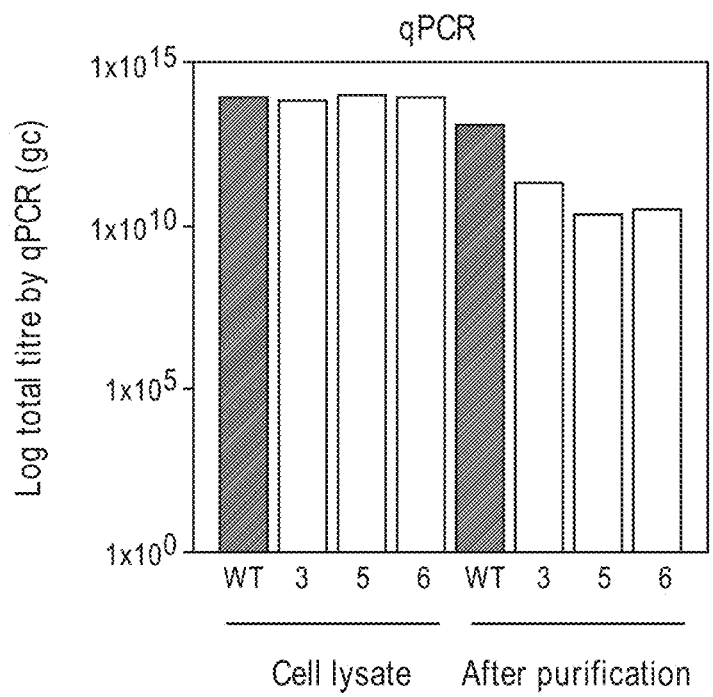
FIG. 27A shows qPCR summary of tired AAV chimeras 3, 5, and 6 using cell lysate and post purification.

Primary cells were transduced with chimeras 3, 5, and 6. Cell lysate was collected and a qPCR was run to determine copy number of AAV chimera 3, 5, and 6, FIG. 27A. Supernatant from the transduced primary cells, lysate vs post purification, was also collected and an anti-ADK1 (specific for a conformational epitope on the AAV6 capsids)

Figure 27B:
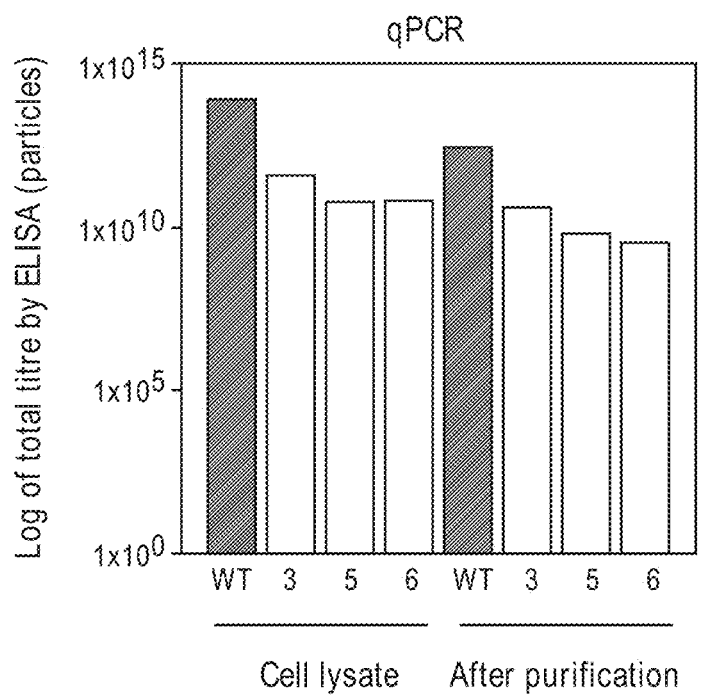
FIG. 27B shows ELISA results of AAV chimeras 3, 5, and 6 using cell lysate and post purification.

ELISA was run on WT, and cells transduced with AAV chimeras 3, 5, and 6, FIG. 27B.

TABLE 15

Figure 29A:
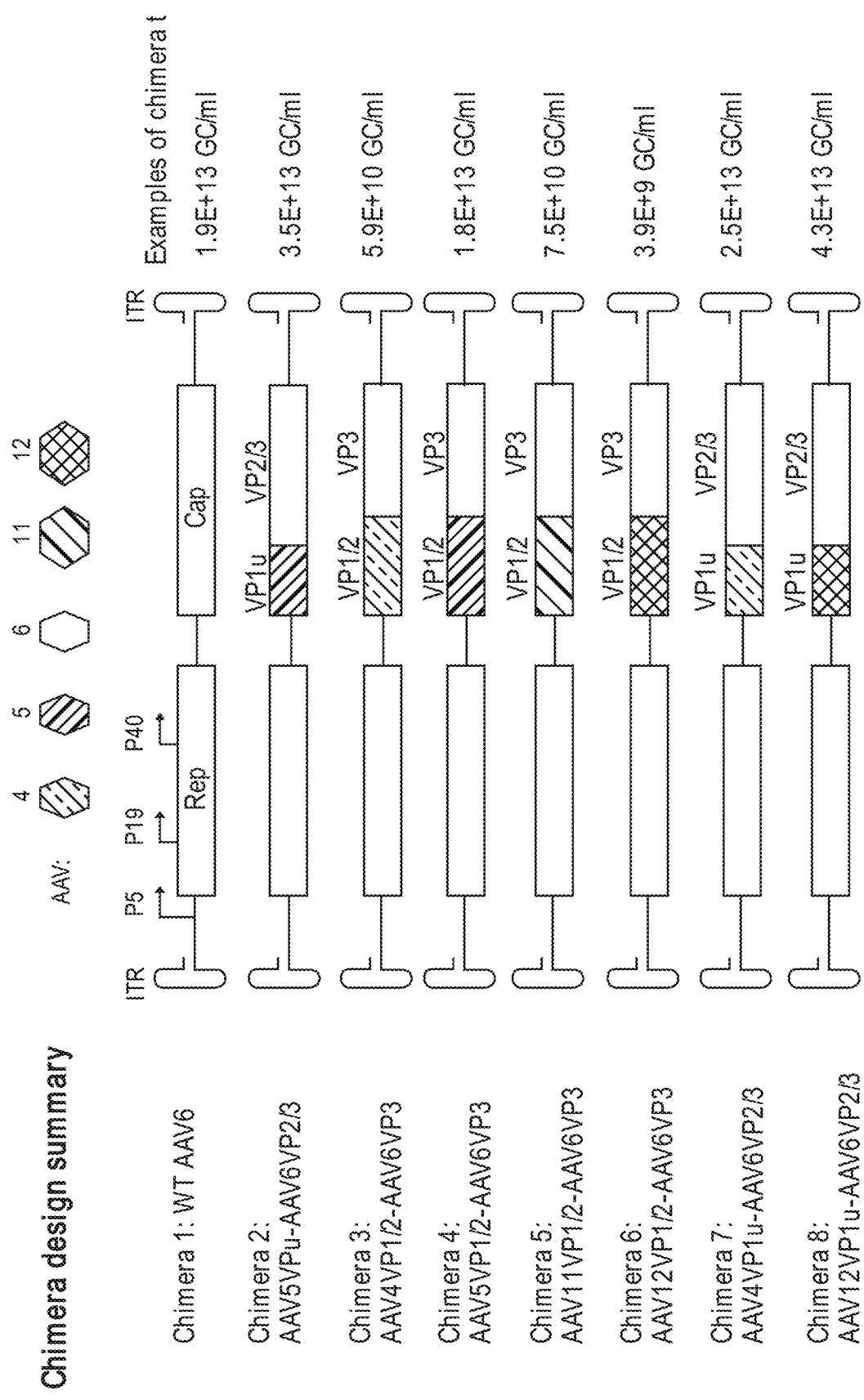
FIG. 29A shows a schematic of AAV chimeras.
Figure 29B:
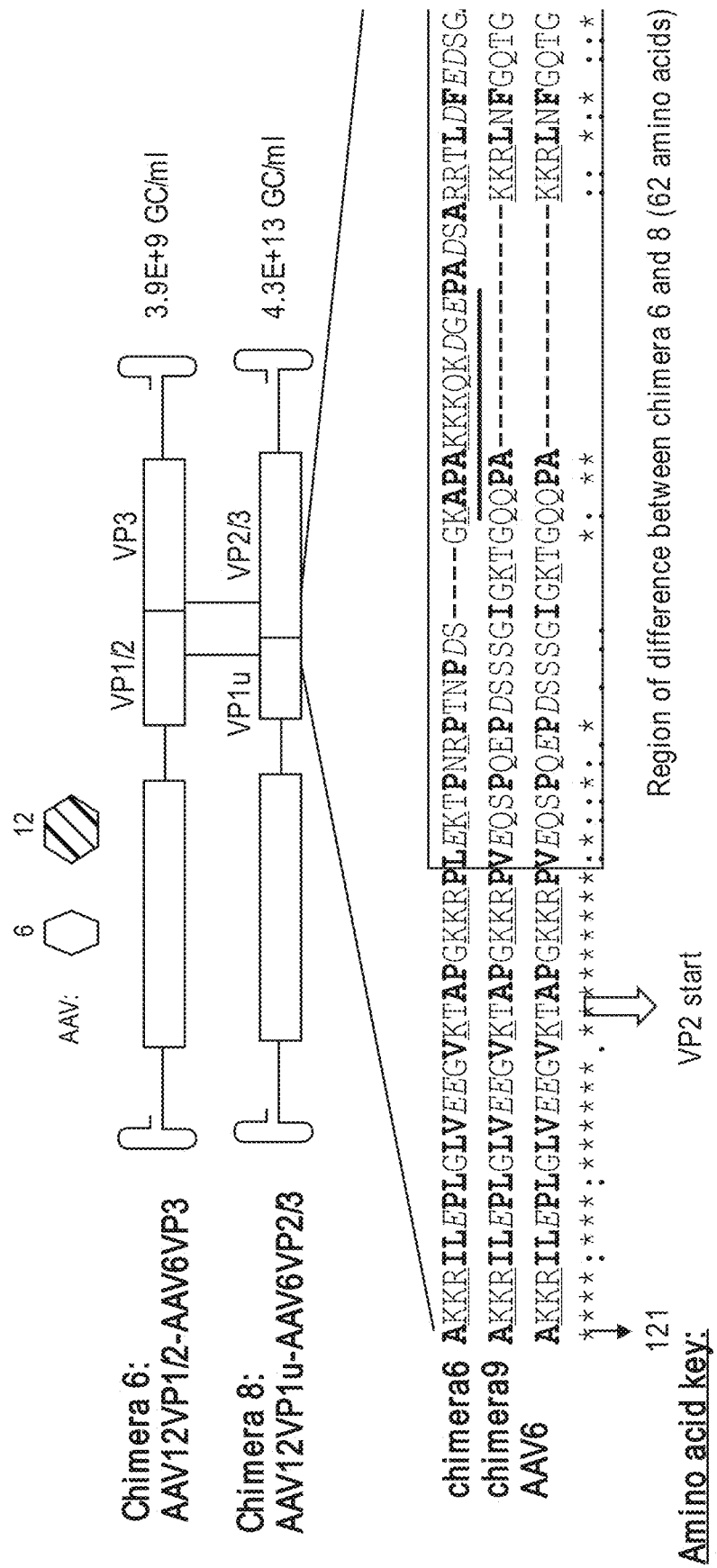
FIG. 29B shows a schematic of AAV chimeras 6 (SEQ ID NO: 307) and 8 (SEQ ID NO: 308) as compared to AAV6 (SEQ ID NO: 309).

Chimeric variant recombinant AAV6 constructs, also shown in FIG. 29A.

| Chimera | Chimera details | Virus titer (GC/ml) |
|---|---|---|
| 1 | WT | 1.90E+13 |
| 2 | AAV5VP1u-AAV6VP2/3 | 3.55E+13 |
| 3 | rAAV4VP1/2-AAV6VP3 | 5.89E+10 |
| 4 | rAAV5VP1/2-AAV6VP3 | 1.76E+13 |
| 5 | rAAV11VP1/2-AAV6VP3 | 7.45E+10 |
| 6 | rAAV12VP1/2-AAV6VP3 | 3.89E+09 |
| 7 | AAV4VP1u-AAV6VP2/3 | 2.53E+13 |
| 8 | AAV12VP1u-AAV6VP 2/3 | 4.34E+13 |

TABLE 16

Modified Streptococcus pyogenes Cas9

SEQ ID 221

```
ggaaataagagagaaaagaagagtaagaagaaatataagagccaccatggccccaaagaaga
agcggaaggtcggtatccacggagtcccagcagccgacaagaagtacagcatcggcctggac
atcggcaccaactctgtgggctgggccgtgatcaccgacgagtacaaggtgcccagcaagaa
attcaaggtgctgggcaacaccgaccggcacagcatcaagaagaacctgatcggagccctgc
tgttcgacagcggcgaaacagccgaggccacccggctgaagagaaccgccagaagaagatac
accagacggaagaaccggatctgctatctgcaagagatcttcagcaacgagatggccaaggt
ggacgacagcttcttccacagactggaagagtccttcctggtggaagaggacaagaagcacg
agagacaccccatcttcggcaacatcgtggacgaggtggcctaccacgagaagtaccccacc
atctaccacctgagaaagaaactggtggacagcaccgacaaggccgacctgagactgatcta
cctggccctggcccacatgatcaagttcagaggccacttcctgatcgagggcgacctgaacc
ccgacaacagcgacgtggacaagctgttcatccagctggtgcagacctacaaccagctgttc
gaggaaaacccccatcaacgccagcggcgtggacgccaaggctatcctgtctgccagactgag
caagagcagaaggctggaaaatctgatcgcccagctgcccggcgagaagaagaacggcctgt
tcggcaacctgattgccctgagcctgggcctgacccccaacttcaagagcaacttcgacctg
gccgaggatgccaaactgcagctgagcaaggacacctacgacgacgacctggacaacctgct
ggcccagatcggcgaccagtacgccgacctgttcctggccgccaagaacctgtctgacgcca
tcctgctgagcgacatcctgagagtgaacaccgagatcaccaaggccccccctgagcgcctct
atgatcaagagatacgacgagcaccaccaggacctgaccctgctgaaagctctcgtgcggca
gcagctgcctgagaagtacaaagaaatcttcttcgaccagagcaagaacggctacgccggct
acatcgatggcggcgctagccaggaagagttctacaagttcatcaagcccatcctggaaaag
atggacggcaccgaggaactgctcgtgaagctgaacagagaggacctgctgagaaagcagag
aaccttcgacaacggcagcatccccccaccagatccacctgggagagctgcacgctatcctga
gaaggcaggaagattttttacccattcctgaaggacaaccgggaaaagatcgagaagatcctg
accttcaggatcccctactacgtgggcccccctggccagaggcaacagcagattcgcctggat
gaccagaaaagagcgaggaaaccatcacccccctggaacttcgaggaagtggtggacaagggcg
ccagcgcccagagcttcatcgagagaatgacaaacttcgataagaacctgcccaacgagaag
gtgctgcccaagcacagcctgctgtacgagtacttcaccgtgtacaacgagctgaccaaagt
gaaatacgtgaccgagggaatgagaaagcccgccttcctgagcggcgagcagaaaaaggcca
tcgtggacctgctgttcaagaccaacagaaaagtgaccgtgaagcagctgaaagaggactac
ttcaagaaaatcgagtgcttcgactccgtggaaatctccggcgtggaagatagattcaacgc
ctcccctgggcacataccacgatctgctgaaaattatcaaggacaaggacttcctggataacg
aagagaacgaggacattctgaagatatcgtgctgaccctgacactgtttgaggaccgcgag
atgatcgaggaaaggctgaaaacctacgctcacctgttcgacgacaaagtgatgaagcagct
gaagagaaggcggtacaccggctggggcaggctgagcagaaagctgatcaacggcatcagag
acaagcagagcggcaagacaatcctggatttcctgaagtccgacggcttcgccaaccggaac
ttcatgcagctgatccacgacgacagcctgacattcaaagaggacatccagaaagcccaggt
gtccggcccagggcgaactctctgcacgagcatatcgctaacctggccggcagcccccgctatca
agaagggcatcctgcagacagtgaaggtggtggacgagctcgtgaaagtgatgggcagacac
aagcccgagaacatcgtgatcgagatggctagagagaaccagaccacccagaagggacagaa
gaactcccgcgagaggatgaagagaatcgaagagggcatcaaagagctgggcagccagatcc
tgaaagaacacccccgtggaaaacacccagctgcagaacgagaagctgtacctgtactacctg
cagaatggccgggatatgtacgtggaccaggaactggacatcaacagactgtccgactacga
tgtggaccatatcgtgcctcagagctttctgaaggacgactccatcgataacaaagtgctga
ctcggagcgacaagaacagaggcaagagcgacaacgtgccctccgaagaggtcgtgaagaag
atgaagaactactggcgacagctgctgaacgccaagctgattacccagaggaagttcgataa
cctgaccaaggccgagagagggcctgagcgagctggataaggccggcttcatcaagaggc
agctggtggaaaccagacagatcacaaagcacgtggcacagatcctggactcccggatgaac
actaagtacgacgaaaacgataagctgatccgggaagtgaaagtgatcaccctgaagtccaa
gctggtgtccgatttccggaaggatttccagttttacaaagtgcgcgagatcaacaactacc
accacgcccacgacgcctacctgaacgccgtcgtgggaaccgcccctgatcaaaaagtaccct
aagctggaaagcgagttcgtgtacggcgactacaaggtgtacgacgtgcggaagatgatcgc
caagagcgagcaggaaatcggcaaggctaccgccaagtacttcttctacagcaacatcatga
acttttttcaagaccgaaatcaccctggccaacggcgagatcagaaagcgccctctgatcgag
acaaacggcgaaaccgggagatcgtgtgggatagcgcagagacttcgccacagtgcgaaa
ggtgctgagcatgccccaagtgaatatcgtgaaaaagaccgaggtgcagacaggcggcttca
gcaaagagtctatcctgcccaagaggaacagcgacaagctgatcgccagaaagaaggactgg
gaccccaagaagtacggcggcttcgacagccctaccgtggcctactctgtgctggtggtggc
taaggtggaaaagggcaagtccaagaaactgaagagtgtgaaagagctgctggggatcacca
tcatggaaagaagcagctttgagaagaacccctatcgactttctggaagccaagggctacaaa
```

TABLE 16 -continued

Modified Streptococcus pyogenes Cas9

| SEQ ID | Sequence |
|---|---|
| | gaagtgaaaaaggacctgatcatcaagctgcctaagtactccctgttcgagctggaaaacgg<br>cagaaagagaatgctggcctctgccggcgaactgcagaagggaaacgagctggccctgccta<br>gcaaatatgtgaacttcctgtacctggcctcccactatgagaagctgaagggcagccctgag<br>gacaacgaacagaaacagctgtttgtggaacagcataagcactacctggacgagatcatcga<br>gcagatcagcgagttctccaagagagtgatcctggccgacgccaatctggacaaggtgctgt<br>ctgcctacaacaagcacagggacaagcctatcagagagcaggccgagaatatcatccacctg<br>ttcacctgacaaacctgggcgctcctgccgccttcaagtactttgacaccaccatcgaccg<br>gaagaggtacaccagcaccaaagaggtgctggacgccaccctgatccaccagagcatcaccg<br>gcctgtacgagacaagaatcgacctgtctcagctgggaggcgacaagagacctgccgccact<br>aagaaggccggacaggccaaaaagaagaagtgagcggccgcttaattaagctgccttctgcg<br>gggcttgccttctggccatgcccttcttctctcccttgcacctgtacctcttggtctttgaa<br>taaagcctgagtaggaagaaaaaaaaaaaaaaaaaaaaaaaaaaaaaaaaaaaaaaaaaaaa<br>aaaaaaaaaaaaaaaaaaaaaaaaaaaaaaaaaaaaaaaaaaaaaaaaaaaaaaaaaaaaaa<br>aaaaaaaaaaaaaa |

Example 10: AAV Screen

To identify novel AAV serotypes, PCR reactions were carried out, Table 17, on genomic DNA to amplify regions of the AAV signature region as shown in FIG. 25B. Control primers, 1-4 correspond to regions AV1NS, 19s, 18as, and AV2Cas (Gao et al., 2002).

TABLE 17

AAV Signature region primers

| SEQ ID NO | Primer | Sequence |
|---|---|---|
| 261 | 1 | GCTGCGTCAACTGGACCAATGAGAAC |
| 262 | 2 | GGTAATGCCTCAGGAAATTGGCA |
| 263 | 3 | GAATCCCCAGTTGTTGTTGTTGATGAGTC |
| 264 | 4 | CGCAGAGACCAAAGTTCAACTGAAACGA |
| 265 | 5 | ATGGCTGCCGATGGTTATCT |
| 266 | 6 | GCACCAATGGCAGACAATAAv |

PCR assays were set up as follow in Table 18.

TABLE 18

AAV serotype screen PCR assay primers

| Amplicon/PCR number | Forward primer | Reverse primer | Approximate amplicon size bp (based on AAV6) |
|---|---|---|---|
| 1 | 1 | 3 | 1746 |
| 2 | 2 | 4 | 1600 |
| 3 | 2 | 3 | 258 |
| 4 | 1 | 4 | 3088 |
| 5 | 5 | 3 | 921 |
| 6 | 6 | 3 | 297 |
| 7 | 6 | 4 | 1639 |
| 8 | 5 | 4 | 2263 |

PCR conditions were as follow in Table 19. PCRs were set up in 96 well plates. Controls to be included in each PCR run were: no template control (nuclease free water in the place of template as a negative control), liver DNA (positive signature region control) and two AAV helper plasmid positive controls (pDG and AAV DJ), FIG. 26A to FIG. 26E. A housekeeping gene, GAPDH, was included to confirm the quality of the T cell DNA samples.

TABLE 19

PCR conditions for AAV serotype screen

| Step | Temperature (° C.) | Time | Cycles |
|---|---|---|---|
| 1 | 97 | 1 min | 1 |
| 2 | 97 | 15 s | 42 |
| | 50 | 15 s | |
| | 68 | 45 s | |
| 3 | 68 | 10 min | 1 |

Example 11: AAV Chimera Transduction of CD34+ Cells and T Cells

CD34 Cells

In order to assess the effectiveness of homologous recombination of AAV chimeras in multiple cell types CD34+ cells were transduced with WT AAV6 or AAV chimeras 3, 5, or 6 (CMV NanoLuc virus) at a MOI of 10,000 GC/mL. AAV6 virus and CRISPR (gRNA+Cas9) were used as controls. On day 7 post transduction cells were assayed for luminescence (RLU).

Figure 28A:
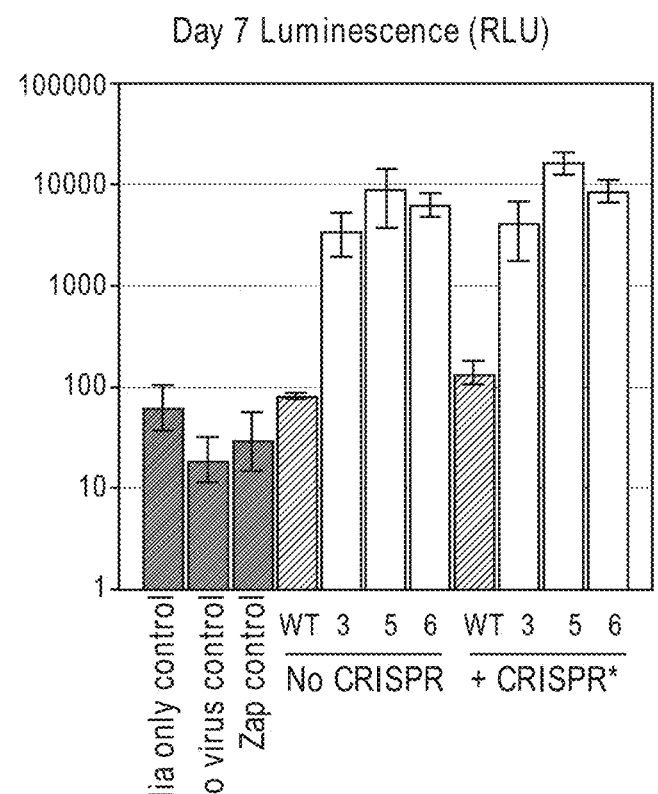
FIG. 28A shows a summary of luminescence (RLU) on day 7 post transduction of CD34+ cells with WT-AAV6 or chimeras 3, 5, or 6 (CMV NanoLuc virus) at MOI of 10,000 GC/mL. Virus only and Virus+CRISPR are shown as controls.
Figure 28B:
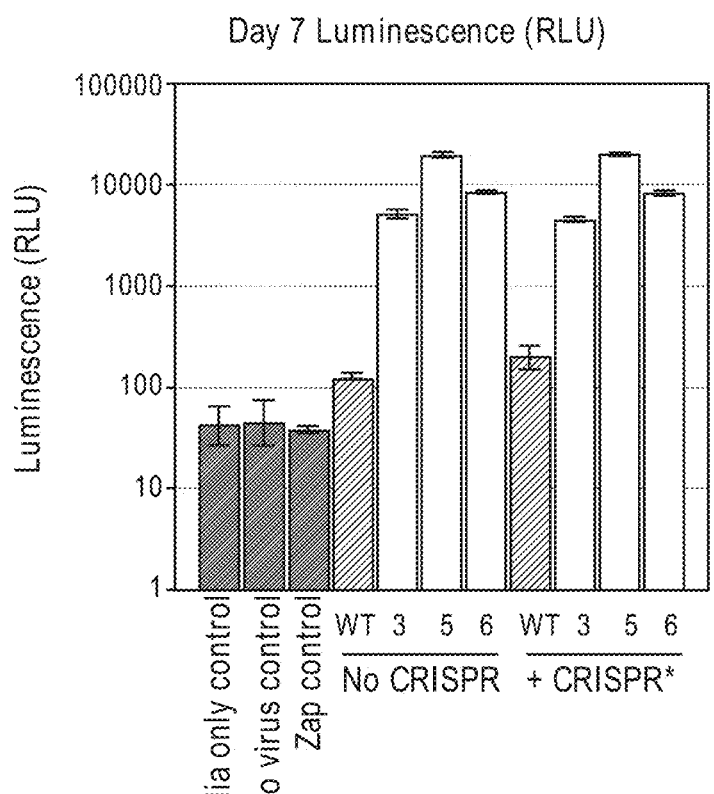
FIG. 28B shows a summary of luminescence (RLU) on day 7 post transduction of T cells with WT-AAV6 or chimeras 3, 5, or 6 (CMV NanoLuc virus) at MOI of 10,000 GC/mL. Virus only and Virus+CRISPR are shown as controls.

Results show that as compared to WT, chimeras 3, 5, and 6 show superior infectivity in CD34+ cells, about 100×, FIG. 28A, and FIG. 28B.

T cells transduced with chimeras 3, 5, or 6

In order to assess the effectiveness of homologous recombination of AAV chimeras in cells, T cells were were transduced with WT AAV6 or AAV chimeras 3, 5, or 6 (CMV NanoLuc virus) at an MOI of 10,000 GC/mL. AAV6 virus and CRISPR (gRNA+Cas9) were used as controls. CRISPR editing was confirmed by TIDE to have 88% editing efficiency. On day 7 and day 14 post transduction cells were assayed for luminescence (RLU).

Figure 30A:
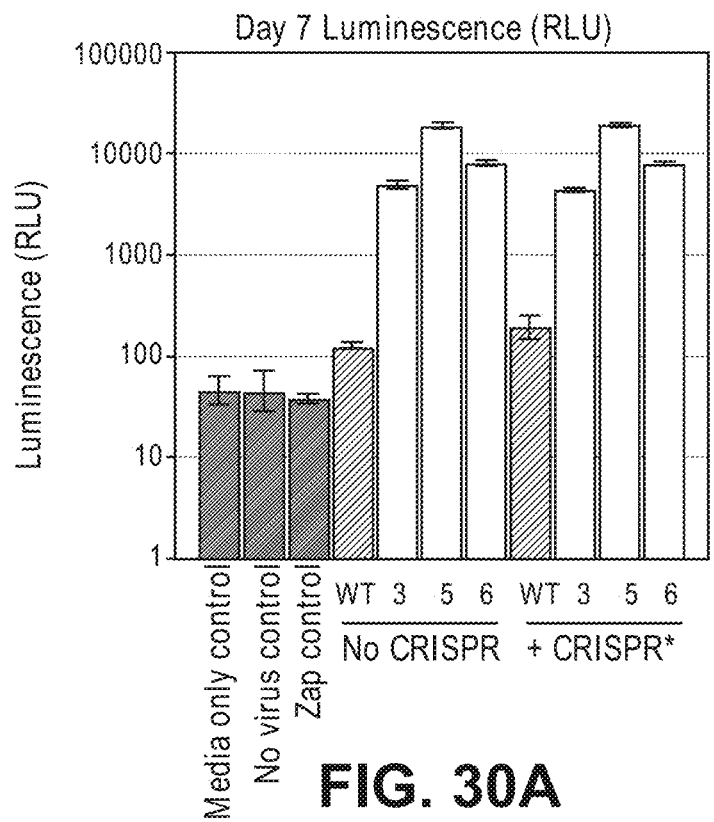
FIG. 30A shows a summary of luminescence (RLU) on day 7 post transduction of T cells with WT-AAV6 or chimeras 3, 5, or 6 (CMV NanoLuc virus) at MOI of 10,000 GC/mL. Virus only and Virus+CRISPR are shown as controls.
Figure 30B:
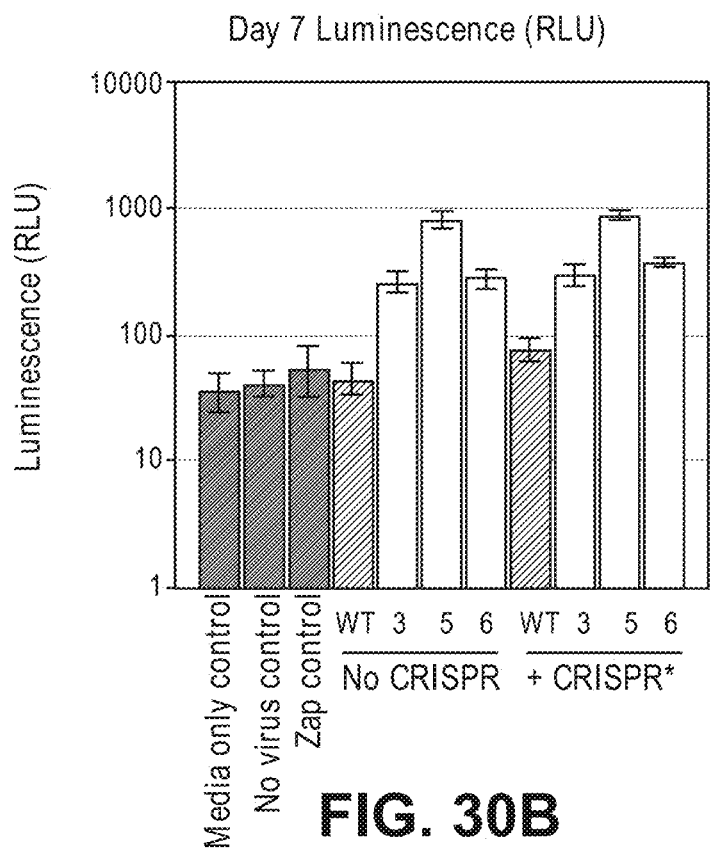
FIG. 30B shows a summary of luminescence (RLU) on day 14 post transduction of T cells with WT-AAV6 and chimeras 3, 5, and 6 (CMV NanoLuc virus) at MOI of 10,000 GC/mL. Virus only and Virus+CRISPR are shown as controls. CRISPR editing confirmed by TIDE analysis at 88% editing efficiency.

Results show that, as compared to WT, chimeras 3, 5, and 6 show about 100× superior infectivity in T cells, FIG. 30A, and FIG. 30B.

T Cells Transduced with Chimera 6

To determine how chimera 6 (at an MOI OD of 1e4 GC/mL) compares to WT AAV6 at an MOI of 1e6 GC/mL, T cells were infected with WT AAV6 and chimera 6 (CMV NanoLuc virus) at an MOI of 1e6 or 1e4 GC/mL.

Figure 31:
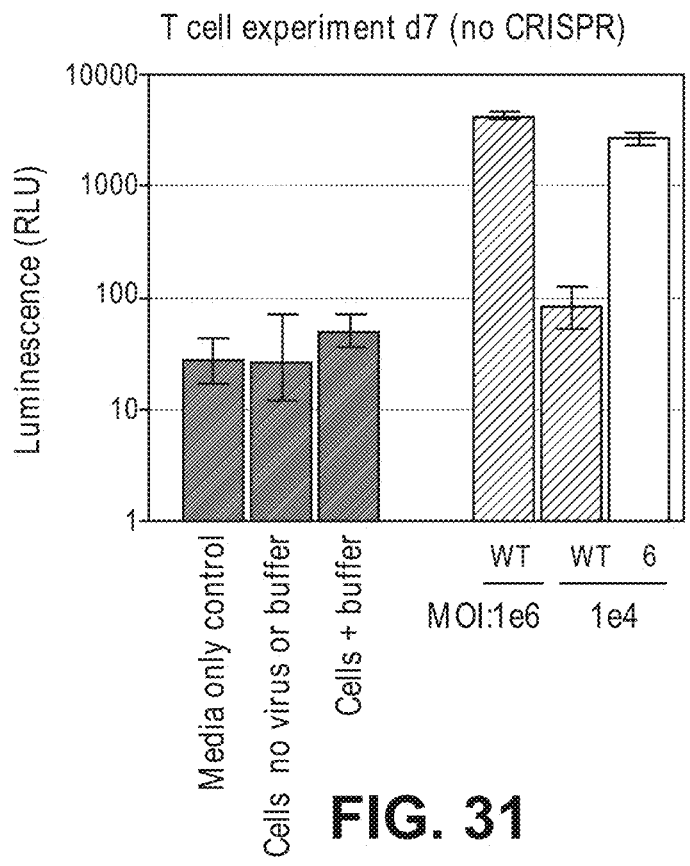
FIG. 31 shows luminescence (RLU) on day 7 post transduction of T cells with WT-AAV6 or chimeras 3, 5, or 6 (CMV NanoLuc virus) at MOI of 1e4 GC/mL or 1e6 GC/mL. RC stands for Rep Cap and refers to the amount of rep/cap plasmid used in the transfection.
Figure 32A:
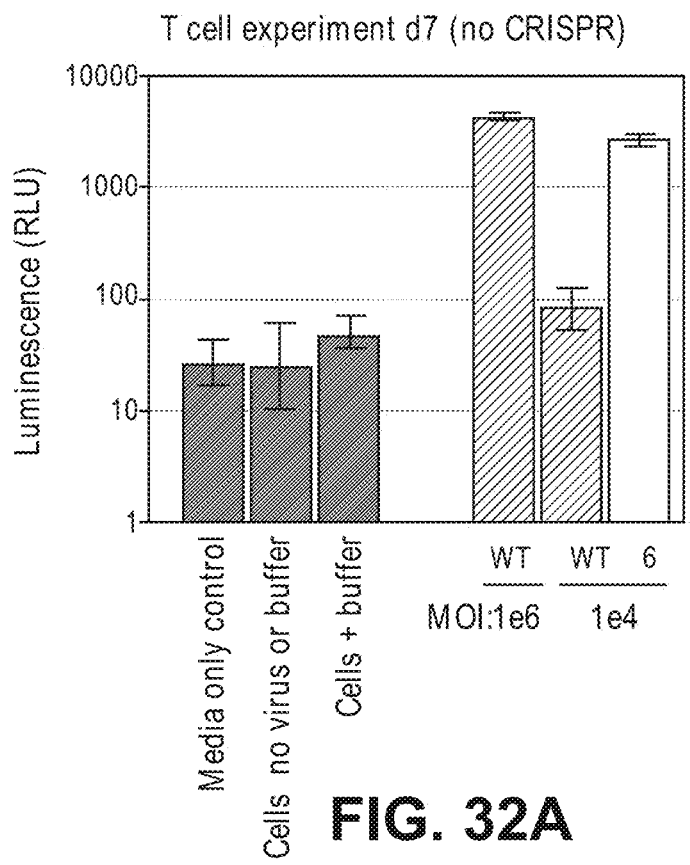
FIG. 32A shows luminescence (RLU) on day 7 post transduction of T cells with WT-AAV6 or chimera 6 (CMV NanoLuc virus) at MOI of 1e4 GC/mL or 1e6 GC/mL.
Figure 32B:
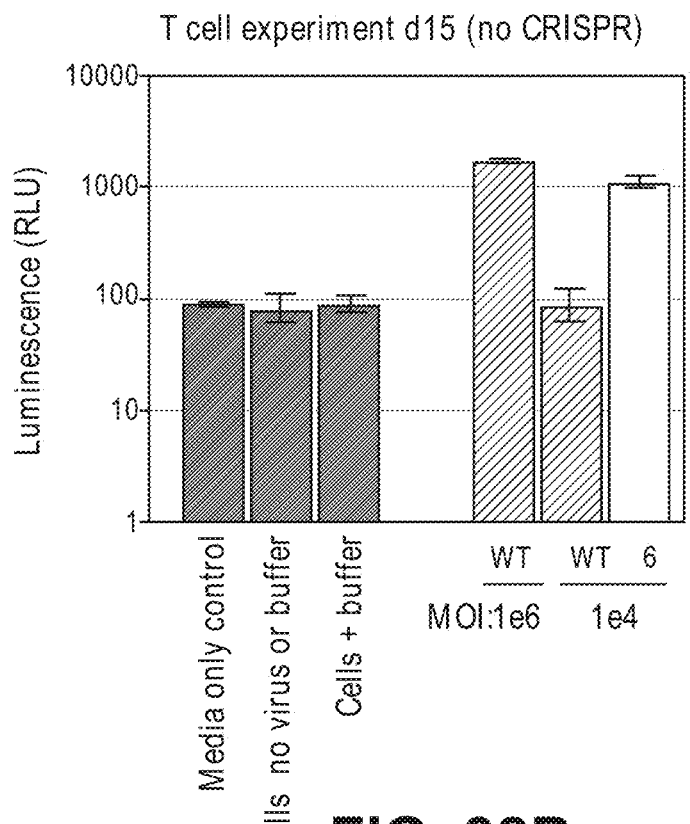
FIG. 32B shows luminescence (RLU) on day 15 post transduction of T cells with WT-AAV6 or chimera 6 (CMV NanoLuc virus) at MOI of 1e4 GC/mL or 1e6 GC/mL.
Figure 32C:
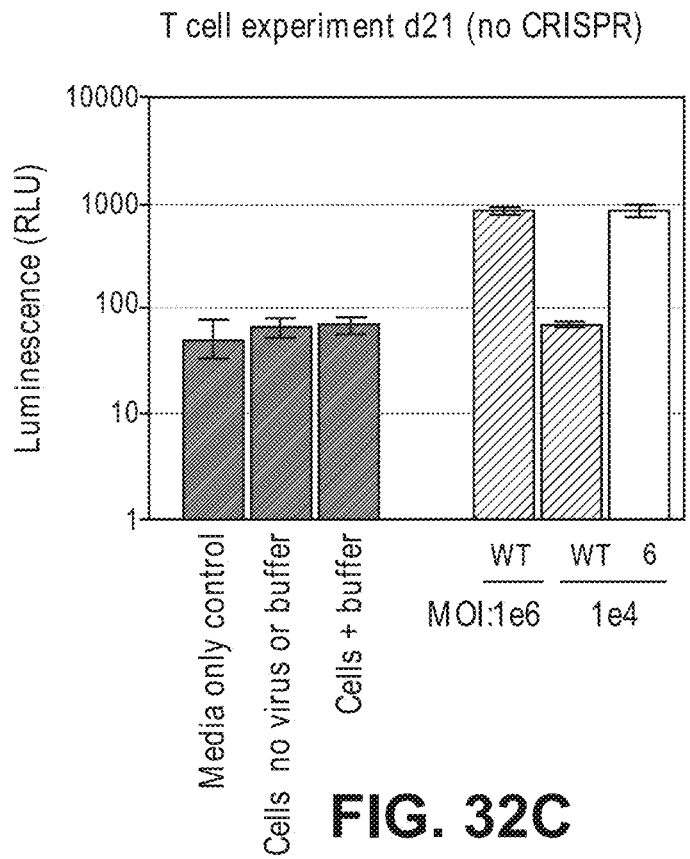
FIG. 32C shows luminescence (RLU) on day 7 post transduction of T cells with WT-AAV6 or chimera 6 (CMV NanoLuc virus) at MOI of 1e4 GC/mL or 1e6 GC/mL.

NanoLuc results show that as compared to WT, chimera 6 shows superior infectivity in T cells, FIG. 31, day 7 (FIG. 32A), day 14 (FIG. 32B), and day 21 (FIG. 32C). Results are being validated in comparable experiment utilizing a GFP reporter.

TABLE 20

Chimera Data Summary

| Chimera | Virus Titer (GC/nil) | | | | T cell NanoLoc titration Experiment (Luminescence RLU)* | | | NanoLoc experiment without CRISPR (Luminescence RLU)* | |
|---|---|---|---|---|---|---|---|---|---|
| | $1^{st}$ order | $2^{nd}$ order | $3^{rd}$ order qPCR | $3^{rd}$ order ELISA | 1st Experiment (day 14) | 2nd Experiment (day 14) | | CD34 + cells (day 7) | T cells (day 7) |
| 1: WT AAV 6 | 1.90E+13 | 1.21E+13 | 1.20E+13 | 3.74E+12 | 30 | 119 | 38 | 84 | 124 |
| 2: AAV 5VP1 u-AAV 6VP2/3 | 3.55E+13 | 2.44E+13 | | | 89 | 68 | 54 | | |
| 3: AAV 4VP1/2-AAV 6VP3 | 5.59E+10 | 2.23E+10 | 2.19E+11 | 5.34E+10 | 5953 | 19950 | 5243 | 3596 | 5014 |
| 4: AAV 5VP1/2-AAV 6VP3 | 1.76E+13 | | | | 56 | 59 | 37 | | |
| 5: AAV11 VP1/2-AAV 6VP3 | 7.45E+10 | 5.54E+10 | 2.46E+10 | 3.56E+09 | 553 | 5265 | 1194 | 9445 | 18944 |
| 6: AAV12 VP1/2-AAV 6VP3 | 3.89E+09 | 4.21E+09 | 3.45E+10 | 4.58E+09 | 33606 | 45290 | 8801 | 6536 | 8055 |
| 7: AAV 4VP1 u-AAV 6VP3 | 2.53E+13 | | | | 50 | 134 | 46 | | |
| 8: AAV 12VP 1u-AAV 6VP2/3 | 4.34E+13 | | | | 53 | 173 | 65 | | |

SEQUENCE LISTING (309 sequences)

SEQ ID NO: 1 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 2 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggaggtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 3 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgagaacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 4 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaataaccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 5 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatcaccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 6 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatgaccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 7 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatcttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 8 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatattatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 9 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 10 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 11 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatgaccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 12 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgagaacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 13 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatcaccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 14 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgagaacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 15 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatgaccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 16 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaataaccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 17 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatcaccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 18 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatcttatgggagccttacctggaatggtgtggcaagacagagacgtatacctgcagggtcctatttgggccaaaattcctcacacggatggacactttcacccgtctcctctcatgggcggctttggacttaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 19 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctttaggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatattatgggagccttacctggaatggtgtggcaagacagagacgtatacctgcagggtcctatttgggccaaaattcctcacacggatggacactttcacccgtctcctctcatgggcggctttggacttaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 20 - protein, 736 aa, Adeno-associated virus 6
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 21 - protein, 734 aa, Adeno-associated virus 4
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 22 - protein, 724 aa, Adeno-associated virus 5
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 23 - protein, 733 aa, Adeno-associated virus 11
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPARKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSSSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFECANNFEKVPFHSMYAHSQSLDRLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRWNPEVQFTSNYGNQSSMLWAPDTTGKYTEPRVIGSRYLTNHL

SEQ ID NO: 24 - protein, 742 aa, Adeno-associated virus 12
MAADGYLPDWLEDNLSEGIREWWALKPGAPQPKANQQHQDNGRGLVLPGYKYLGPFNGLDKGEPVNEADAAALEHDKAYDKQLEQGDNPYLKYNHADAEFQQRLATDTSFGGNLGRAVFQAKKRILEPLGLVEEGVKTAPGKKRPLEKTPNRPTNPDSGKAPAKKKQKDGEPADSARRTLDFEDSGAGDGPPEGSSSGEMSHDAEMRAAPGGNAVEAGQGADGVGNASGDWHCDSTWSEGRVTTTSTRTWVLPTYNNHLYLRIGTTANSNTYNGFSTPWGYFDFNRFHCHFSPRDWQRLINNNWGLRPKSMRVKIFNIQVKEVTTSNGETTVANNLTSTVQIFADSTYELPYVMDAGQEGSFPPFPNDVFMVPQYGYCGVVTGKNQNQTDRNAFYCLEYFPSQMLRTGNNFEVSYQFEKVPFHSMYAHSQSLDRMMNPLLDQYLWHLQSTTTGNSLNQGTATTTYGKITTGDFAYYRKNWLPGACIKQQKFSKNANQNYKIPASGGDALLKYDTHTTLNGRWSNMAPGPPMATAGAGDSDFSNSQLIFAGPNPSGNTTTSSNNLLFTSEEEIATTNPRDTDMFGQIADNNQNATTAPHIANLDAMGIVPGMVWQNRDIYYQGPIWAKVPHTDGHFHPSPLMGGFGLKHPPPQIFIKNTPVPANPNTTFSAARINSFLTQYSTGQVAVQIDWEIQKEHSKRWNPEVQFTSNYGTQNSMLWAPDNAGNYHELRAIGSRFLTHHL

SEQ ID NO: 25 - protein, 735 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 26 - protein, 735 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 27 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 28 - protein, 736 aa, Artificial Sequence
  Description of Artificial Sequence: Synthetic polypeptide
MAADGYLPDWLEDNLSEGIREWWALKPGAPQPKANQQHQDNGRGLVLPGYKYLGPFNGLDKGEPVNEADAAALEHDKAYDKQLEQGDNPYLKYNHADAEFQQRLATDTSFGGNLGRAVFQAKKRILEPLGLVEEGVKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 29 - protein, 730 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 30 - protein, 726 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 31 - protein, 730 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPARKRLNFEEDTGAGDGPPEGSDTSAMSSDIEMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 32 - protein, 739 aa, Artificial Sequence
  Description of Artificial Sequence: Synthetic polypeptide
MAADGYLPDWLEDNLSEGIREWWALKPGAPQPKANQQHQDNGRGLVLPGYKYLGPFNGLDKGEPVNEADAAALEHDKAYDKQLEQGDNPYLKYNHADAEFQQRLATDTSFGGNLGRAVFQAKKRILEPLGLVEEGVKTAPGKKRPLEKTPNRPTNPDSGKAPAKKKQKDGEPADSARRTLDFEDSGAGDGPPEGSSSGEMSHDAEMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 33-37 - skipped (5 entries)

SEQ ID NO: 38 - DNA, 2529 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 39 - DNA, 2529 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 40 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgctgacggttatcttccagattggctcgaggacaacctctctgagggcattcgcgagtggtgggacctgaaacctggagccccgaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaacctctgggcctggttgaagaaggtgctaaaacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 41 - DNA, 2532 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgctgacggttatcttccagattggctcgaggacaacctctctgaaggcattcgcgagtggtgggcgctgaaacctggagctccacaacccaaggccaaccaacagcatcaggacaacggcaggggtcttgtgcttcctgggtacaagtacctcggacccttcaacggactcgacaagggagagccggtcaacgaggcagacgccgcggccctcgagcacgacaaggcctacgacaagcagctcgagcagggggacaacccgtatctcaagtacaaccacgccgacgccgagttccagcagcgcttggcgaccgacacctcttttgggggcaacctcgggcgagcagtcttccaggccaaaaagaggattctcgagcctctgggtctggttgaagagggcgttaaaacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 42 - DNA, 2514 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 43 - DNA, 2502 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 44 - DNA, 2514 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgctgacggttatcttccagattggctcgaggacaacctctctgagggcattcgcgagtggtgggacctgaaacctggagccccgaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaacctctgggcctggttgaagaaggtgctaaaacggctcctggaaagaagagaccgttagagtcaccacaagagcccgactcctcctcgggcatcggcaaaaaaggcaaacaaccagccagaaagaggctcaactttgaagaggacactggagccggagacggaccccctgaaggatcagataccagcgccatgtcttcagacattgaaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 45 - DNA, 2541 bp, Artificial Sequence
  Description of Artificial Sequence: Synthetic polynucleotide
ggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgctgacggttatcttccagattggctcgaggacaacctctctgaaggcattcgcgagtggtgggcgctgaaacctggagctccacaacccaaggccaaccaacagcatcaggacaacggcaggggtcttgtgcttcctgggtacaagtacctcggacccttcaacggactcgacaagggagagccggtcaacgaggcagacgccgcggccctcgagcacgacaaggcctacgacaagcagctcgagcagggggacaacccgtatctcaagtacaaccacgccgacgccgagttccagcagcgcttggcgaccgacacctcttttgggggcaacctcgggcgagcagtcttccaggccaaaaagaggattctcgagcctctgggtctggttgaagagggcgttaaaacggctcctggaaagaaacgcccattagaaaagactccaaatcggccgaccaacccggactctgggaaggccccggccaagaaaaagcaaaaagacggcgaaccagccgactctgctagaaggacactcgactttgaagactctggagcaggagacggaccccctgagggatcatcttccggagaaatgtctcatgatgctgagatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggt

SEQ ID NO: 46 - protein, 196 aa, Artificial Sequence
  Description of Artificial Sequence: Synthetic polypeptide
LATQSQSPTHNLSENLQQPPLLWDLLQWLQAVAHQWQTITKAPTEWVMPQEIGIAIPHGWATESSPPAPEHGPCPPITTTSTSKSPVLQRGPATTTTTSATAPPGGILISTDSTAISHHVTGSDSSTTIGDSGPRDSTSSSSTSKSRRSRRMMASRPSLITLPARFKSSRTRSTSCRTSSALRTRAASLRSRRTCS

SEQ ID NO: 47 - protein, 198 aa, Artificial Sequence
  Description of Artificial Sequence: Synthetic polypeptide
LNPPSSPTPPRVSAKKASSRLKRSSFSKTKLEQATDPLRDQLPEPCLMTVRCVQQLAELQSRADKVPMEWVMPRVIGIAIPPGLRATSRPPAPEPGSCPPTTTTSTSDSERACSPTPTTDSPPPGDTLTSTASTATSHHVTGSDSSTTTGACDPKPCGSKSSTSRSRRSRRRTARQRWLITLPARFRSLRTRRTNCRT

SEQ ID NO: 48 - protein, 226 aa, Artificial Sequence
  Description of Artificial Sequence: Synthetic polypeptide
TTTFQKERRLGPKRTPSLPPRQTPKLDPADPSSCKSQPNQPQVWELIQCLREVAAHWATITKVPMEWAMPREIGIAIPRGWGTESSPSPPEPGCCPATTTTSTERSKAAPSTEATPTPTLDTAPPGGTLTLTASTATGAPETGKDSSTTTGASDPGPSESKSSTFKSKRSRCRTPPPPSPTTSPPPSKCLRTTTTSCPTSSATGPRDACRPSLRRSLRCRSTVTRR

SEQ ID NO: 49 - protein, 197 aa, Artificial Sequence
  Description of Artificial Sequence: Synthetic polypeptide
SHHKSPTPPRASAKKANNQPERGSTLKRTLEPETDPLKDQIPAPCLQTLKCVQHRAEMLSMRDKVPMEWVMPRVIGIAIPPGLRARSQQPRPEPGSCPPTTTTCTCVSEQHQAATPTTDSPPPGDILTSTDSTVTSHHVTGKDSSTTTGDYDQKPCALKSSISKLRRSQRRTARLRSLITLPARFRYLRTRRMSSRT

SEQ ID NO: 50 - protein, 206 aa, Artificial Sequence
  Description of Artificial Sequence: Synthetic polypeptide
KRLQIGRPTRTLGRPRPRKSKKTANQPTLLEGHSTLKTLEQETDPLRDHLPEKCLMMLRCVRRQAEMLSRRDKVPMEWVMPPVIGIAIPPGQRAESPPPAPEPGSYPRTTTTCTCESEQRPTATPTTDSPPPGDTLTLTASTATFPHATGSDSSTTTGDSGRNRCVLKSSTYRSRRSRRQTARLRSLITLPARFRSLRIRRMNSHT

SEQ ID NO: 51 - protein, 220 aa, Artificial Sequence
  Description of Artificial Sequence: Synthetic polypeptide
LNPPSSPTPPRVSAKKASSRLKRSSFSKTKLEQATDPLRDQLPEPCLMTVRWLQAVAHQWQTITKAPTEWVMPQEIGIAIPHGWATESSPPAPEHGPCPPITTTSTSKSPVLQRGPATTTTTSATAPPGGILISTDSTAISHHVTGSDSSTTIGDSGPRDSTSSSSTSKSRRSRRMMASRPSLITLPARFKSSRTRSTSCRTSSALRTRAASLRSRRTCS

SEQ ID NO: 52 - protein, 217 aa, Artificial Sequence
  Description of Artificial Sequence: Synthetic polypeptide
TTTFQKERRLGPKRTPSLPPRQTPKLDPADPSSCKSQPNQPQVWELIQWLQAVAHQWQTITKAPTEWVMPQEIGIAIPHGWATESSPPAPEHGPCPPITTTSTSKSPVLQRGPATTTTTSATAPPGGILISTDSTAISHHVTGSDSSTTIGDSGPRDSTSSSSTSKSRRSRRMMASRPSLITLPARFKSSRTRSTSCRTSSALRTRAASLRSRRTCS

SEQ ID NO: 53 - protein, 219 aa, Artificial Sequence
  Description of Artificial Sequence: Synthetic polypeptide
SHHKSPTPPRASAKKANNQPERGSTLKRTLEPETDPLKDQIPAPCLQTLKWLQAVAHQWQTITKAPTEWVMPQEIGIAIPHGWATESSPPAPEHGPCPPITTTSTSKSPVLQRGPATTTTTSATAPPGGILISTDSTAISHHVTGSDSSTTIGDSGPRDSTSSSSTSKSRRSRRMMASRPSLITLPARFKSSRTRSTSCRTSSALRTRAASLRSRRTCS

SEQ ID NO: 54 - protein, 228 aa, Artificial Sequence
  Description of Artificial Sequence: Synthetic polypeptide
KRLQIGRPTRTLGRPRPRKSKKTANQPTLLEGHSTLKTLEQETDPLRDHLPEKCLMMLRWLQAVAHQWQTITKAPTEWVMPQEIGIAIPHGWATESSPPAPEHGPCPPITTTSTSKSPVLQRGPATTTTTSATAPPGGILISTDSTAISHHVTGSDSSTTIGDSGPRDSTSSSSTSKSRRSRRMMASRPSLITLPARFKSSRTRSTSCRTSSALRTRAASLRSRRTCS

SEQ ID NO: 55 - DNA, 2211 bp, Adeno-associated virus 6
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 56 - DNA, 187 bp, Streptococcus pyogenes
atggactataaggaccacgacggagactacaaggatcatgatattgattacaaagacgatgacgataagatggccccaaagaagaagcggaaggtcggtatccacggagtcccagcagccgacaagaagtacagcatcggcctggacatcggcaccaactctgtgggctgggccgtgatcaccgacg

SEQ ID NO: 57-62 - skipped (6 entries)

SEQ ID NO: 63 - DNA, 18764 bp, Homo sapiens
gactcccaggcccgaggactcctggaagggaggtgagtgtggcgctgaggaagcggcgggacggatgcgagcccgggaggagcgcgctggggggccgcaggcgggggatgtggcgcggtccaggcccgtcgcggcctcgtcctgacagggacacctgcgggatcgtccttccaggatcgcctgcgggcctcgcgggccgatgcctcgggtccccctccggcctcggtttctccgcgcagcggggcggggcgggggcagcgcgggtctcaaagctgcctgcagggggcgcccgtgagcggcgcggccggagccggagacccagcggccgccgagacagcgggagccggcgtgcgagcggcaggtcagccggggtgctaggtctggcgtgcggggtcctgggtgccgggtccggggtgcggggtgccgggggtccggggctggtggccgggcggcgtggggccgtcgggggtgcggggccgggaggactgggaggctggggttctgctcccctcagggttcctttcccgccgccccgagaccagttccccggcgcggggtccgagtcctgccccgcggcggctgccggcactgcctgtgaagggcccaggcacagtcacgtcccaggcgcagttgcggcgccgcgtgcgggaccctccgagctgtcccaaactgcaccggaaggcgcgcaggggtaggcggggagggaaggcaagtgcggcggccggcgcggcgcggggtgcggagccgcaggtagcgggcggggagcgtccgtccgtcagtccgtccgtccgtccatgcgccgcagaccggccccgcgcgctcgcatgaaccttcgcgagctcctccagcagggatggaccgggggcgcagaggcgcttcctgaggggtggcgggccgggccccggggcgagggagattccccaggtggaggagccgggcggagaccggttccccgggaaggtgaggcgcgggcagagatacccgagcgcccgggacgcgccgagaaagggggaatcaggaacgctgggccgagcgctggcgtcttccgtggacagtggtggcgggaactgggtttgggggacccaggagacgacgggggacggatgggggtgggtgcgcgcctcggactggccccggccgtctgtctggctgcccggagcggaggtaggaatggcgggaatggtggcggctctcgagggatttggcgcaaggcggcccaagggcttgaggaggaggccgcgggccggcagagctgaggtccctgtgtcccgcactcagactttagttgccccgactgtaccatgggaggaagagggagacccagggctgggtcctaggctgggggagtcggggccctgcaaagacgcgcaggtgtttgtggcccttgttggagggtgagccgcaggtcaagccagccctccgtcgccatcctgaagcacctcctctcttgggctctgccacacacagggccttctcccctattgccaggtgctcaggccgcctccaccctgcctctgctgccggctccccctgggttccccggcggggcaccctgccgatactccatgacgcgccagggctgccccagggtgccccagccctggggaccatggtggagggttctgtggagcaccgcgggcctgggaagctgttgcggggtcggggcttcctcactggccctgctttggccgttcctggaggccttgggtggggctgggaaggccgggccctgtgggcagcaccccccccccccccgcccaacatcccggcagatccatggcaggggcgcctcacaggctggtccacggccacggtgtcagtccctccttgttctgcgcttgctttttggggtctcccagcctctccctagtcctagagtttctcaggcaaatcccagccactacccctccatccgtgtcccctgtttccccagtgctgagctggctgagctgtgagctttcctgctccttgcctcaggaagccaggggcagcccagtcacctctggccagaggcgggccttaggccaaggctgacctggctggtctgagagctgtgctgggcttcttcccatatcagtctgtgaattacagatccccaaatatgccctgcgtcgcgatggaggagggcaatcaatggcaatgactgcctcatgggcaacgcgatgtgctggagatttcagtgctctcgtctgggttctggtcttgcctcctcgacccactcgctgagcaggttgctgtcccggggaatctgatatctcatctgtagaacaaggatgatgatcttagcaatgcctaatgtggaaaggccttggcttgggagcaagtgggggaaggtttagggcagaccagagggccggtgaggggtgtgtgctggagcggggaacccgggagggagggtgttaggcttgagggtcaggggacaccacagggattgctgttggcagagggacatatgaatggtagttggcctgggagccagcatgtgacttgagagcatcacgtcctgcaaagtccaggtgaggcctgggcagtgcctgctgtgtgggaccacagcccctggtggctctcagctgtgtcctgacactccaaagaaggtcttagtaccctctcacagacctaatacccgagccacctaaccccaaatgagctagaactgccttcccaaccgtgtttgcggggtctgtcttgtctattgcagcgcaaacagagccctgagcacgcaggagagcagaggaaggacagacagaagatggatggatggatgaaggcgggaagcacaggctgaggggatttagggcatgtgtggtgggggtgctgtggagaggagactgcacaggcaggagctgagctggtgaatgggagggttctagctcccagaagggtctgggccattgacaggaggggcttggtcctaggaggtgggtggtccagaggttgcaaggagcagaggagcccagatggggaagggaatggagctggggtgcagagaggagcccccacacaactgcccacatcctgtgcagaacctggggctctgggtggtgggaagaggcagtttcatggcggaggaggcctgggcccctgcagcctggactccatggatctggccagggactggggaggatcaggtggagagaggagcagcagagcagctgcccctcgtcccagcacaggggatgatgggagcccagggaaggcaggaccctggcttcgggcattttctctgctagaatctctcgatacctctctcccttcaccttctcctccaagtctcacccagatgatgtttctgtgagttgccatggggattctctcaccaccccccgccaacaccccgcaggggaagcttgttccaggagtcactgggcaggggctgctgctgctcttctgtgcccactcctcggatgtgccgctgcagccctggtctctggcatcggccgtcacctggtggagaggctgccggagctggccaagcagagggaggccgatggtgccacttggtgtctcctctggcatctgggcaggagacttctccccagaggccccgggctggtctgcccgtgtcacaggaggactcgcctctggtccctcagtggcctctgcaaaccctgagccagcctgggggaggctgctcagtggggaagaagcagtggccaggctctgcttggtcaccctgccctcctgtcagcctccggggctgcctcgtcgcacctgcccagggacccaacagccggtcctcacccctcccatcctcattgcagccaccctggggcattgtgaggccctgcacccagcactgccccttcaagcctcccacagggtcccgcccaggactcctgggctctgtgtccgcggggccatctagaaacactcccttgtccccccttcagcggcatagtacctgttgcccgccatctgagggaggtgcaggtgccaatccttcacgtgacgtgacgtggctcaccacagcctgtgtacatgtgagcagccgcgtgcagaggggaagctctgcctgggcctcagggactgtgacatggagcaggagccgcccccagccaagctgctttcagcacagcgtgggcccccagcaccttggtgcggggtgcggcccctcggaggagggctgtcaggtgaagcctcgtgtgagggggtgagtggcccccaggcggggaggagggggtgctgtggccttcctggcccctagcctggacacatgggggtgtggggagcaggagctggggcccccagcactggccccggggctgcgatgtgggggctgctctgtgaggcaggctcagagccttagcctccagctgcagggagctgggtcttggccccatcttgcccacatcctgccaccaggagcagagagctgcagctgcacccgggctgtgggggagggatgccaggtgtatctctgggtcccgggcccagcctgcacccagcgcctgaagtaagggccaccgggcagccccggaggtcaggagggaagtggagcccgtgctgggtggctgcttaccactgggcagtgaggaaggcacctgcgctgatgagtttggaaggggtatggggatcctggggccctgggttctgggaggttcatgcccaggcccccctgggccatcccaaaagccagtcatagtggggcccacaacctgccgtgccctgccgagctcccgcaagccacttgttgatgcttctcagtccaccccatgcctctcaaccgtttcctcctagactaggtctcttcatggcgtttctgggagaattcctcagtactagcttcagatccccagtcgtctcttccactgtacgtgtgcctgaagctcaccacatcccttacttcagtccttctatttttcagtccctggattttgtattatttcttgttcatatccacctgtccttgtttcatttccgccagtcggttcagaagttctcattcttgtctacggatgccattcctttctttgcctctttggagattctaaaggtctctgaaatcattattagattactgtattaccttccttcctactggaatgaattcacctccatgttttttattctgttgcttacctttcttagccttcatatacctcttgcgctttgaaattgatttgcgactcctcttagctgagccaatgttgtggagacagggagtggcctgcagtgcctgaaactgcagggcagcagccgcctcccaggaatgtcctgggtcctttcctcctttgaggtcccctgccatatgctcagatggggccaggcacagcaacgggggcacacctccctttggcccagcagttggggtgctgccaggcctggtggaggtacttggtaaacatttgttatggaaaagcagcaggagggttctaaggctgggattctggagcccaggaacaggccaggcatggctggagcgggtccgagtccgtgcactgtgtcctgtatgttgctcttagccgcactcaggagcagatgtgcaggtcactgcctagaagctggtgggcacctccgtgcagcaggctctggggggtatagccaccatctgggcatgtgtacagagggccttgctagtgcgacatatgaggaaccagaagatgtgtgggttttgattaaatggagttttaattaaagtggccaggttgggggaggtgaggaggaaggcaggaagcagcagcagttttgagtctgaccgcgtggaatcctataaggtggttctttcaagaggcattatgcacattccgcagcatgtgtcccctgtctgtatggggcagcatctgccctctgatctgtccccaacaaggggtaatcacagagaagtattacattattaatatttaatttcccctcctggttagcaacagatgactcaaggagtaattagatgcacagagccaacagagagggataggaaattgccagatcctggccccgccccctccccggggcctctgaccttcctgtcactctgggaggcttctgagggaggggagctggaggcccaggagccttcctgctgctgtgctctctgtgcgcacggccgcagccctacaccaccttccagtgctcttggtgaggctgagagaggtcgcttcgtgcctttgggcctcagtttcctcatctgtaaaatgggcttcctgggaccagcaagatcacagatgacagtcatttcccaagctcctaagcaggctgcacaagctgtgtctgagggtccagtgcagtgcctggcctctaggcaggtgccccctgggacgcgtaaggtttggcagctcagcagtgactggcatcgtggccagctgactctgtgttgctccccagttacggtccacgacacattagtagcttgaaactgggcacaaggggagaatttacaccacagaaatcaggcaaagcctgtaagtcagggtgcccccggccaggagctgatttgccagcctacggctgggtagctcccaacctttccccaatgaatgcactcctcttcccctgtctgccccaaaggtgcctctgactccactgatctgctttgctcagggccgagaaaggcacagctgagagtggattctggcttggcaggggcccaggttgcctgtgggtccgggcaagcctcacccgggatgtgctggcagcagctgggagagcctgcaggagtgcttaaggaggggctgagggagaggacgggcagcgaggtggcctgtgtggaccctgctggcaggagccgtgggtgtctttagccccgtgtgaggccggcctgggcagaggggtctgttgctgtcactgaggctggtgggcagcaggaaggtggcttcagtatagtcaagaaggttatcggtatctagtgctgtttagcatggggacccacagcacagaaggtggggagaccctgagaacgggggtacacaggcaggtacccagggctgccagggaagccttgccaaacagaggccctggtcaggcttctcccaaactgggcatcccagctggcatggcaccagtccagcccgtgaggcaggcgccgatgatttgaccccaccagcagggctctgggtgatgggactggggagtcctccttcactttggcagacgtgttatgttccaccttgtttgcccccagcaaggcccttgaatctggagcgtggtctggggctgcatcagccttctagcctgggatggtcagattggcagaaggctgtggcatccttcaatgcagatgccctagagagggccgtggtgggaggcaggatccctgggtagaggcggctcctcagtggcccactgggcctcactggacagtcgcctgttgctgctgctggtggtgctgggcctgggagtccaccttggagccacaggccaggcacctgggtgggaggcagcccggggccagcaccagctccacttgtacctgttgggcaggggctatcgtgagtcaggtgggccctggtgagtactgctcagggagagaggccaagagcatcagggataactgtgttccttgagtgtggccagggatggtgccaggagagctggtctggtgcatccctgccaacgacacactttgtgaatggctgcctggcaagtgctccatggaaagcaggggcttgggaggactcggccctctccagctgctgcaggccctccgttgctgcagggtttctggctctgctctctccttcctcctcctgcttctgtgtcaatgctccattcccaggctcctagtaggggcaaaagggcctgctgggtgcaggagaacctccagtcccaggtatggctgcagcccgtgccaatcctgttccagccacttgaggtgccgacagcattggagttggagggaaagttggggtctgtgtgtttgagctctgtcacatggacaatggggtagaggggagcctggccctttgaacagggctcaggaccaggagtgacttcctctccaggttgccagtcctgctccatccctcatgtcctggaagagagagagagacgaggtggctgcccgagtccacgtgaaaggcagcctctgacctcttgtccccaggcaggtggtggcggctggcaacacactcatagggccccatgagggttcaggattggagggggtagatttgggggcctcttagctctcaaagaggggcaatttaacgggcagaggtccatttggatccagaccattcacaggctcgaaggggacactgggagttggggctgggctcaggcctgctggggaaccaaaacttctgcttctgaggggtgtcagtaattccattttgactctgggggagccattttaaatctgtttatttccttctcatagaatcatgggtgagagctggcatggcccctagaggtcatttggggtccagctgcctcaccgtatcaatgaggaaactgaggcccagaaaagaaaagcatttttgcccagagtccctcagtgagtcctggttccgtacctgctttctgccagggaccaaactcccgttagtcattcctggtgtcagccaggcagaggagcaggtgggggagagggcgtgggaggagggaggtgaggcagctccctccgagtggaagctcacagtcagctgcagcgccgcccctgccctgactgcagctgactggcaggggcacctggaggcagcgggttcgggcgcagtatgagagggcttaccctctgcggcagtgggagacaggaccaggcagctccccacatccttccacatccgagctccaggggtctctggcttgtcctttcacagggcggctggtgtcccttaggtgggtgctggtagttcctgggagagttgacgggatggagcaggccaggggggctgagaagttggcctggcgagagaaggtgggtgggactgggagagcctgggcagggaggggcctttctgggagggagtgtcatggggctggccgagatccaggacccaggagactggccaagctgccacaggaggcctgagaggctgagcatgggggggccaacactgacagactttaacaagtttctggctcccccaggaaaaaaacagaccacatctgatccttggccctgagtccagagtgggaggcaccgtgacaacaatgcgcagagcagggaatgcagggagccatggatagtgctggggtgagctggagtcctggcaggggcccagctagggcagtactcattctgcagagcctgggagaaggggctgcctccttgggaggggtttgtgtgggagtctcagcgggaattctattggaccaggggaaccagccttgctcagtgacttctctgggtgtcctcctctaaagtgagggtcaaattcccacctctctcgcctcctggctatgaccacagcagaccaggcagggcatggggctaggcggggtcaggggccatcctcaggctgacacctggcctgtgggtagggtgggatctgaaactatagggtcttcagggggccaagtgtggggtaaggggtggcactttccgcagggctcgccctctgcagatggttcagcttctcatcggctgtccctttgcaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtgagcagggccggggttacatctgtgcaaaggctgttggtgcccaggctttggtctgtgcccggagccagggtgagcctgggatcagggcctggtctgcagtgtcagcatggtgagctggcgacggggccccaggctcagcaggggctccccagggccagcacgtggccagcagtcatgccgaactgactgacccctatgggcgcagggcagcctggccctcccaggcggcctgggttcccctaggctgcctgaggccaactgtgctctgctttttggcagatgagtgtggccagggtctggcattgggcttagcagggagctgtggtcccagtgacccacgtgctgccagcgggtgtgtctgggccattcctcacacacaagcaaaacttcccggatgatgctggggtggagtggggagccaggggaaaccataggacctcagagttaggagccgcccgccacctgccttcccccagatcctctgggccagccttgcagtgtgcacattaggaaaatgacccagagaggggaagtgacttggttgaatgccacagtgagtcacttggacctatatgcaaattctgttgctcctcaagtcaccaaggactcatcgtcttagaggcagccagtgtgctcaggggctggctgttggaggggatttttatggtgaatcttttgtgaagtgacttcagccaagtaattgtgcaaatgaagattttcccagaggctgaattactcggcatggattccacctacccaggccatagatgaggctagaaagtgcatccctcccttggggacgtcagaggccttctgccccacctcctggcccctctgccacagagctgggttccacagcctgggtggttgtgggccctgaggccatgtatgaggcttgaggtggtgcctcttgagagtcagggagcagggtgcaccatctctgcggtgaattatctgaaactggtgggtgcctatctaaagaggaagccacagcaggttgagggtgccccagcaggaaggaggacccagctagatgagcaaatggaaatttagagcgtcaaagccaaggggcccttagaggtcatttcctctcatcttcgggatggaaaatgagcctcagagaagacagccagctgtttccgggccacacaacgagttggtagtggagctggggcgagtcctggaaagaaatgtggcctgatccccactgtgacttcagtcactggggagcggtcatgagcagcctgtctcgcagagcctgcaccaggtggctgtccctgtcacctgggctctaagtgggagcaggagctgcactgggctgctccagggaaggggaggaatctggacctcacactgccctgtcagatgctctctatcccaggagagtctagaaccctcggcaaaggagaaggggaccctggccagccctgagaggggtggaattagggattgtcggactccaagtgcagtctctggtgagcctccatccattgctctgcgacgggcagagcagagtttaggttcgtccagtggcagctcagaacacggaggcccaggaggggccctgtctgcaggtgcccaggtgggccagagaacaaagcactggaggggacttcagggaaccaagctgagtctgcacactgatgggatgctctatggggaagcagaggccaagctctcacttttttctctgattcaaagggtatgatcagggctgccgttctcaatttaaaggagctcgactttttttctcttttgtctctccctttccttctctgttttctgagagttgagagaatgactccctatgtagtaggacaggatgtgctgtgtggctatggaaagttagctgcctctctctgggcccatttcctcatccataaaataggacaagtctctctgcccctctgagctcacaaaggtgttctgaaggtccagtgagtggatggggtgacagggaccctgaggagggttggaggcgtggggagggtggggattcagatctttgggttcagagccatggacctgccccctatcctctacccatctcatcccaacttccttggagctggaccttagttccacccagaccttgagccatttgactctgctccatgaggctctgcaaggcttaggctggtctcttctgcagggggccctggagaggatgacgacgatgatgttcatcctcccttgagggcagagagctttgcagttgccaaaggatgtcagctcagcatctcctgtcatcctcttggcctgcattgtggccaggcggatgttctgaccctcctgttactcacaaactcatggggaggccagagcagggaaggacatacgagtgtctcctgatgtggatggactccagggcccttcaggctgttcctggcccgcaggtcccttcgctttcctgttcctcagggcccctgggcctctgggcatgtggaggtgtccatgtgggctcccgagagcaagcggggtatgaaaggaacttggtgacactcctggccggcgctggagtcacagcctgcctcaggatcctccctcctcctttctcagctgggaatccagcctcctctacgtgccgtttcctgctccactcagaaaggtccattcggctagccctgggtctagcctcaggcctgccccactctccattaactttttttttaaaaaaaagaactcagttttggaaaaatctgttattttccaagttcagggaacctgttgggctagcacagggcctagtcgaggaactctgtgagaaagacttcaggccagaggcagagatgtagctctctgtgttcccagaggatagggaattcagggtgagagacacaggcttctttttccagttcccaggggatttttgcctcactgtcccctccctggctctcacagcagcccttggtggatgttctcgctggtttgaggaacaggccaaggtgcaggtggcagctggtggtgaggcccgaagtcctaacacttctaagagggcaggattgggagagagggctccctggaggaggtgtcacccagtgggtcttgcaggacgggcaggcagggtctcactggcatgagtgtgggggcaggtgtgtcaggaggggggcaaagcctgggacaagaccctgaggaaggaatgagcatgtgagcactgggtagggaagggtggcctggctgcctagtgacagagagagatgaacagagtgggcaggaaaggtggaggccaagtcaggcctgttcgtaccaggggaaggaatggaggtttccctgtgggtccatggctcttcaattcttggatcaatgactcctttggacaacttaggaaggctccacctactcctcaggttgggacatgtgcacataaagccccagctggaatcatggggcatattcttggaccatagggtgagcccccagtgtgggtaatggagatccccagaaaggggcagcctgcaagccgggggacacagagctgcagagggcacctccacaaagggtgggcagcagctctgggacccacattctctgacatgcctgggcaccccagagtggtggtgtgtcacgctagacagccttggcatcccttccagctggatggtcaatgtttggggtctaagacggcaagatgtgagtgtgttggtcacagatgcagcccaggatatgctgctgggcctggctgaggctcagctgtgattccatttgggccctgatgctgtccccaccccgtgggcaccagggtccagggctctcagcctatggagatttcttttgaataaacttagtctatttgcaatttaagaaaaaaaaaagtcatgttttgcccactctaaaacattaaaaaggaacaaaagagtatagtatagtagaaagttgtcctccataccccctgtcccccaccctcagttccctgcctgcaaggccatgttaagaatccttccagagatattctttgcatatataagcaagtgctattaatgtatgttttgtttctgtccccacacgggactttctttgcagagtacggtggaagactccccttgtgggttcccttttctgtacaagtcaacaattggacagaccagggatttccatactgtgttcccagaagccttcgggttggctctggtgtccccaccaattcactgattcaataaacatttaataagccccttcccttccccagcagcttcacctctgtgactgcctgggaatgtgggcgacaaggtttgctgctgagaacagtttgaaaaccagcaaagcaggtggcccagggcccaggcagctctgcaacacccctgtggctgcttggctctgctctgttgcctcaaatgacaggaaactcactattgcctgaggcaggccatctctcctgtgaacagctcagctgaaaaactcttaacctaccctgagttacaatctgcctccctataatttccacccactgattctccattctgcccttagagggcagagtgctgacaggtccacgacttggtcccattttacaaatgaagaaactgaggctcagagagacaaagttttaaaacattcctgttaacagggccagaacccaggaagggatatgcttttctcaggaataatgtcaaaattaatatagcttcccagtcaatgaggactatataaattactatttgcaaagcactaagaacagtgtccggcacagagtcagtgctatgtaatgtagatgtgagaatgagagagcctgagattttatgtttgcgagtcccacaggaggcagggcaatgccaactccctgttgcttggaagcaatgggcaagtctatgaccctcctgttgaggccctgttacaggtaaccaagcccccacggaatggagctgaggagctcctgagaatgggcttgtccggttactgtttggattcagaactgacctaagagattcagaacagacagactcgccttggcctgagttgcctctgggctcttggaatgtccacagcaagtccattcctctccttgggcctcaatttacccacctgtaaaacaagaggattggaccacataagagatcggaagccaccagggtttctctttttctcttttatttgaattagttgacaaaacttaaatcttgggagattttacccagaaaatcatctccccagccccacctgagatctggtaatagcaggcgtacgttttgcatggcgctgaagaccaggtaaacgccccaccagctgcctcctgtgtgtgctacctataggcgcctgtttgctacccgtgaatgagatggtttctgtggatgttcccagctccgcagttaagtagagcacatccttccccttgcacctttttttttttttttttttttttttttttggagactgagtcttgctctgtctcccaggctggagtgcagtggcgcgatcttggctcactgcaagctctgcctcctgggttcacaccattctcctgcctgtctcccaagtagctgggattacaggcccccgccaccacggccggctagttttttttatttttagtagagacaaggtttctccatctcctgacctcgtgatccgcctgcctcggcctcccaaagtgctgggattacaggtgtgagccactgcgcccggcctccttgcaccttctgagtgtccctgtctcggagctggcaatgcagagatggatgtaggaaagccctgcccccgaggggcccagatgtggtggggatctgctgcacttcggtaggaaacttctttgagatctctatcctggacttgaaggatgggtagggtttctgccaggtagaggggagtgtagtctggtcttgccagaatcaaaactgttaaacagaagtcatccctcagtgatcatcaaggttgccttcctaaattagggagactttttttttttattgtccattctttcatgaaatctaggccacctttcctacagggctgaggtctgcttactggctggcagatccagccatttcccgagtatgagactgggagtcggtaggcttggatttctgtctggctctcactcaggaagactgagtgatttcgggcagattactgtccccctggacctcagtatttccttgcaaatgttaagatggccatgtaaatgttaacaagtaattctctcatttctctccagagggctgtgggtgggtttggaggggagaaatggcatctcctttggcctgggacctcctcccctcttttaccctccatgctgcctctcctcaagggcttctggagtccccaagtcaaatggcaaatggggaagagaagacagggtatggagtacaagaggcctagatcctctataggtctgatctggctggtgctgcccctagccagtaaagccaccctccagaccccttcaagcctgttgtagccttaaccaagatcaaccaacatggaggtgactgatcttggttaaggctgcgaccaacatggaggtaattgatcttggttaaggctacgacacgtttccctttagagaaaaatcatgttttccccctcaaaaaatcatgcgttaatttcctccaaccaaactaagtcccaggactactccgaaaactactcaatgaccatctgggcatttgtacatgggtttccatttcttggatgcctgctctcctgttacctcccagaagcctgtgaaaaaggcaaggcatattacttccacttaacggaagaggatgctggggcgaggtggcaggaaatgactggtccaagaccttacagtcaggaaatgtggaaacgggtgctgctctggggttctgaactcttggccctgcttaaccctggcttctcagatctctgatgctggtctcttctccccaggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgagaa

SEQ ID NO: 64 - DNA, 30238 bp, Homo sapiens
ccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggtgagtgctggcgtggcgcgggcggcgcggggtggggcggcctttgtctgctgcgggccgggcctggatcccgcggaggtccgcacgttcccgctcagggctgcaggagctgagcagggcgccttccctccgggctcctgctcccctgccctcccccaggtccgggcggcccccctcgcacaggagtcccgggaaccgcgggcgcccctcctgccctgggctgtggggcccgcggagagctgggggctcccggatcctaccccgcccccctttcctcgggttgagaggggcccgggcgccgtcggacctgcagaccccggaagctgcggaccgggccgggtgggtgaatgcgcttttgcaggccccgggtctggagcgggcatgggggcagatctgtcccgtgttgaagcttaacgaagccaccggccggcgctgggaggttagcggggtctcgggtcctgcagaggaaaacgcccagctccgggaggggagcggcggggagggaaggcgagtggttaggcgtgtccactctgcagggcccagcagggcgaaggtgtgggcgactggtgcacttccacaggcagccgtgggcagcatgaggggtcagattccgggaaggacaggtagagacggctggcaggggccacggggtgaataggtgttgggggtggggagggaattgggatgggcagtttgggcttgggaagcctcagggaggtggggggtgaggtgggatggagaggagatgcgggcgacggtggagggaggtggggaccccgagtgggggcacactagaagggaggggattgaattccagcgcccagggccctccctgcgaccgtttagctagcgaattggcaggtttggcagcctaaggcaggggatttatttctaagccaaacctgctctaatgagaaaagcgtgatagatgactcagatatgggatctatcactgagggaaaacattaagcaaatagtaaagcaaaaaagatttgtgtgtgtgtgtgtgtgtgtgtgtgtgtgtgtgtgtgtgtggcgggtgggggggtgttagttgtcttaatttagaaaaacgatttaccttcaaattggatgtggataattgtaaatgagtctgatctcttcattaaagcccggggtccttttcttataagcatgtcttcagcagttagtttctatattagaaagtaatgaagctgctttgtctttaagagagttctttatttagtgcggcctcctctagttccctctggcctcccagaagtccctaggaaatctgatgctgtgcagccttccttgtagtgtgggggactgcaaataggtgggacagtttgaggctgaggggaactgaagtctaaacttgaagtctaaacctgtccgatgggttgagctgatctgagtgcagggcaggatggagggctatggggctgtagggtatgaagtggctcatttcaagggagtattttgggtgagtacattttcctgatatctggagttcttgagattaagcactaacacttagggtaactgttgaccgtggaaatttacatacgtcaccgtcagcttactggagtatcctgatgtgaatgaaattttccttcatgactttgggtcagccctgtggacctcagtttttgttctgaggggttgtatggcaaggggacgctggcgggagagagcttcgttcctgcattaagtggcctcagtgatgcagtcagggtcccatgactgacctttggagttcttccatgtccttatggcattactggtggtttctcctgcctgcagtaagctttccagcttactctagactcctgtgctgtgagacatgagcttgtcagaggtaaggagcctgtgttaatgcaagtctcaggtgagaaggggtgttggaatctgaggaccctgttttccttcctgtcccctcttcagctctgtccaggcaccacccgatggagggttggctgaatgtctcatgttcatatacctgacagctggcttcggtgctttaatatttatggaaaggacagttatagaagtgtggtcccttcaaagtagtcctctggggtgtctgtgtccttattaggttgacttctgaaacttcctgtgagaattccatcattaaactttggctttctctggaggggtaaatctttgttctttggagtaggatttgagtttgacaaggagctggacaatgctgtttggagtcagagatgcagtgtgataagagagctgtgagttggaattccacagcacctaaagagactcctagaaaatgttgtagaacaagtggctggatggtacttggttgcacatacggggtttggggtctgtgcagaaaaatgaccaaatccaagcagcctctgagattatgaccacatgggggctgttaagctgtggatctgagtcatagggtcagggaaagaggaaaaatggcaaggaggatgacgttactgcccatgagcttatcctctgagtgggtggcgacttctcattgtccttttcccacatccccagggcaggagtgttagggaagtccaccagcaaaagggggagggcacacccagggcctaggggagggggagaggggtgaggactggtccacatgatttttgagaaattgcctttggtcttgttggctcagaatggaccccacacctggaagggggccacgtgtacagttatgcaacccttgcctgccacccccagttctaccgcccttgcagtgtgccagataggagcattgggttttcaggtttgggagtgggtagggttgtgctggaggctaaatagacattatctcatgtaatcctcatagtaatcctatgaggtagggtatcattaacaccattgtacagttggggaaactgaggcccagaaagggtaagtcacatgcccaaagacacacagccggcaaatggtggagctgggctgttgtctgcttccagaactggctttttctgctgctctggaggtaggcacaggttttacccctctttctggagcccggtaagatgtgccaagggtctccttagtaagtcagggaagactcatctggggaaccagagaaggggcaggcctgacctgggtgacccagtgactagtggccttcacagcatagtcagggcctttgctgagagttcttctcttccagagccctggactttatcatgctggggcttccaggagttccccctccaccctccagttctgaccagtgctcccagccagctgccccctttctccctttctttctctttgtggtccagagaatgaatgcctgctccacacaccttatgccattgggaatctgaccttctctaggcatagggagcttaatctgcgggaagtggagtgagaagcatttcttgctgggagccttggagcagggagagatactgtctctgggaggcaggggtcccaagttaccctagaggcaatgcaggctcctaggaactggggctgccttgtgggagacattggaatgtgtccctgtgggaatgctctgtgctaggggctatggcagcaggacggtaggagctcatggtacttggaactgtgaccaagcatctgcgaagaggaaggggcccaggaccactagaatgagtcagagccagagatggagtcgagttgtgcatttgctactttggagctggggcactgatagggctctaggtgaaaagtagggatacagaaggagtaatggtcccagaggcccagatgtgtggcctgacagaggaggtcttggccagggagagtggggtaggggcaaagtgttcgctcagtgcagaggccccatctaggaggccttgtccccatgcttgcggcaataataacagcaataataataattattactgcagttttggtactgggcactttcctaagtcctctctctctattgtcttattttattctcacagcagccctgtggggtagggattgttacccccattttagagatttggaattgggtctcaaataggttaagtcatttaaacttggtcatgtgttcagcaaggcatcggtgtcaggattgaaacccaaggctgctggcttctgagctcatgctgtaccctgggcaggcaaggcagcctggtgattccattcaataagtgaggaagagagataggagcatcagctggctcttagtcacttctgctggtggctgataattgagtgtgggcccttggccagccggccaccactctgggtccagatttccatctgtacaatgggcctggagctaggcgctggaccaggtgtaccgtaagaggccttctagctctgaggactggtggagattgctacactccgagaggggtctggtgcttagatggagaggggtcggcagagttgttctgctaagctgagcctctttcagggtagaaaccaaaggaatttggaggcaaggaggcatttaggcagatcacatctggagaaaatgcacccttccttgagtgcagtctggaaaggcttctggaaaggataggatttccagatatgtttaggtgggcacctagcaggactcagcagatattgagtgaatgcagatgtgtgtgccctgggcctgccagtgtctgacccgaaatctgcgctctgatgtggtctcatgtgctctcatccctttccttcctctccctattctccttgttgccatcccttcttttggctggacctcctctgggcccaatgtagctttcacttttttcagggctctgtgcctcctgtgtgtgtgtgtgtgtgtgtgtgtgtgtgtgtgtgtgtgtacacatttccacatgcatgtataggtcagttttgcagcccctgcacatgcctctagttccagggagaccttagccctgctttgctggccagccctgatgacatactactgtcctgactcacacagaaatcgcttggagaggaagaactgattcctgctcttgggtgggatcacgggactggggagtggtgcccagtggacagccttgaacataaaaggcccaaactgactcagattatcaggaaaaaggaaggcaaacagggaggctgttcccagggaactctagggaccctcccatctcttttctgaggctgctgcccatttatagagcacctagtattaactaggtcagttttgataattttgctcattgagtcctataatcatcctatgagggtaaggtttataatccccattttacaaatgagcaaactgaggctcagagaggatattttcataaagtttcattactaggaagtgacagagtctggatttgaacctgtctctccaactccaaagtcatcttcttaaacactagtgctaacttcttccatgaagcttcttgtgattacaccagcccaacatgcgatatggtcacagcatgggatggtggtcaggaccctttgatggttgaggagatgaagacccagaaaggcaaggggtttggcctagggagcctggcaagtgagtgacagagcctggtctaaagtccaggatatctctgttgttgctgttttccttttttcgttaattgcaaaagaatttacatgttcatagttaaaaacagagaagtgtatcaagtagaaaacagtagcaaactctcacccttattctgacactccagagttgcattcactctcaggcatccagatcctttccccatatacaaacatccatccatccatatatctatccatctctctatctaaacacacatgcattcattcgttcactcattgaatcgtgcattgagaacccattatgtgccaagccattgctagaattaaggatgcaatagttaaataaagcagatgtggttccttctcagggaggttctcatatatcatgaagaaaacagactgggtgcaatgaatgacagggtccttcttagagtggcagatctcttacctggcttttctgtcaaggtgaccctcagaatatggaggtgttaccttttatcttagtccatgttttactgctataacagaataccacagcctgggtaatatataaagaaaaaaaggttatttggcttgtagttctggagactgggaagtccaagggcatggtgctggcatctggcgagggccttcttgctgcattatcctattgtggaagggcatgtgagcgtgcagtacagacagtatgggggcagcacttacgcttttatcaggagcccacttttcctgtgataacagcattaatctcttcacttcttacaggccccacctcttaatactgttacagtggcaattaaatttcaacatgagtcttaaagcacccatgtcatctaggaagaagaaactgtatttgcagcaacactgtgaggtaggaaagggagtcctatgttgtaggaactggaagcagcccactgtggtgaggggcaagtaggaagaggtgaggctgggcaggtgggcagggccagggcagatggggctctgtaggctatggaggagctgcgatcttatcacaaggaaagtgaacagccctatgattaactattgaaggcagtgatataatttatgcttttatattaatagcaattattctggctgttgtatagagtatagattggagaacagaattgggtgggggaactagagaaggtgaacagactggtgaagaggcttttatagttatccaggcaagagatgatggtgacttggaagaccaggaagagaagcaggggtagagagaaatggagatagtgaagatatagcagacatatttgaggagtccttcagttacagataatagaaaactagctcaagcacatttaagaaaaaaaaaaaagacttgtttaagtacctaggcagtctatgtgtgcagcttgcttcaggaataggggcttaaatgatggttttagggctctatatccttctagcttccatctctgcctctgttcatttgtttggatcaattctttagattgttggtagcagacacatttattgctaacagtcccagaccgtatccttcttagtaatctcaacaagaaagagtcttttttgatggctgcagcagcaaggctctggggaagtctctgattgggtgtggcttggcttacagctcattctcgaactaatcactgagtgggggcagggcaggtttctccatgagccaggtcttgtaacatgcccaggccctaggctgggaggacagctccaccagtacagcatggactgggctccctgcaggagtgcggagccttgctaccagaaggggccagcatagaccaagagaagggcactgtagaataaaggacatggagcaaaataactgtgttaagactagctaccaaagacggagacgatctgctcggcattgaatttgcctctttgtcaaggaaagaaggagcagaagatgttaagaaggaattgaagtttaggccatacggggaggtgctcatctgttttaactgtatttgtcttctggcccctgggattgcctgtcctggtgtggggtgaacttggagacagaatctctgagaagctgtcagggatatttcaggccagtctagggtagaagagggttggacacgtgggtcacagtattccacagtttcctgctgtgcacagattcaatccgagtccccatctacgtccctcactacctcccttgcctcctctcctgagtctcagcctctcctggagtcccatcttcccagaatatgctgtggacatctcctcttctgtgacttttcatgctgtcccctccgccagatagccgagatgtctcctcctctgtgcagtccttactgagcctccccagcccccagtgaatggcttgaccctttcatccaggtttaagcctactgcctcgtccattcccacaataccttgtataaatgtgtaccaaaaaactggtcatattctattttaatgatatatttgtttcctaaaccttttttctatttttaatatgaaaatgtgggattttaaatatgccatttagcagctctgtaatcttgagcaagttattaaatctctccatccctgaatttactcctcggtgaaataggataataatagtacctacttcacagaattgttgggaagcttaaatgagttaatatgtgtaaaagcatttagaacagagcctggtgcatggctttcaacaaaactggcctatgttattattatttgataaaagcaaaataatatatataacatgggtaacttttgaagcataataataaacatacctcccaacttgagaatgagaacccctgtagttgaatatttatatgtacgattcttcatctccattcatattgcatgcatggccaatgcctggcatgtggatcatgaataagcatttgttgaatgaataaatgaacaaatgccagaagacttgagacagggaaataaccagttttatggggaagatggtagattatgggaacaacagatcgataatcttgttcttaatccttgacaaagtcctggaaccaatgagcacttgaagaagagcccactagtaggcacttgcatggcttcactggggttttgaaaatgcacttcttttcttgttcttctccagttgattggtccccagccagaagcagtgaagcttctcatgacagccctggggatgagatgggtagatgggagctgggtagcagcacaggtaggaacactcctaaccccggtgtactgaatggtggatggacattgatcatccagggacagatggtgctgtgggctttcctattcctgtcctctccctgaggaccttgatgacacccagacaccagcagagagaggagagtaaccttttcagatgatattcattcattctttttttaatccaccaacaaattattgagcattgtctatgcaccagaacagtcaaaagagtacttcaaaagatcacgacagggttacacagcattgtaaatatagttaatgctgccgacttatacacttaaacctggataaaatggccaacttcatgttatatatattttacaacaatgaaaaaaatgttgtggcagttggaggaatggactcagtttaactgggtgaaatggaatagtaacaaatgaaatatcctgtaaaactcctccccattctgaactccatcagaagaggatggcagaggtgtggattagcagcaatgagtgtgagtgacttctgatggttggctacagatttgatagtctgttattttgggttattttggtgaatggtgtgacatggctgctcaatggtgacttcgtcaaggaagatcaaatacttgcagggctttgataaggaagggggcagactcattctgtgtggtccaaggggtcacatgaggactgttgtgggctgtattgggagacaaatttgggctaagtataaggtagagcttctcaccgatgaacgctgtccaaaagcaagtggatagcccatgcaggccatgggtgcccatcacgggagggcaaacagagattgtgtgtatgcggtgggtggggggaggggcagggaaaggttccctgttctgatacttgatcattaatttctgcagtttccccagaatttgttctcatggcatcatctccctcagtgaccccacctttggttctgtcaccaccactgcacgaatgactgccatgtccctctgttctgagctgcagctcagtgtgtctgggagtccataggacattttggtgtggatgatccatagtcgagctcagtaggaactgatcttccccctccacgtgcttcatctccaggtctccttgttatgtgtgtccatgtttgcccattgctcaagccttcagtgccctcttgacaccttcagcccctccctcaatacaaacagtccccaagcctggtcacttctacccttgacatttgtccaaagctgggctcaggcatcactcggtgactctgatgagatagtctcctgttcgtattttgagatacctattttagatgtggtttccttttgtggctctgagcagtggcaatgctcatcgggtacggagacggggaagagaaggagggaaagtaagggtgggatggctccttagttagttcagatgctgtaagaaaggcccaaaatagcaatgacttatgctggaagagatgtttatttctcacccatgtgaccatctgggtatatccagggctgatactacagtccctcagggttcttctgtctgctgctctgccgtcctcagggtgttgcctttggcagtatgatcgccacacacaccacatctatgttccagccagtgggaagggggaggggaaagggaggggagggcatgcttctctctttcagggcatgacccagaagctgtacacatcagtgtacacattgcatggccacactcagctgcaagtaaggctgggatctgcagtcgttagctgagtggccgtgtgcctaactaaaaatgctatggaagaaggggagagctgggtgtgctggcagcacctgtagtccctgttactcgggaggctgaggcaggaggatcacttgagcccaggagttacaagggtgcagtgggttctgattgcaccactgaactatgatggtaccactccagcctgggtgacagagcgggaccctgtctcttaaaaagggagaaaatgggtgtaagtggacaacaactagcagtttctgccacagtcactttgtgcatttcagtgggaactgtgtggctgtgaactggttaagccttaaggatatagtccctgaaagcttcaagtactgataaagttccactagcatccacaaagcttttcttttataggtaggaacactgagctcagagaagttgcctagttaagattgcataacaaagtgtcagagctgggaccagaaccccacactttgggctcattttctagaattccagggtgatctggctgaggggcagacaggcagtgtcaggaggacgggtctctggagttcaggaaagggttacctttcccagcgcggctacctggggagctgctcatgacttttcagggatcatctctggggttatcatgcctctgaggtgcctccaattcgccctgaccatatcataaatagtatactataccaaactgcagtgatctaactgcatgtcccccttccctattagaatctgctccttgaggacagacgtgtaccttagttatctctctgcccctagtacgtccctaccaggaactccgtaagtagtgaaatgaattactaaagacatgaatgcatgtggattcaaggactccttcggttgcagacaatagaaacttagttcaaactggtttaagggaaaaaaaatgattggctcaaatatctgggcggtctaggtctgcagcttgcttcaggcatagctggatccagggacttgtctgacattttcagaactttgtgtctttctgaccctttttgtccctttgtgggaagtgttgcccaaggagcccctgcggggattgggaggaagtagggggttaggaggaagtggagtgatgtgggtgattatggtggggggcaaggagaccctcttgggcatccccaggcccagggcattttggccctgagcccaggtgcagtctggatttgttgtagctttctgagggcacatcttgggtcatctcttgggagcctccctgtggccctgcttctgcagggttggatgcccttgctgtaccttaggctgaggacagcctgacccctctctcctgctgctctgtgaaagccgaaggtgctctgtggttttgggatagagcaggaaggagaaggacgaggagtgggcactggcaggtgactcaccgggacgggtggcacatgctgactccagggcaggtcccggctggggatgagattcccctttgtggaaaacatgggtggagggggtggtacgcaggcagcatgaggcctgcgtggctccacgtggctctgggtcccgggccgaccagctctgtgttcacaggacactctcccattctccagggagcacttcctttctgagctctgtctctttctcctgtcctcagctcctccaggcccagctgtcagcgtaggggtctctgggtgccgtggactcttctggtctctttgcttctgggctgtcaaactgcttctctccagggcaggtttccaggatccagagtctaggaaaggaatgaaagggagcaagtccagggcgcagccctggaagtccctcatcttccctctggagggaagcgcagctcggccctgggagagcctgggtaggtctgatcaggggaggtgccctctgctccctgtacctgcccagagtggcaggaattagcctgatatatgaaggagacaattatatgaagagtcttgagtaccaggcagaggaatggggtctgacttctatagtgaatggggagccatgggaagttcttgagcaggggagggacatgagcagattcctgtcttaggtcctaagagaaggcaccttagagaatggggctggcagggaaagagaggagcaagcagggccagtgaggggggtgatgggtcagggtgggagatggaagcttgagaagcagtgtggagagtgagggaggcggcccaggaagaacccacaggccttggttctgtctggggttaaagagaggcagggagatgtggaatctgggcgttcgttcatccttagccctggtgcttcccgcaggggttgggcaggtcctgcaggcagctgcctgctggatcttcctgtgggcctcagggtggcccttgtggggcaggatgtggtgcctgccaaaggtgctttatgaatggagccggggaaggctgctgactcagcaggcagtaaggctttgaggccggaagcgtctggaaaggaagtggctgctcagggcttccccactgtagacagctgggagagaaggggggctggccaggatgcacatggtttggctgagggactcccttggcccagctgctgggggtgtgtgtgtgtaggagtggagggtggcggggggcgggtgtgcctggctgggattggaaggattgaggctgggcgcctggaatggaattgaggctagcagctgttgatgaggtttgctccgtggaagggtggaaaggtgtagcagaattggactctttttggctgtgctgactggcaaattacttgacattaacaaagtcacttatctgggctttaatttttttttttttttttttgagacagagtcttgcagtatcgcccagactggagtacagtggcgcgatttccactcactacaacctccgcctcctgggttcaagcaattctcctgcctcagcctcctgagtagctggtattacaggcctgagccaccacgcccagctaatgtttatatttttagtagacacagggtttcaccatgttggtcaggctggtctcaaactcctgacctcgtgatccacccacctcggcctcccaaagtgctgggattacaggcatgagccaccacacccagccatgggctttaattttttaaagtcctgcaaaaataggaccaagtgttacagcctatctcccagggtattaggaggacgtgaaatcatttctattcttgttgatcagtgttggttggcatagatgtggcttgatcaggacatggcacaaatgtttaggcagcagctgtgggactcagggacaaggtgtgtgcagcctggagggtggctgggattgggagcagggctggatttagggatgtctgcccttctcatccccagctcaggcctgacctgcagccacagacttgcctcttactcagtcctgactccagccttgaggtcatccccaagtccttgcctcttccacttctgatctgtcttggtcactcaatacagatgtgttaagctagcaaatgttctctctctgcattcccacactcatacacctagtcgcctcctaaaactctgtcctagaagcttctttgcaaatactgctgatttcacacaagctatactgaacccttccattttctctgcctcagtgaatgctccaccctgtcactgaggctcaaaaccacggccaacctgactgctctttctctctacccaagtcctcagatactgtcacttttacccagacatgctttgtctcctgtctggcccttcatttattccaccactataccttcctacagggatggctatattagcctctttttttatttttattttttgagatcgagtctggctctgtcacccagtctggagtgcagtggtgcaatcttggcttactgcaacctctgcctcctgggttctagcaattctcctgcctcaccctcccaagtagctgggattacaggtgcccaccaccatgcccagctaattatttgtatttttagtagagatggggtttcaccatgttgttcaaaccggtcacaaactcctgacttcaagtgattcgcctgcctcagcctcccaaagtgctgggattacaggcatgagccactgcactcagcctgaaatagcctcttaactggcctctcccttgccctgatacaatccagtctatgctgaggagctagagtgggttttaaacattgttacctagattatgtgtgattaaaatgctccccagtgattcccattactcatagaaaaacccaaattcctcactggtctctcaaagccctgcttgatctggctgaaacataccctcccatcagatagcgggtggaggtgctgtcagattaatcttcatgaagctcagctctgaccgtgtatttcccttattcaggaagcttcagtggctctcaactgcctttaggatacatttcacacctgtcagcccatctctaagtctggcccccacaggagctcctgctctgccctaccagctactgtctgccaaattgatctgcacacatcctagccccagagcaagccaaccttgccttcacttgccgccttgcctcctcttccttatatttggatactaacatcttagctgaaagggtggatcccagctgccccctaccccatcttccctgtcaggcctccccagggactccctgccaagcatctgtcaccaagattcctcagcagggggcccggtgggatatgggaatgaggacctcccagtgggcagttgcagccttccccactctggtccaggagagatgaggcaagagatggtctggggagaacctttggagacaaaggccttgcgtcctctttctcccaggcaggggcagccttccaccacggggagcccagctgtcagccgcctcacaggaagatgctgcgtcggcggggcagccctggcatgggtgtgcatgtgggtgcagccctgggagcactgtggttctgcctcacaggtgagggtagcagcatggggacgggaggggagggacagtgattgtggcagttggggagggggtgcccacgcctgttaggggtcctgccaagccagctctggctagcagggccataccttacttccacctgtgggatccagtaggcaactcacgttactgttcttagcctccatttccttgtctgtaaaatgggaacatgagtgctaaatgagatcgtgctatttcttgaatacactgtgtgcgccccctcccaggacctttccacttgctctttcctctgcctggaactttctgcccctaaacgtctgcatgactggatcccatattttgtggaggtctttgctcaatgtcacctcctctcaaggctctcctagctcccttgtataaaatagcacacctccgctcctccctccctatccctggcctccctgcgttattctgcctagattcgcccccacctggcgtttgcttgcttcctccctgttcaaagagcagggtccatctcagggccagagcggctgttgcatagtaggtgcccaataactgtgtagaataaacgatgtgactctccccacacggtgcttggcacacaggaagcactcaataataatagctactttaataacaatatcctcatcacatttcaaattctcatcagcatctctgctctgagacggcttcctccgtggggaagacaaagctgagggtctggcgccatcttgtggccataaagaagtgcctgtctctacccacggctgctctgatttctctagagcaagaaagggttttgtctgggtgacttaccaggtttcattcccccaaatgtcccctccaaggggcaccctggttcgactgacagggcatgagaactggcctggggcaccaggggtttcagcaagagatccaaggctagcttaagaactttagagatctctaggtactgcaaagattatgatactgagtatgattcacaataaaaataataaccataaagtcaatgttatttttctaaatgcaggaaacctttaatgagtgctgtattcaattagcattgtttcaaggttgatcttcccacattttgagtgtgcctgctttgctagtgctcgaagcacacaatctaaccattaccggagaatggtagtgccagggtgggggggttcgcttcccctcctcccctcctcctcctcctctttttttttttttgagatggggtcttgctctgttgccaaggatggagtgcagtggcgcgatctcggctcactgcaacctccacctcccaggttcaagcaattctcctgcctcagcctcctgagtagctgggattacaggtgtgttccaccacccctggctattttttagtagaggtggggtttcaccatatctgctaggctggtctcgaacgcctgacctcaggtgatccacctgcctcggcctcccatgccgggccttttcccctcacttctgactcatcagcaagtcctgttgattccctcctaaataaaccttgaatctgatccctctcttcttctctactaccaccctttgaagccacaccaccctcacctcttacagggacagctgaaaccgcccctaactggcctcccccttgccctgccacagtccagtctccacagaggagctagagtgagttttaagcattgctactcagattatgcgtgattaaaacactccccagtgattcccattactcatagaaaaagttagattcctcactggtctcttcaagtcatctttggtctgggtgggacatgccctcccatcagatgtgtctgccacactggacgctccccgatattttcacacagcaaggccagtcttgcctcagggccttccacctgctgtttcctctacggggttctctgtatgtcagctctttttcattccctataaatttcagcttaattgctttaaagagcatgtgcctcaccaccatatttaaaggtacgggtattctttcttgtataaaaacaaatcgtgtttcgttaggaaaagaaaaaaaaagaaaaaaagaaaaagcacttgtgattctctctcctccagagaaaccactattgacatttttggtggatacttttttggactccccaatttataacattacttacgctcatggggaaatgcacatggtgcaggcaggtgtaaagtacctgccagatttttgaaaagctgttgctttacttactaacctgctggctccttttcctcacataccttagtcacatgctgacgagaatctgtgtgcccatttgtctctctctcccattaaaatgtaagttctgtggggatgtgaccgtagtattgctctctgttgcatttctgacttttatgcttggcacctgtaggtgctgactatattcttgactgaatgaggtcctaagacaataaattactttgggtctcaggcctaaaaggaggggtggacagggcctggggttagcaggggcagggagcgggactagggaggcccacccctcctcagtcccccttatatgttctccactccccctacccccaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccggtgagcaccaggagggggacgccttccccttagttcaccctccattccccctgcagcccaccccctgctgcaccactgctcccagaaccccagtgctgattcctgtactcagccccatgcatccttttcgtcctctgccattgccctgcccttgacccctgccctctgtcacctccagctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggttgctttgcttaaatgtccccttgggggaggggggttctgcttctgtcggcaggggttgggagctccgaatctggccccaccttcaatctcccagaacagcaagttgcctcctaatgatagggagaaagataacggggaggtggggatgttcactggaggggttgggggcggagaaatcacaggccttcttaaggctctcctgacttcaaggctctggaagcctctgggaagaatggagccacatctgggtcagcagaggggtgggcgaaggaaaggagtcctgatggcaggattcaccagggctggagctggtgagagtcacctgccccaggcctggccctgggattggtctggtcaggccaagacccacctgctgtgattgttctcagaagattggggagactccatatctgagagtcctcagacttaatctgcttttgcatctaagaagaaaataggaagatggaacagggtctgggaattgatgggggaagagtttgggggactcgggtggtagcctagagagtcccatttctcctcaccaccctgcccctctgaccccgcccccaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccggtgagcaccaggagggcgacgccttccccttggttcaccctccattccctctgcagcccaccctctgctgcaccactgctcccagaaccccagtgctgattcctgtactcagccccatgcatccttttcctcccctgccattgccctgcccttgacccctgccctctgtcacctccagctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacaggtaagggcagatgaacagctggggaaggacggagcgagtaactccctctttactggaccctaacgtggaatttccataggtttgggtggccagaagactttcaaaatccctttcatagacttcaggtgctcacactcttccccacaagtccttaagggactcgagctgataagaaccatttataatgtttgccttcctaagagtgcttttcgtggcacttatgcttcttatgcagaggacaaggtacctgcccgaaatttggaggcatgggcaggaattctggggcagccacaaggtgtggcccaggggacttggtgtgggtgtgctttccagcaggaactcctctgagtggtaggaaggtattctgggtcagtgggcgccatctgattctgaagcctgagtgacagctggccctccctagttagtccccaacacctgagtcaacgtcagctcttcttcctgcagacttgcgctccacccaggcagccgttggatgggcaggggctgtctctgctgcccccgtgtggtcaaacaccagatagaggccacccctttagtgattgttagtctctggtttccaggttctagcctcgtgggcacctcttgtgcctgagggtgtgaagagggttgaggtcaagagccgcagtctccatctgtgtttggccctgagaggcctctggtcagtcacttcctgggccgacgtgctcagtctggctcttcagtatctctccctggccaactgagctttcccagggacctcgccctggtgcacagtgaggtcaggacagcaggttttgtctgtctggttctcctcttgtcttctgatgacttccatctgcccctcagcccatccaagttctgatctcaccccaagtttccaggtctgcatgcacctcaggactcacttattcctgtcctctccctcttgagacctatgtggtccccacttctgacaagctcggagccagggcccgtcacatcgtctgcttggagttcaggctcactcctccttctctcttacgtgtttccttctggcaaggttgtgctccttctgcccaccccttccccaagatggaaaacactcccttcctgtgctctccaggagagagtagctgccctgagctcttgaatgttctgagacatgtccttgaccttttagagaacagcatatggtttggtggtgaaaatgctgttcacaggcgaaaagaagaaatagaagatagagtgatcttggcagaggatatgaagctttcagaggagggagggtggtagtgaggacacctccaggggcaaatgggagctgagaaggccttgaaggataaggggtctttgtggtcatttgcaccctgggctgagctggatatttgcgatgctgtgcagaaaggacttatgagtataaatgtgattgcaaagagaatgtttatctcacctaagagaaaattctctattttaaacttgagtagctaacatttaaagtgatttcaaaaaaatttagggctgggcatggtggctcacacctgtaatcccagcactttgggaggccaaggcgggtggatcacttgaggtcaggagttcgagaccagcctgatcagcatggtgaaaccctgtctctactgaaaacacaaaaattagctgggcgtggtggcatgcacctgtggtcccagctacttgggaggctggggcaagagaattgcttgaacctgggaggcggaggttgcagtgagccgagacagtgtcactgcactccagcctgggtgacagagcaagacactgtctcaaaaaataaataaaataaaaataaagtgatttcattgaggccattgttgccaagcacatttcacagacgaagaaactgaggtccacagagaagggggaactttcccaaggtcacagactggcacagcggctctcaatctttgggggtcagacccttctttgaaaattggataaatgatcaatgcagcagtttgcacataactctggagggttcgctgcctctctaaactcctccgtgggtctgtagacctgggctccagtgccctgcagtgaggagatgagccatgatcagaatccaactttggcctctcagcctaatttcctctccttcccaccagccagcctcctgtttctgttagagcaggtctggcctactttggagcccttggcctgtattttgcttcgggcagctttgtatcatgtcaaacattctgggattcagactttcagtcctccagctggtctctcccgtacctgatgaagttagtgaagttgtgtgctgtgcagagcctcttggagggggatttatggagcaagccctagagacgtggcctgagcctgtcctttcttgggtgaacagggcaaatgtaatttgtgttccagggacaccaccagttaagggggaacatagagaccctctgcttgagtatttccatggctctgccccctcctctgctgtcagagccccatgatgggatttccagggtggttattgttttttaatgtgtgctctgtggatgggccctcttggccacatcagctgctgccctccttttctgcacacctctcttcatcactggggtgatggatccctgtgcttccaatggccagagcagcagttttgccagcagtgcctattgaaggtgacatctgcagatccatgcacgaggtgcatctatgctggggtctctgccgccaaagggtccatagcaccgcgcactgcactgacagggcctcctgcagaagctgctgaggccctgggtgtgcatcgtctccagacagcaaaggaaagcagcactgtcttttgtcaggcttttcctctcaagacttctccctaggacccagctgggtgcaggggctgggctagaggatggtatgtaagatggagtcacacaggctgtgctcagaacagctcctggccctacccagctttgggtcctcaacttcatccctcttgacgtgacagctctaagaggaggggcctcagtgtttcatgttaatatccccctggcaaggcccctgcagacctacctgactccttggggaaactccaagccctcactccagccccgtcagtgacctcatctgtatgtaggactcagcgaacattttctgtaaatggccagggagtaaatgtttttaggcatcgtgggccacacaccatctctgttgctgctgcttctccttctgttcctcctccgccttcccccatctttttttggtaaccctttacaaatgtaaaaaccatcactagtttgtggactgtacaaaaacaggccacaagccagctttggcccatgggctgtagtttgctgccttctgatccatagaatgggagatgtcaccaggtagggctgaagcagtcaaaagagggcctctggaggaggtgaatattgagctaagcagagaatttgggaaactgatagcattagtgcagaggctggaaggagccagttgcttctggagagaatggttaggacaccagtttggctgaagctgaggctcctacagtagaattagaaaacttaggggagggtaagcagcagccaacttctagaggtccttgaatcacgcttgaagcttgaagcattattctaaagtcactagggagccatagaaggtacttgagcatcaattcaaccacaggctcttcagcccttcctggttgaggcgtgtccacatcagccagggttgtatcagggtttggggagtgtatggcgaagggactgtaggaacttaagtgagctttattcatagtgttagggcccagtgagggtgggagcccctgttcacacttggagccaatggtgctgtcctccgggacatggggccaggcatgacagtctcactgttgctacttttcctctcagggcagcctatgacattccccccagaggccctgtgggtgaccgtggggctgtctgtctgtctcattgcactgctggtggccctggctttcgtgtgctggagaaagatcaaacagagctgtgaggaggagaatgcaggtgagtgtgtgtgtatgtgtgtgcgtgcgcatgcacacttatgtgtcttggggtatgttgctgtctttgatgtcaatagagtgtcactttctagtgacagaacgagtgtgtgtgtgcagatggggctggatttgtctgtgtgtgaccttgagtctacgtcttgtgtgtgtgaacaagcgtgagcctgtctgtccatgtgcagataccacaggatgaatgtggatgagtgtgactggaaggtggtgggagtgtaaggccaagtgctacaaagggatgagtgtgtgccaacaagtgtgcctgtgaaagtgtaagtcagtcacgtgtgtgtgagagagcaggccagagcatggaagctgtgcggcacaaatgtaggcatgccaggggcgtgcatggcactgggggtgatcgtgcctgccttggagtgagtttgaagcagctgccatttgcggggctgagggtcagcccgagctggcattggtgactggtaagtgggtgagaggacattggtgggtggtgagttgaccctggtgggtaaacagatgcatgagagtagatgggtagtcagaggctggggatggctggaggttgggaaggagagggaagaagagtggtcagttggcagataggtgagtacttgtgaggtagacaggtggaaggatgagcaggtagacggctggttggttacatctgttggaggttgatggttggcagggctactgagcgagcggatgggtgaggtgatgggtgggtgggctggtggagggtaggtggatggtctttggctgggtgtgtggcgggggctccaggttgagtggatggtctttggctgggtgagtggtgggctccaggctgggtggatggtccttgactgggtaagtggtgcactccaggctgggtggatggtctttggctgggtgagtggtgggggcgccaggctgggtagtttttggctgggtgagtggtgggctccaggctgggagccccttcatgttgtcacaggctcggctctgctgtgctctgctctcgggctctaacccgtgtctagcatttggtccgcaggtcaggcccactcaggccctgttcaccagcttcctgcactctcaggtgggaaagtgctggcatgaaaatgggcttgcaaaagatttttgtttattctgagttcttgcctttgcaggagctgaggaccaggatggggagggagaaggctccaagacaggtgagtctgaacttggagctggccctcttggctgggagagggacatatgggaaaggagagaggactctaggatctggaggggccagatttgctgtaaggtttgaatgaaatgtgttctgtggactcagacctccccaccccggtgagtctgctctttgcccagagttaggcaggaagtggatcacccagttccctcccaggtgtggcttcatttctcctgccaacctttacccatctgccagggccgattccacctgattggccccacaccgtggagtctggtggcttcctaggggtgggagcaggggctccggagatagggagtctgggtttaagttcctgctccatctcaggtaaacagagtggccttgagcaagatgctttgcctctctggcttcggtttcctcttatgtaaaatgaggataatcacagattcataggttgtttgaattattaattgagataatgtatataaaggacctagtatcatatctagtgccaagtgcttaatactctggagtcctattactattaggcaaacagcttaagacaatactgttctagttacagactgtgtagctttgggcaaggtgccttgctcctctgggcatcagtttcccatctgtaaaatgtcatcctgaccctgccctgatggcaccagagggctgttttgaagctctttcaggtgactggagagggaggtacttgcaaaggacataggagcatggcacagtaagctgggggcccagcttgggtgggtgccaaggcactggtgcccatggccgactcccaggggatcctgggctgggagaggcaggtttccgctgagccatttgggatggttccagttaatgccagttccctccccacccccgcagaaggaagggcaggagattgacacttggggactgctataaattatgccaattaattctttgcctgttggtgcccagcgtggcaggcgtagagacagctctgggatcagacctcattcttcatgctcagaggcagatgtagttggcagaagggagggagtgaggagaagagtgtgggtgatggagttggtcagtctcattccacatggtcccaggcccacctgcaaatctgccagcctcctttagcttctcacatcaccctgtgtgtacattgggctcagggcacttccgcatctccagctggaggtggagggctcgagggttgtcccattctatagatgcagaaaactaaggcccagagaggagaatgacaagccacagagtggaactgggacctgggactggggcttgggacagcaacctagggccccttcccttgtgctatgaagtggtcccactctgctgacttgtcccgccccttccagccctcactcctccctctgcctgactccctaccccaccacttcccatggttcctccctcaccgtgtgcgccttcctttttttacagccctgcagcctctgaaacactctgacagcaaagaaggtaaagacacctgggcttgaggttgtgtctgtgtatgcacacatctgtgtgtgagaggctgagagggtgggtaggcatcatcctttcactagtgacctgaggccccctctgcagaagagcagcctcaacttccccctggtgagatggcagagggctgagtaaccaaggtcccagctgctctgatgggacccaaatacgacagaggcttaagcaggacaggagtttattcctccttcctgtgatagtgtgagcataggtaatcgtaaaaccactgatgacctggagccaggttccacttacctggattctgccctcttcaacttcaagctttcactcctaggtctaagaggctgtttgtgctcccacgccccctccagagccaagagggagagaaaggaaggatatgtttccttctagagcttgagtggaagtagcctgcatcacttccgcttacattccattggtcagaacccaggcatatgagccctaactcaggggaggctagaaaagtgttcagctgggtagccatgtccctggcgcacagtgggtggttagtaaatgtccatagtcattattgggcctattgttataatgtcagtgatgacatttggaaatacaggagataggtcatttccttcctgtttttcagaatcaaataaccatagaagagctgggcagatggagataaaaagtgtcagcttaggccaggcatggtacttcacacctgtaatctcagcactttgggaggccgaggtgggtggatcacttgaggtcaggagtttgagaccagcctggccaacatggtgaaaccctgtctctactaaaaatacaaaacttagccgggcgtggtggtgcatgcctgtaatcccagctacttgggaagctgaggcgggagaatcacttgaacctgggaggcagaggttgcagtgaactgagattgcacctgtgcactccagcctgggcaacagagcaagattccatctcaaaaaaaaaaaaaaaaaaaagtcagcttggttttgaagagttgctggagaatgtggcctggatgggcaaaccagtttgcttcctaaccctgctccttggtgaggcagcctgccccctcagtctctggccatgctggacaaccacagaggcagtgcccagatgggggagctcttctcctctccccagggacatacagagccccaagaatgggtgagggagagggcaggggaagggcccaagcccttcttcccaagtctccattcagcttcagatgcagagtggggtctgaaagatgagtctttgggatggccctccacatggagacaggaagcccaagggaaggaggagggcccctgccgtgtcactctcagggaaaccagtgtggaggggacactgggaaggctgcctgctggacgagggagttgggccaggccttggagggtggatgggatggacaaacaggagatgagaagggaaaagtgttgcacgtagagggagagtggagggaagtgtatcgggctgtgggcctgtgggtactgagagggggctgcgtgaggtggtccccctcaggtgccccggcgtgcctggcacctgcatctgtgtctgggcctccagggccgtggtcagcacgggggctgtccgttgggctgctgtctcacacacactccccacttgaagtctgaccaggtgcttgggcttctggcataatcccaaaaatagatcttctggcatctaatgcttttcccttcccttttttttcttcccatcatgaaatgaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaagctt

SEQ ID NO: 65 - DNA, 126782 bp, Homo sapiens
ttcctgcatcctaacatgctcactgtgggttatgtcctgagaagacctgcttggtttagcagctgtggtacccatgaaagaaatacatctctgatcctgtggtaagtgaaatcaaatttccctgcatttccgtaagaccccctataccaaaacattgttggggctcacaaactgatacctcaaaatatgctcattgacatacttaactgaagaagcctcaaggtctctctgatcttccccatctggcccccccagtctgtcccaaagacaggatgatgttgaagttcatttatctggccagacatggtctctcacgcctgtaattccagcagtttgggaggtcgaggtgggcggatcacttgaggccaggagctcaggaccagcctggccaacatggtgaaaccccatctctactaaaaagaaaaaaaaagaagtttcttcatctgtctgagatcctgaacagatcctttcacaagataacatacaagttcatctctgttccttgaaccgttcattctctccagcaattcccataacagaatttctcttctccatcaccccataacctattttgccaggatggtacataagtttctgaatcccgttggggtggggtaatcactctgcaattcattctgtgtgcatgttaataaatttgtatgccttttcttcaatcaatctgccttttgtgagttgatttttcaatgaaatttttttttttttttttttttgaggcagagtctctgtcacccaggctggagtgtagtggcataatctcggctcactgcaacttctgcctcccgggttcaagagattctcctgcctcagcctcaagagtagctggactacaggtgcctgccaccatgcccggctaatttttgtatttttagaagagatagggtttcactatgttggccaggctggtctcaaactcctcacatgaatattcacactgaatattcatggtgatctgccctcctcagcctcctacagtgctgggattacaggggtgagccaccgcccccggccctcagtgaaattttagagtggggaggggaagctttccttaggcccctatagcacaatggtcagtttagtataccttgttttcgattccttttgtctttgctaagaatttaagtaacacctgaagcaccagtcaggcagcattccaaagaaggttcagccgcatttaaaccgtcgtgtccccctgtgaggcactccaggccagatcccaatctcagccacattcttcacttacacttgactggctgagaaagaacagaacaaaactgccttgggtcagaggccacttttttatatcagatgatctaaactgttcctggaaggatgtttatctgctggaacaaacaccctggggcctcctggctgaagctgggctttcctctgtccatgcatcctccaaggctatccagagtgctttgagcagcccgccttgtccattctttccatttgtctctgtctccccagagagaaacgccacagggaagtacatgacaagctgctatgttaccttaacattgaattcccagcagggatcacaaagccatggaagatactggttcagaaattagctgagagggacagagggcttttagcagacgagtgctggctttgccttagagagctttctgggtggtgctctgactaagggcattcaggtctttatgattcagggttattataatggcggtgctaacttttcttgcgtactgatgtaactggcagcacattaagtgcttcacctatattactgcagtcttcccaagaatgctatgagattggaccattagtgctaggaggtagaagggctgggaggttcccttacccatggccataccaagggtctgagccaggattcacactggtctgcctggctttagcattcatccctcactgttactatgctgcagaggatgaattggcagcccatgggctggattttgtttagcctgccagtgttttaaaagacatttaaaaatctgagccaatatttaaaatgcaagtgatttcacatataaacaaacaaaattctaacatctcttaaaaatagctatgactggcaacactgggtcctcaatcccaaaggctcctggctattggaggtaagtattggcttccctgctacatggggcatgtgctcccagtttcccatagaacctagtatggcaggctggctccattcatgtacctgctccagaagagccagacttgcattatagccttctatagcatgatttttgggtgctgtgtgtacccctgacctggcatagccctagaaacagaattctgtgccaataccatagcttgggttggttaggaacagagaactcaagtgtaagctgctgagggtttgtggcaggtaatttatggttaattccaaagtcagttcatctccaagggagagggcaggataaagaggtggcatgggaagtgctggaagtgaccatagacctgggattgactccaggttctgccacaggctggttacatgagccacattgagtcactttctttccctgtacctataagaaggagagattggagttgatgttgtcaggtgggtgtcagctctgaaattctaatatgccactgcttgttagtcaaattttcacaagagaaactgactttggaggtgtatcttctggcagtggacaatgggtgcaaacgaataggtaattagcaaacaactccggctcaggttcagagcagctggaaggttatggacccggcccagtgaagagaggtgtggcccaaagcactgcagccattttgaatgccagagctttctgtcacattagttcaggggtcagttcagggcttggctctttatttagaaaccataataggaactacttaaaccattcttttccagagcaaatgcctcaccccaaaaaatatcactgggaactatattagagagaattgcacaatctttcagtgcattcagaggaactcacaggaactgtattgttttctactttcttccttgcttttgaaacacaaaccttatcacaacaaagtgaacctgtttctccaattaaagcagtcatgaaaataaatagttatccacaaaactgcactgtaagaaataaaaataagtcagtagatcaggcaaagtgccaagaaaactccttcgtaatacattttacttatctcctcttttgtgcctctgcaggtctcttaattccctctggcctgtcaccatctctgagtgtatgtttcattggcttctttgaataagccttattgtctctttagcaaaggtggtgtgtgcaaccttatgttctgttgcttgtctgaaaatgagacctcaggcatgacttcctggtatctcccaggaatgagcaggttttaggatgtggacccaatagaaactcttctgagagccagataccaattgaggttcttagagacctctatgagaaggccaacttgactgaactgagcctactggcttgactttgtagaaacttccttctatagcggaggctagctgactttccagcttgttctggggcagtgcctcctagatcaaggcttctccaactttaatgttagaatgtagattctcattcagaaagcctggggcatggtccaggagagggtctgcatttctcccagggcccctggtgatgctgatgctcctagtccaaggactgcattttgagttgcaaggtcctacactagtaattctcaagtgtctgctaccaggaccaacagcaacagcatcaactggtaacttgttagaaatggaaattcttaggctccaccccagatctcctgaatcagaacccctggatgtgatccagtaatctctattttttttttttttttttgagacagaccctcactcttgtcccccaggctggagtgcagtagtgtgatctgggctcactgcaacctctgtctcccgggttcaagcaattctcctgcctcagcctcctgagtagctgggcttacaggcacctgccacaatgcctggctaatttttgtagttttggtagagatggggtttcaccatgttggccaggctggtcttgaactcctgacctcaagtgatctgcccgccttggcctcccaaagtgctgggattacaggcgtgagccactgtgcctggctgtaatccgtgttttaacaaaccttccaggtgagcctgatacatgtgagagtttgagaaccactgtctgtgtcattgttatgggttgaattgtgtccctcctctaaaggatatatagagaactcaatatatgaaatcctaacctctagtacttatgaatgtaactttatttggatatagggtctttgcagatttaatcaaattaagatgaaatcattaggatgtacctagcctaatatgatcagcgtcctttaagatgatcatgtgacatcacagagacacagagggcaaagatgatctgatgacaacagaggcagaggtttgaagtgatgcatctacaagctaaggaatgccaaagatgaccagaaaaaaaaaaaaagaagctagaagaggcaaaaaaaagaatgtttttttctccgtgtttccgaggcaacatggccctgccaacatcttaattttgaaagtttagcctccagaagtgtgagacaataagtcgctgtcattttaaacaacatcatttgtggtacttcgttacagcagccttaggaaactaatacaatcgtgaaaggctttccctgctcagtgatagaacagcaggtacttatagggctcaggtgcggctattgactgatgggtagcagaagatagggaaagaaatggaagaaggcaaaatagaaagcaagaagcagtgatgatttttgttctgaggtatttgtgggcttaataatttttaaaacattatttgtaagttaattatcaaacatttattgaatgcttactacatgccaagatccgttttagattctggggatataacaatgatcaagtccagtttcttttcctcaagaaacttgcagtcagtacaggaaagagttgagtaaacacgccctcactatgcaagggcagatggcactcagagtacacaggctatgggagcagggaagccacacagagttgtattggttgcgcattgcaccacacatagtcttagatgtaaatggtctcccctagggttgtgtggtgcacaaatgctctactgagcatgacagctccgttaggaagattcaagaggaacattaaattcagttcttttgatttttattttatttatttatttatttatttttgagatggagtttcactctgtcgcccaggctggagtgcagtggtgcaatctcagctcactgcaacctccacctccaggtttcaagtgattctcctgccttagcctcccaagtagctgggattacaggcacccgccaccacacccagctaatttttgtatttttagtagagatggggtttcaccatgttggccaggatggtcttgatctcttcaccttatgatccgcccaccttggcctcccaaagtgctgggaatacaggcgtgagccactgcacccggccgtctttttattaatttattaaattttcaaggcagtcctctagggtccattcaatttattcttgaaggtcaagaaaagtttcccaagggaaatagtatctaaactgagacctgaagggtaagtagaagttaatcaggtaagggaagctgagggggctttgggtaattgaaaaggaaagtgtttagaaaaacaaaactgcacataccagactgagagacaatgggagcatctgtgaggtgtgtactccatcaagggctctgtaggcaaaaagctaactacctgatttgctagtcagattcttttcagggcctagagccccttaaataagctccattttgtagtaagactttctttggttgctcaaatatctccgaagtaattaaagcctgcagatcttagttgttaaactgcctgatgcaaatttcttataatagaataatttaggtgtctaatggaacagaatataatatgagtagaagacatgagatgtcaatgctatgtttaaaatgtgtatgtctaattggctaagtaactgtaacttttaactttctattttagccaggagtcttcctcttttccttcccaatgagggtcagttgtggggagaccatattaaagctggcttgttttttttgtttgtttttttgttttttttgagacagagtctcgctctgttgcccaggctggagtgcagtggcgtgatctcagctcactgcaacctccgcctcccggattcaagcaattcttctgcctcagcctcccgagtagctgggactacaggcgtgtgccaccatgcccggctaatttttgtatttttagtagagatggggtttcaccatattggccaggctggtctcgaactcctgacctcgcgatccgcctgccttggcctcccaaagtgctgggattacaagcgtgagctatggcgcctggccagctggcttatgtttttaacgtactgtaccttctcaaaaatccaaggctgtgtaaagtccactcatgtagagagaaggaacctgctcaagttttattcttggaactagaaaaatcagtcttccctttggtgttgagtgtgaatttctgactgggaagtccaagctgaggggcaggtggaggcctgggggagttggccatggcttggagaaggcagccacagctcagctgaggcagccatgagcacagggcaaattgggcagactactcctggcagcacaagctagagagcatgttgggtgcgtctgttagcggtggagaatccatatgggtctgcaacaacctcagttcttgcctcctcagaagaaagaatttggccaaggggtataaagcagaaaaaaagtcctggcaagttttagagcaggaatgaaagttcattaaaaagctttagagcaggaacgaaaaaaagtaaaacatacttggaaaaggaccaagcaggcaagttgagagatcaagtgcacagtttgacatttgacttggggtcttatatactggcatgcttctgagattgaatccctctttccctgattgttcccttggaatgggctgtctgcatgcgcagtgtgtttatgggagttgtacgcatgctcacttgaggcattcctcccttgcgagccgaaagtttctagaagatcacataccagttaaactctgccattttcctcttagtgtgcatgcttgagcccacttgctcaactcctgagatcttatcaggaagctgctgatcaccacttttaagtgttttctatctattaggagactgcctttccctggagccagctgtgcccaattgttattttagagagacagttaacaaaccaccggaccatcacctgatggttgcctgacattacaggtgtgggaaggggccccctcttgtcctgctcccatctgcctgactatctactggaacccttctccagcagcagctcataatatcattcaggtgagaccaggatgcactgaacactgggtctacaggctggggtggggctgatggtggagcttcaggggaggcccaaaagagcaacacacacacctggagagcaaagcagcagctcctagttgcaatcctcatattgggagttgagggataagctaagatctggctgtttatttacaagctgaaatggcctttgcaaaagtatgactgaggaaattatgacagtgaaagaaatcagacctaaccaactccatcttgcttctaactttaagctgtccttgttcattcctgggcatagaccaaactaactttgggaaggaattcagttcataatttgactctgaaacaaaattgataacagccctttcctgaaaagaccacccttcttgcctgggaaccagttcacctttgcaggactaacaaattagctataagatgagaaattacagtttaggggtcatgcagtctctggctccaagagtctgaaccgccccaaattttaaaacctaagatcagtgcttgagatgttttacagaccctgcacttgatggatcagctgacaccacccagaccagtaatctggctcaatcagttttgccatcccacccaggaacagaaaacagcaagaaaaactcaccttgaccccctttggttccatctccaacctgaccaatcagcactcctgacttcccaagcctccacctgccaaattatctttaaaaactctgatccctgtatgcttggggaaactgatctgagtaataataaaactccggtctcccacacagtcggctctgtgtgaataactctttctccattgcaattcccctgttttgataaattggctctgtgtaggccgtgggcaaggtgaacacactgggcagttacaaagcctcagattcctttaggaccaacgattgaaatttcttcctaaaatcaggaattccagaagtagaagcagtgcgaaggtcatcacatataagaatcaccctggcctcgaacatcacacacgggggcctgtcgtggggtggggggctgggggagggatagcattaggagaaatacttaatgtaaatgacgagttaatgggggcagcaaccaatatggcacatatatacctgtgtaacaaacctgcacattgtgcacatgtaccctagaacttaaagcataattttaaaaaaattaaaaaaaaaaaagaaccatcccagcctcatcttgccctccagttccctccagagctgtggtgccctgcagcccaccaacagctgggtatcatgagagcaagttgctctctgtctcctgaacacagctgtggctgaggaaactttccttttggattgagtgacaatgaatctttctgtagctttctttcgccagaattgttgtccctttctcggagacctccaccacaaccttgctaagtgaccttgggaagctcaccttttctttctgtgtccacattttctctgcctgtctaatgggatttctggcaggatcaaattaaattactatgtgaaagcactttgaacaagtagactgtacatgtggtggtcacggtggttattggtgtttggtattatgtttcggctctctctgaccatggtcttcctgtgctctgccagctgcagagctctataccctggactatgaagaagagatcttgtattccagggcccagctgtcccggtgtgagccactcattgttctgatctcctcaagagaggagtgaaaacaaattgaggaatttgaaacttttagaccacacccccaaacacagccctaataaataacatacattcagttttctgaaaagattaaatcttgtccacatactccatcaaaaactacaccccagtgcatccaagagctcttcaacaggggtgtttacaaacctgaaaccagccatcagagccactgaaacttcagctggtgcctgtatcggggagtaaaaagacctttattctctgtgtttaggcttagtgcctggggttctgcagatgaaacagagaaaacacaggttagcaagagaaaagggtttctttcatacacatatggaggaggctcacagaaatgaaaaaaaatccaaggggtgctcatacctagaggcttatataccattttaacaaaatggtatataaattcaaacaaaaataaatttgtaaagaagtgagaagataaaaagagtttgaagttgttacgagtagtaaattgtgggaaggtaaatacagggaggaaataaatggaataaaagagatattttagtaatatttggtatgttggttcctctcagactccagtgattaagagtctaatctctctgcccttcctgctatgagagaggaaaagggtaatgtcctcacaaagggaatttatgccctgcctttaggcaaatgggaggaggatagagaactttttttgtgtctgctgttttttagttgccttcagctcaaaataatccttatgccaaagtggcatatttgggggtggcctattctgagcaccttcacttgcataactgtagcaacagcatcttctgagccatttgtacctctgttatttccctctcattgtcctttggtcaaccatgctgagactgaaaattatccaagagttttgccggccgcagttaagaatccccatctctctaaccaaagggtcaagtcccatccctacctgtcaaaatcctacttgtgtgtaaagggattattttaaaggcaataagtagtttctgagtacagagtcattggtttggaagtataaccacaaattgactttcatcaatcaattgttattgagtgcctcctaaacaccagggcctattcaatgtgctagaaaacaaagataaatcaagcacaattcctgccttttggagagctttacctcttgggggtctgatatagtttggctgttttcccacccaaatctcatcttgaattgtagtttccataatccccacatgtcatgggagggaccagctagagacaactgaatcatagtagaggattcccccatcctgttcttgtgatagtaagttatcacaagatctgttggttttataaggggcttttctccattttgctcggcagttcttcttgctgccgccatgtgaagaaggacatgtttgcctccccttctgccatgattgtaagtttcctgaggtctccccagccatgctaaactgtgagtcagttaaacctctttcttttataaattacccagtctgaggtatatccttataccagtgtgagaatgggctagtacagtaaattggtaccaagggagtggggtgctgctataagaatacccaaaaatatggaagcaactttggaactgggcaacagacagaggctgaaacagttgagaaggctcataagaagacaggaaaatgtgggaaagtttggaacttcctagagacttcttgaatggctttgatctgaaagggatatggacaatgaagtctaggctgaggtggtctcagatggagatgaggaacttgttgggaattggagtaaaggtcacgcttgctatgctttagcaaagaaactggcagcatttttcttctgccctagagatctgtggaactttgaacttaagagagatgatttagggtatctggtggaaaaaatttctaagtggcaaagtgttcaagaggaagtggagcataaatgtttggaaaatttgcagcctgacaatgcaacagaaaagaaaatccccttttctggggagaaattcaagcccgctgcagaaatttgcataaggaacaaggagctgaaagttaatcactgagacaatggggaaaatgtctccagggcatgtcagagaccttcatagcagcccttcccatcacaggcctggaggcctaggagtgaaaaatggtttcctgggccaggcccagggcctctctgctctatgcagcttctggacgtagtgccctgagtcccagctgcttcagctccagccatgactaaaaggggccaacatacagctcaggcccattgcttcagagggtacaagccccaagcctttgtggtatacacatggcattgggcctgtgggtgcacgaagtaaagaactgaggtataggaccctctgcctagatttcagaggatggatggaaacacctggatgttcaggcagaagtttgctgcagggacagggtcactgtggagaacctctgctagggcagtgtggaaaggaaatgtgaggttggagcccccacatagagtccccactggggcaccgcctagtggagctgtgagaagagggccatcctctagaccccagaatggcagatccgctgacagcttgcaccatatgcctggaaaagctgcagaaactcaactccagtcgtgaaagcaagtgggagggggactgtacctggcaaagccacagaggtggacctgcccaaggctgcaggagcccacctcttgtatcagtgcatgctggatgtaagacatggagtcaaaggagatcattttggaactttaaggtttaatgactgccctattggatttaggacttgcatggggcctgtagcccctttgttttggacaattatcccctttggaatgggtgtatttactcaatgcctccattgtatctaaaaagtaactaacttgcttttgattttacaggttcaaaggcagaagggtctcattgtctcagatgagactttggacttggacttttgagttaatgctggaatgagtcaagcctttgggggactgttggaagggcatgattgtgttttgaattgtgaggacatgagatttgggaggggccagggtggaatgatatggtttggctgtgtcccctcccaaatttcatcttgaattgtggttcccataatccccatgtgtcgtgggagggacaaggtggagataattgaatcatgggggcaaggtttcccccatcctgttcttctgatagtaagctcttacaagatctgatggttttataaggggcctcccccttcacttggctctcattcttccccctcttgtcaccatgtaaagaaggatgtgtttgcttccctttctgccatgattgtaagtttcctgaggccttcctagtcgtattgaactatgagtcaattaaacctctttcctttataaattacccagtcttgggtatgtccttatagcagcatgagaatggactattagagggtctcagaatctaaattgtaagttctctgaagagctataagtgctgtgatagcctgaaatgtagtatacaatgtggatatagggaggaagaggtcagttctatctgagcaggatggggtgggatagggtaaagcagagaaattatcataaacaagtgatgttcaggctgagttttgaaagaatgggtactcagtgggtgtttaggggcctggggcaataaaatattgcaatgattcccttgtttctcaatggtttgcaccatttacccaaggctcagtcattagtcacatgtcaagatttctattcctatttgggataatctggtttcttcattccttggctcagcaagagaacctaaacttcaacttgacaaactttcaatggcagcagccaccttctcaattggaaattattttatttgtgtgcctatgacactttctgaattcccttcttataggatttacctagtattgtaattgcttatgtacctatactatctgtaatcagttgtaagtgtgatcagagctttgaaaggagaagcccagtgtgatgtttcaaggtaaagtagggaaactgacacagtggagatcccaagaaggtgccctcaatgggtacataatttttttttttttttagacggagtttcactctgtcacccaggctggagtgcagtggcacaatctcagctcactgcaacctccgccttccaggttcaagcaattctcttgcgtcagcctcccaagtagctgggattacgggtgcatgccaccatccccagctaatttttgtatttttagtagagatggggtttcaccttgttggtcaggctggtttcaaactcctgatctcatgatctgcccacctcggcctcccaaagtgctggcatgagccccagtgcctggctacataattctatgttgtttaaattaagctggaagacacttgtccccaactcctgcctggctagttttactctttggtgtgcaatgctctcatatttaccctctagctcaaaatcctataaaatgcctctctatataaattcactgtaccagagatcaaagccccaatagctatctatccttctcttttcatttgtctccttctctgtcttctgtaataaaacatcaatatttagctgggcaaatggttgctcaggtagcaactgtatttcccagcctttcttgtagctaagagggaaatatgacaaaattcctcctattggagtgtgagcagaagtgatgtgaagaacataagggccacattctttatagataaaagggcttgttgtgctccactatccatttcctattgtgtgggaaagagcagcaacagcagcagccaccttaggccacatgggtgccaccactgagggtgacagagctgccccagtgccagtaccttgggatgatcttagggagcagcattgcctgtctgctctggaattctagactctctatggacccttccaggagggaaaattaaacttctgtctcactgtactttggggtctctttgccagggcagttaaacttgtatcctaactcatatatccaggcgctgccttttggcatgtctttagtttagctgagggccataaaagcatttatccactttgtcataatctgtgtatagtttcagtgggagatttctcttgagtgattttccagtttaaattttctcatgatccccatctggctgtcatttcttttaactcatcctcccctaatgctcacttttattgtacagaagctctaaatattttgagaactgaagtcatggagtcatgggatttcttggctaggtcataatactttgggaaaagtggactaggagagaaaggggatgtgaatgagattctaatatgaagatgaaagtcttagttacccagagtcacagctctccattaatatgaatgttttcaccacacctagagaaagaaaaaaaccatgatcaaatcagctgttattagagatccattcaaaaaaacaatcttgtaggcctatgccagagtttcagcccaattggctacccttccatggtgacaaccacaactctctgtgatgaagtgagaatttgtcataatatcactgaggccatcttttcaagatcagagagtctctgctttgtcaaagcattttatttgaggggaaaaatggatggcaatgcttattaaagaatacatcataaagaaacactatacaaatgtgcaaaggtacacatataaggatatttattgtggtattgcttacattggcaaaaaagtgcaaacatcctaatagccagcagtatgaggaagattaataaagtatagtttgtcttattacataaagcaaagcagccacttcaaagaaggtatgtctgtatcgactgacttgcaaagctgcccacaatatattgttagcagaatgattctatctttgataaaattagacaatagatatttatgtatacattttcatatacctagaaaaatagtctggaaggatatgcatgaaattattaataatgattacctctggggagtagaattaggagagatggagtagactttcatattttactctgtataattctatattgtttgaattttttatgatggtgggaattcatgatgaggcagagatcatacttatcctgctcactgctctctcatgcagagaatagatgaggtgatcaataataatagtaacagttatgtagcacctaccatgtgctagtcaccttcctatggaccttacatatgttaatctatctaattttcatatatatactatgagataagtactattactatctccaatttaaagatgaggagacagagcatagagagaacaagcagtctgctcaacgtagcaaagtgatggagctgagattcaatccaggcagattggctccagtgactgatcttaaccactatcatttgtcgtgttgattaatcgattgaatgaatgaatactaaaaaattaattttccagctaagtcttttataagtagaagaatcaataagccaggaaagctcattccgagagtattctacttaatcagggttttacaatttatctttcattgcaaagtaatgggctatttatacttagagccttccaaatgctgaaaagacactgatgttaactgttgttgatgagtgaccaggagaagctgaacattttaatttaaagtaagtgaaagaattaattgccagcatattaaaagccttcatctgctgttcctctgccttccacctggaacaataacaagggcatcatgagcacaagcatgacagcctggcttttccttttcaagctgcctgattttccagcttgtgaaattgtcttctctgtgcttacatctggtaatttggaaatgtaggacagaattctgtagtctggaactatctctatgccttacgtgaccaatgggactcctccctcagggaaaatggctaaagaatagaccatgtccttggggcagaggaactagcttttatcttattagtattctcagcatctggcagagtacctggtgcatagtaggagctttatatagcctagaacaaggccatcttaactgtcaggtcaatagaaatttttatggtttagagaaaggcataagaaaaataaaggataggccaggtgcagtggctcacacctgtaatctcagcattttgggaggccaagcgggcagatcacttgaggtcaggagtttgagaccagcctggccaacatggtaaaaccgcgtctctactgaaaatacaaaaaaaattagctgggtgtggtggtgcacacctgtaatcccagctactcaggaggctgaggcaagagaaatgcttgaatgtgggaggtcaaggttgcagtgagccgagattgtgccactgtactccagcctgggcaacagagcgagactctgtctcaaaaaaaaaaagaaagagaagaaaaaagaaaaaggaaaagaaagcatactccttggctaaaatagttttctaagtataaaaatggcattcatttagcaaatgaatacttagcacctactatgtgtaaaatactgtgggagatacaagtgaatacaaaattgtcccagtctttagcttgtactagagcctgagagatatatgcgcatatgtcagccctgtgaatttagataggagaattttgtaaatttgcagtagctcccccaccaatctttttttttttttttttttttttgagatggagtcttgctctgttgctcaggttagagtgcagtggcacaatctcagctcactgcagcctctgcctcccgggttcaaatgattctcctcctgcttcagcctcccaagtatctgggactacaggcgaccaccaccatgcccagctaatttttgtatttttagcagagacggggtttcaccatgttggccaggctggtctcaaactcctgacctcaggtgatctgcctgcctcggcctcccaaagtgctaggattacaggcatgagccaccctgcctggcctctctcaatcttaaagtacaactcaggagtaattttttgggcatgtggaatttgtatacatggctaaaatgcatttttgtgttatagagggaacaaatagaatctcttcctgaggacaattgaatgtggtttcctggcagatgggggttggtttacccatgcacagttgagttgagagtaggtctgcagataaccactcctccatgagagagaaggcagaagaaaatcccatgggaaaaagacacatcagcctgtttgatggaacaaatgaagttttgaggggaggaggaaaggagagcagtacttaaatgaacaattgttggcctggcacggtggctcatgcctgtaatcccagcactttgggaggccgaggtaggtggatcacgaggtcaggagatcgagaccatcctagctatcacagtgaaaccccatctctactaaaaataaaaataaaaaaaattagccaggcgtggtggcaggcgcctgtagtcccagctactcgggaggctgaggcaggagaatggtgtgaacccgggagtcggagctcggagtgagccgagatcgcgccactgtgctccagcctgggcaacagagcgagactccgtctcaaaaaaaaaaaaaaaaagccaggcgcggtggctcacacttgtaatcccagcactttgggaggccaaggcgggcggatcacaaggtcaggagatcgagaccatcgtggccaacatggtgaaaccacatctctactcaaaatacaaaaattagctgggtgtggtggtgggcccctgtaatcccagctactcgggaggctgaggcagaagaatcacttgaacccgggaggcagaggttgcagtgagccaagattgcgccactgcactccagcctgggcgacagagcgagactccgtctcaaaacaaaaacaaaaacaaaaacaattgtgcaggctccctgatcattaatggtcttcataaaaagggcatagagcactaaataactgacacaaaattagggtggagttagaaaggtacttgtgggagaaaatttgtgacgctcacactgtgtctcactcaaagaggatctgcacaagcattaaagttctgagctcacacagaatgggaatgttgcaattctgtttgtttctgtttagaaataataatacctcagccaggagcagtggctcacgcttgtaatcccagcaccttgggaggctgaggtggacggattacctgagctcaggagtttgcaaccagcctgggcaacacggtgaaaccccatctctactaaaatacaaaaaataaaaaaaaataatttgccaggcatggcggcatgcgcctgtagtcccagctacttaggaggctgaggcaggagaactgcttgaactcaggaggaggaagttgcagtaagctgagatcgcaccactgcattccagcctgggcaacagagtgagcctccatctcaaaaaaaaaaaaaaaaaaaagaaaagaaaagaaaaaaagaaatagtaacacctcatcatacatttttcatgaatctttgagcctttgggaagacagcatagtttagtgatgagaaaagcaggtgccagattgccagggttcaaaacttatcagctgtgttactctgggaaaacaaacaaacaaaagaacaccttatgtgggcagtaatatattcaaagggctaatgttaagattaattgagacaatatatgtaaaaacatcataagtactcaagaactgctggctatgaacagcaacagctatacaattatgcattacaacaagaggtaatgtgtgtagaaccttagtttgcaaagtgttttctcatgcgtgttctggggtgggatcttacaggtctgagtttagatactggttcccttctcaccaactttgcaaacatggccaagttagttaacctttaagctgcagtttcttcatctgtaaaatgggatgataacagtatgaagctctcctcacaaggctaacaagaagacagaaacatagttaattctggacagaaatatagttataattgagcattaatcaggctgaactttgactcacttttttttgcaagcaaaagtcagggagcactagatactgaccacttggatccccattgttcctatagataggatttctagtgttagcatcataaggcttttgtttaagatagatagaatatctgacattagaatcataaagcttttgtttaagaattgctaaagcagatcctgaattctggttgaatagctgatgccaaccagtttgaagacccccacagaggaacctaatcagcattggaatacagtttctttatcttcctgctcatgacataaccctgtatgcttcaaccaatcatccatctccacactttgacccactctaaaacctttaaaaaccctaaccccagactcctcagggggatggatttgaggtatccttccatctcctcagtcagaagccctacaattaaacctctttctctgctgcaacctgccatcttggcatattgacttgctacacattgggcaatgaacctattatggttacaagtacataaagtataacttttatgtaaccataataagccaattatggttacaggtacataaagtgtataaagccgttctgaatgttaaattgaataatgtatgtaagttgcttagtgtatagtaagtgttcagtaaatgttagcaattgtttatcttcctatttattctcagaggtctgttctgaggagcctaagactcagagctggaagcattccagagcaggactgaaatcaaactctagtgcatgtggagcccttgcctgagaacattttccagtgatgacataagggagatgatatagtttggatgtttgccccctccaaatctcacattaaaatgtgattcccatgttataggtggggcctagtgggaggtgtttggatcatggcagaagatccctcatgaatggcttggtgccatcctcacagtaatgagggagttctcactctactatttcacatgagatctggttgtgaaaaagagtctgggacctcctgcctctctctcttgctccctctcttgccatgtgatacatctgctcccccttttgccttctgccatgaggaaaacttcctgaggcccaaccagaagctgagccaatgccaatgctatgcttgtacagcctgtagaaccatgagccaaataaacctcttttctttataaactatccattctcaagtgttctttagagcaatacaaaacaggctgacacagaaagtgtctcaggaaatgagctggaggctttcagaaggcacaccttgtacctgagccaaaaatgaagattctagtcccagaggccttaaagccagcaaaccctttcccatggaggaaggactccatttgaatctggcacagtgacacagagattctgtcactcccctaaatgagtacattaagttggcgttctccactaggcttctttctcaccatcaggaatgaaagccagtagggaagtcataatgggccttgatgtgcccagagagcccttggctgtcctcacagctctgctggccatgccctaaattaaagaaaatacaatacagggagtcaagaagtggggccagcttgggcctctttgatcagcatccatgatgctgtaggatgcatgattcagctctgagatctcctgctaagtcagaggtaatggtctccttacaggcacgtgtagcatttgcagcaagagacataaaagaactacattctgtttctgttgattctatcctccattcctcctacttattttctctttccccctccagttaactcccacattgtgcttactccgaccccaccttcttccttgtgaacccctaataactgagacaggtctcagtcaatttaggaagtttattttgccaatgttaaggatgcgcacctgtgacacagcctcaggaagtcctgatgatatgtgcccaaggtggtcagggcacagcttggttttatacattttagaaagacgtgagacatcaatcaatatatgtacaatgtatatggattcagtatggaaaggtgggacaagtggggtgggggggcttcctggttataggtagatgagatacaaaggttgcattcttttgagtttctgatcagcctctctaaaggaagcaatcagatatgcatttatctcattgagcagagggatgacttcgaatagaatgggaggcaggtttgctctaagcagttcccagcttagcttagtgattttggggtcccaagatttattttcatttcacatcctgtatgcagatgtctactcactcaactctgctactgagttttatatatgcatgatcctctgcatagaccacactgtcttgatgagtgtctatgcctgtctatgtacagtgttcactgcagtgtgcatgtgaatgtgtgtgttggtgtgacatagatatttagggtcagggacttaagccaaaaccatgaagctaaatcctaaaggaaacatactggtttgctgaactaaggtaaatctagaaattaagcttaccttgaaccaaagcttagaaaaaaagggcttaatttgatttaagacaaagaataatttttaaaaaaattgtttaatttttaaagtagataaaatgtttatatgattcaaaattaaataaacttttacacctatatttcttttttccacccttgtcctgcatatgtttattcacctttgcaaaccagtaacctgccaatgttttccttgaattctttttttttttttttttttgagatggagtcttgctctgttgcccaggctggagtatagtggtgcaatctctactcactgcaacttctgcctcccgggttcaagcaattctcctgcctcagcctcctgagtaactgggactacaggtgtgtgccaccacactcggctaattttttatatttttagtagagacaggtttcaccatgttagtctggatgacctcaatcttctgacctcataatctgcctgccttggactcccaaaatgctgggattacaggtgtgagccactgcgcctggcttccttgaattcttctagagattttacatttatatacaagcaaatgcaaatttacaattcaatctcttcctttccacacaaattagaaaactatgcatattattctgtatcttacttttttctctttataattcatcttagcaatctttcaatatctattcatagaaagtgtcctcattctctttatattaatacaactatacaatagtacaatagtctattatatggatgtactataatatgtttaaccaatcccctattggtggacatttaggttgttgtcaaatttcttgctacagtaaccagtatttactgcaatggataactaattttttttttttttttttttttttatatacagggtctcactttgtcacataggcaggagagcagtggtgtgatcacagctcactgcagcctcaacctcctgggctcaagtgatcctccaaccttagccctcgaagtagataggactataggtgtgtgccaccatgcctggcaaattttctgtattttttgtagagacaaggtttcaccgtgcttcccaggctggtctcaaactcctgagctcaagcaatctgcctgcctcagcctcccaaagtgcagggattacaggcatgagccaccacactctgccttgaataaccacttttgatagttgttgctaagttgcccacctacatgagacaccaaatgccatttgcaacagcgggtaggatagtgctcatttccttcttccatgatgacagtgtgcattagtacacttcatttttactaatttgatagtgaaaatggtatctcatggtagctcgagtaacatgagtaaggttgacattcatatatttaaaagctatatgtacttccttttttctttgaactgtctctttatattctttgcccaattttcttttggataattggtctttttttattggcctgtaggagtgcttaaaatattaaggacattaaacgttgtctgtgaaatgagttgcaaacaacttgctcccgtttgtcttttgacattgctcaagtagtttttgccaagcaaaattttgatttttatggaatttaatttttaaaaccttttcctttatgccttctagattttatctctcatagttagaaaggtcttcctgctctggatttatacaggaatgtttcttttaggacttactttttacttataatatttgattcatttggaatggatcctggtataatgcatcaggcataaatccaactctattttttccaaatggacccagagttgttccaacatcatatattgaatagtctattattttcctcactgatttgagatagcaactctatcataaatccctatatgtatttgaacctatttctaaatttttgattctgttgtactgatctgtcaaataacagaatatttaaaactgtgtaaatcactgagctatcagccaaaacagaaatatatcctaaaggacagagaaatttgggaaatgaaaataatactaaactgaagccttctacaggaatactcgcctttcacaatttcagtgtgaatctgaggagcggggccaggaaaaaggtcagaaggatggtcctgtgtgatctgaaggctgggcacaaacatccagatgatactcgtggctttgctatgttctccatgaagccttgcccgtccagccatagatatctggcccagggttgaggctctgacccaacagagagccaatcaaaaacctttccaggaatttctgaacttgagaccagaaagagaatcaggcagttcttggtggaggtaatcataaaatgtaaacctcggaactaccatgagccaggttttttctgcaagaaataggcagcagagaaagaataaaacaatacagagaaaaaagcagagatgatggaatactattcagcaatcaaaaggaatgaactacagatcacacaacagcatgaatcaatctgagtgaaatcagacaaaaataaatacctactagatgattccatttatataaaacccttgaaaatggaaactaatttgtaatgacagaaatcaggtcagtcacagctgggaaaggaggagaggagaagtgaggcaggtatgggagggggaaattacaaagagatatggggagattgggggtgatggatataatgatggtttcaaggtgtgtgcgtatttcaaaacttatacaactgtatgctttaaatatgcagtgtattttatcattttaattcaataatacctcaacaaagctgttttttttttttttaaaaaaaaagcagagatgggagggaaactagtagaaagaagcagaaaggagggttgtgagtaggagagagggcaggcaagaggaagaatggatttagattacatttgttctttagttatagatgcccagctgtgtctccaatttgttttcttaacctaaatttggattatgaggataatatagttatcattttgcccaagctgagtttctgacttttgcagacagaataataagaccaatatttacccacactcttcccaagaaagaatcagagtccattttgactattcttcctccttatctgtcacactcagtttatcacccagtacaaccaattctacctcaaaatatttcttgcatttgttttttcccttccagatgtgcagagtccaggctcccatcctcttctacttcgactcttttaaggcctcccaagggggctctcccccatcttctatctgccatgttgtttccaaagttacatatttagagcatagatctgattctttcatcccccttcttaaaaaaataatattggcaattggtgaccacttaacatggtatggtgctcactgagccaacccccagcgtcccctcccaaaaatctccagcagacccaccactctggcaagaattgaacctcagccatgccaagtatatttacccttgagtgctcttatcttatttgtccacctgacaaacttccaacatatttaaaggcccaactcaaatgttgcctttttatatctttatttggctctctccggctgaattaattgttccttcatctgtgttcccatagctcttatcatctctgttgtggtgattaatgagtctgtttttcccacaagatgataaacttctaaagagcagaaagtgtgtcttatttatttttatatccctagaaacaaggatacttcacaaaatgtagcaggtgcttaattaatgtctgtgtaattgatttaaatcgagggaattgaaatagatcaatggttttcaagcctttttgaatacccctcagtacaactctttaaaaacaaaatggtacaaggaatctcaacacgtagtttagatgaaggtggaactgatcttgttgaagagtaaattaatgtatttgatgcagatactattctggtatttcatagttttctttctgtctgcatctatatatataagaggtttgcttttctgccactttcctcgatttcctcatcttctccatcacctgatgaagactccattcaccctttttagatagaagtatctgtaacccttctgtatcatgaaatatcccccaaaacaactctttgtgctaccaggcgcccctgctcacagctttcatgtatcgtcaaaaattcccagtcatgaaaaaaccaaatgaacaagtttttggacaaagctgtctctgaccacagagaaagacagttctcataaagaggcttctgtttgctcaagttactaagctagtttccaaacaagttaaatgcaagcttaaatgtgtctctaaagtaccaaggagtctgggagtgaaaccactagttaagtcattcattcctcctgaggttaaataataataataggagtgcttttcctatttattcttccttcatgcagagttttaatttaaaattttgagtctgttgtcttttatttccagaataccgctttataaaattgattctgacgttgttttttgtcctgtattatctaaagagataccatgtattaattcttcctgcaattttataaacaaaactcattcaatatagaacccaatgggctacatctgtaacccacgggaagcattcagaatatttgtgatgtatcaaatttatgacaaagataaaactaaagcaatttcattgtgtttgtaggcaaaacgagggcatttagccagatgttcaccaagggctcttccaaccttgtgagtttatgattttagggcaaatgagaacaacagcataggtttcagattaattgtgtgagaagtatattgtctttgcacagatgaatagaacataacggcaacgaatatcaggaagaacatttccaaaattatcttaaatgctttattattgtacagcttcattttttggttttcttactttgtaagaaatgccactattgtggggtttcaagcgtaattcagcaaatggtatgtctaattgtaatttcttccatattcccaggacagaagccacaggaccaagagccattttgcaaggtcaatgggactaagtgagaaaaggggagaacattatccagttgtttatgtgtccagaaagagagtttttcaaaagttcatctcttggtaggaattcaaaatgcctttgcccaaaccattgagactatatggttaggttaccaggctagattctaagagcctgtttaaccctaaatataaaaagattattaaggcagacatggtggttcatgcctgtagtcccagctacttggggaggctgaggcaggaggatcgcttgagcttgctcctgggctgcagtgctgtgtgctgatcaggtgtctgcattaagttcatcaccaatatagtgacttcccgggaatggaagaccacaaggttgcctaaggaggggtgaactagctcagtttaaaaacggagtaattcaaaactcctgtgctgatcagtagtggaatcacacctgtgaatagccattgcactcttgcctgggcaacatagcaagaccccacctcaataaataaataagtaaataggattcttcaaaattttattttgatttatttagcctcatgtatagcatctttttcttaggaaaaaaagtccacactcccagctgtaatgccatagacatatctcccccagcccagcagtagaaacagacttgcagtgtgaagacagtctatgggcagggatcggtgtaggtgatcaaatccactcagtacacccaagctttatatctgcctaagagaaggcaaaattgttgcaaactggagaacaaggaaaagttaccttgaggagtggagttctgagtgtcaactctctcccttgctatatttaaattatattacacattgaatattcacaaagggctgcttgtctttgcattcattttgaatcctgttttgtgaccatgattggggacgcaaaggttttttgtcctttgtcatacttagtaaatggttttatgttccttgattatgatacatttgtttttgaaattcattgcaatatctaaattgatgattatcacaaatgagtgtcagtgcttggctgtcagtgtttttcttttagcagaaatgaatgaacaacattttttgaattactatcttgtgggtttcatttttaactactggaagagaaaaaacacagaatgaaaaactatattttgaaccaaacatgagctcaatcattcattcaacaaacatttattgagtaccaatcattgggctaagtgctttggagtataaaaagatgaatgaattgcatttcctgaactcatggaacatgatttgaggaaataagacagataaataaatagctctactaaaggtaaagtgaataaataccttaagagatgacagagctcttcgggcatcaaagtgggagcggagaccccattcagctgagaattttccagagaaattggcacataaactgattcttgttagagagggaggatttaaaaagtgttgaaacgggaccccgaggggagagaatggaaaaccactgatggttttagaaaggaaaatgacatgggttagctgtgtggtttagaaagatcacagatactagctcggtggctattgtaatgattcaaataaagctgtgagccaggtaagagaccgcaaatgtgaatggaacacacagatttgagagatgcttcagatgcagaatcaacaaaccttggggatgctttggaaacaagaggtggaaacacagatctggcaatcagtaaaggtaattactaaaatctaaaaatgtggttcttaagcttatcaagcacaagaattacctggagagcttatttaatggcaggtttcaggctccactctgccgagagaagattcagtgttgagcccaggaatctatttttaagcagcatcccagaagatgtggatgcaggtgctgggctgatcacactttgaaaagcactgcgatggaagtggaggtcccccagagtgcctaggaagaacaaaagcctcctgagaacagcttttgtgaaccacctacactcaggaggtgggaggaggaggggaatctgcacactggagctcctactgtgtaccccatgcttttcctgggatgtcctactgtgtgccccgtgcttttctatgtcctgggatagcaaggccttgacttcttggagcctccattctaatgtaaaataatacatacagtagacaaacacataaatatataacatgggtttaaatagtgccatggagaaaataaagcagaataagggcttgagagtgatgggacatggggaagtgggggaggggggaaggggagtgggggtggaggagcactttttgattgaataaggagaagcctctcaggcagtgacatctgagtagaaccctgagacgaggtggccataagaagatctggaggaagagcattccaggcggagaatgagatgcgtaacaattctgagttgagaaacagctggttgtgtctggggaatggctgcagggccaggcagggtccagtggggctgtagcagagtgagtactggggaggggagcaggagaggaaggcagaggagccagcaggagctgggccagggaaggaggacttttggctgtggccttgtaggccatggtaaaggtcttggagcttattcttagatgtgttggggacctcactgggagctctgaggagagtgacatgatctgacttgctttttaaaggaccagtttgtctactgtggatggtagaaagtaagtatggagtggaagactcaccagcaggccactaagctggtgcccagagatcacagtggttgggccatggatgggagcaggggagatggtcagaggcgggcaaacctgacatgagttttgaaggcagaaacaacacaactgctgaaggattagctgtggtatgtgagagaactttctggttttctagtgttttggcagaaggaacgattgaacatttaagaaataaacatgatgtaatgggatggaaggcaaaggaaaagaggacatcagagccttctatgtcttggtattgctaatgccttgcaccatgatgcgcagggcaagctcttaacaaatatgttttgaatgaatgtttggatgactcaatgctgcatttaagctagggaggcaaggactgaaaaagccattagatggtataattaagatgctgttgggggtcaaggtggacggttatgttactaaccagatgagggacatggaggaagctgcggttttcgggcaagaaggtaacagtttacagaggtgatgaggaagatcaacagaggagaatgggccttggcagggctgagctgacaccgatgagggagaggagtttgaacctagagtggtaacctagaccaactgaataatgtctgataccttgaagcagcaccataattaagtgctaaatgattcttcaccctctcctgtggggacatgtgtgtatgtatagatgagtgtgcttatacatttgtggagatttggatccatgagagtggtgtttgttaagaggaaaaggtgtttatatcttgagaaatatatctttgtgccagcaaattgcagaagaactttcttccatgcttccctttctctctttcatctctctcccttcattcttcctttttcttccacctggttttcttcattaataattttatattgattacatgttaaagtgatattattttgaacatattgggttaagtaatatataagtaaaattaatttcacatctcttgtaacttatttaatgtggctactaggaaatgtaaagccacagatgtggctcgtgttgttttccatgggtcagcgctgctgtggagcctcacactcagcggcaatgttcttgcctgctttaaagacctttaatcaatgagctaagatactcccttggaaagaggttctaatttaactatcctggtaaacaagaaggaaataaaggatttctgaccaaggtcatactttaacaaggccctaggacaaatgggagtagatgttgtgtttccaagctgaattggtgacttaaagtgtgtttcaaaagagcctgaggctactttctaaacaataagtcagtggactgccctttgtgtaagtgtttctaagcataggtaaactttgggtgtcctttcatctgtgaccctatgaactattttggtcagaaaatatggttgcaaaaggcttaccccattccagtaaacagcatccattatcacttaatggatagaatcttggagaagtagttcacatgtataacattttatcttttccagacaggcccattaaattagttttaagtacctcataaaataaggccatattccaagtttgtgttcctataagattatctttaaataaaataatataaagaccttttctcttgacacaataaactaccattttaatacaacctcctgaatttgagaaaattgtcctatctaagtaatcacttttaattggttaaacaatctgcctattctatgcaaacttacaacagcaaaactgataccacattgggctagtaccccacctgctttttttttttttttttttttttttgagacaatcttgctctgtcacccaggctggagtgcagtggcacgatctcggctcactgcaaccgccgcctcccaggttcacgccattctcctgcctcagcctcccgagtagctgggactacaggcgcccaccaccatgcctggctaatttttttttatttttagcagagacggggtttcaccgtgttagccaggatggtctcaatctcctgaccctgtgatccgcccatctcagcctcccaaagtgctaggattacaggcgtgagccgccatgcccagcctatatcacctgtttttaaagatatgtgtacaagtttttgttgcacctgcttcggttttgggtggtatatacaaaggagtggaattgctagatcatatgctaattttatgtttaacttaatgaggaaccaccaatcaactgagcaccttttacggcatcctctctgaagactttcttgaactgtcctttccccttccacccaagttatccctccttctattcccaccatttccaatttacacatctcttagcacttgaacttgagtttaataaccttatattacctgcctcctatcagtagtttgtaaacctcttaagagcttacagaccttattttcctttgtattgtttacttcaactccatttatctttgatgtagtaagccctcgataaatctttactgggcaaaatcatagaaggctgttctgggtgcagaaaagacttagcttcaaacagggtgacttttcatttggggaaccaagaacttgagatgttgtgaagtggtaattgctgtttttatctgtaattgctgagactatgctggctcaccaaggttgctattatatttatttagacaagaaagagagggtgtatgtgtctgtatgtgtggggaaagggaggctgtatttggtatgctacagctttttgacagtaagctacatttacaaaatctgtctaccagccaagtgacctcaaccaatgtgggaggaacttctcagaacttcaactttgcacaagcctgagttgctgggctcctggctggatatgtagatgtctgaaaatgctgcattttacaagccatggttctgcctagggaggctaaaatttttggtaatcttgcaaaaatcacaagggttttaattaaattgcttccagcaaagctttacttaatgggtcaaaggacaaaatgttgaattaacacaaagaatttcctaatggagtgaaaacaaatgggaggtggcttctctcgtgaacttcctgtaattggaaccaccaatcagaggtgttggcatgagggctccctgaaggaatcctttttttttttttttttttttttgcctctgagtcagcatacaaaatgaaatgctgaagaaaggttggctttccaagtgcatcattgctgaggatcagacagagaagctaaggcattgcttttctgcttgctaagagcttatcatctagctgtagaggtgtgaaagggacacaaaagatcataataaatgtaggtagcatgtaagagaactaaaggaataatataaacaattggcattagtggcgttagttgggatggaagtcgaggggcgagtgctcactgcagccttgggtgggaagagagatgtcacttgagcatgtccttgaattgtggagaagttcgttaagacaggcagagagggtgctgtgtgccaaaggaaaagcatgatgattgtgaaaagcgtgtgaaggtcaagggccatggagtaatctagtttgaatcgagtaggacattcaacggtgctgatgcaagaatggtatgggtacgttgagaaccagattgaaaagagcactggaaataaaaataagtttaggcaaggccaagcatggtagctcacacctgtaatcccagcactttgggaggccgaggcaggtggatcatctaaggtcaggagttcgagaccagcctggccaacatggagaatccccgtctctactaaaaatacaaaaattagccgggcatggtggcaggtacctgtaatcccagctcaggaggctgaggcaggagaatcacttgaacccaggaggcagaggttgcagtgagccgagatcatgccactgcattccagcctgggtgacagagcgagactccatctcaatcaatcaatcaataaaagtttagacagattttcttctgtagggagtgagaagtgtttaggtttctgagcgggagaatgatacattgacagttatatttacagcaaagtaatctaacaaggttttgtggactggcctaactggagaaaataatggaaaagagaaataaattaagagcctattgaaatagtacagctgagaacagagaacttgaactacagtggtgggaatagggatataaagaagggtatggtgggggcaggtagacccaatcaataaagttgaggtctctttttttttttgagatggagtttgcttttgttgcccaggctggagtgcaatggcgtgatctcggctcaccgcaacctccacctccggggttcaagagattctcctgcctcagcctcccaagtagatgggattacaggcatatgccaccatgccaggctaattttgtatttttagtagagatagggtttctccacattggtcaggcttgtctcgaactctcaaactcaggtgatctgccttccttggcctcccaaagtgctgggattacaggcatgagccaccgtgcccggcctaagttggggtctctttagttttaggtaggtattttaaattgatgggttttatttttaatgtctctgttcctacttcattttccccagacactgctctgttggacatcagaatcccttagctgaccaacacacagtcatgggactgctctcattcatagctttggttctaacctcaagtgggtcccaagtgctgcctggcagtctgagcacatttctctagtggattcactggagtatgagctctgcatggacagagatctctgtgctatcccagctgcctggaagagtgcctggtacatgacatgtgcagtgaatgtgtatggctaggcatttcatattctctcgcctttcctcagacctcaaattcatttaccacaatttgcactcagctgttggtcttactacttgttccactgtgaaaatagaattaatctgaagagaacatccacacactcccacaacaaagtcaaccagcccacgtgcaaccttatccacagggctccttcccactcatcaccattcagcttgtcccagctgctgtctaaggctaaccctcccaactgtgcaatggatattacccttcctactggttgactcttctgtctcctgcatgatcagttttgcctctcaatgggataattcccatcagtatacagagaagttctggaggaatccctgaggtggaaaagcaaagaggtcctctggtgtgtgtctgaggtaggatgctagcaacttgcacagacctgtccgcagggctgccttgaggtgggttgcaggcacccacaacacctgctaaaggagtttacacagttttcccagtacataattttacacctgaaaataagtaggtgctcgataaattgtcactgaagaatggatatctcccatcttcaattgtcccttccttgattccacatcccttccagctaccatcccatttatctgcacccttttttggcaaaatccacaagatcattgtttatatactcactgtcttctcctgtcctcttagtctctcttgctgtcacttgtttggacttttgtctttactcctctactgaaacttctcctttgagatcaccagtgacctccattttgccaaatccagttcttagaccttttctgatttgacctttcaagcaccatttgacaagtgagtcgcctcttcttcccttttcctcactggccccttcttctcagttgaatttgctgcttcctattcagctctccaatctcttcatgttgtagtctcccagcttctgcccccagacagctcttttctatcaccctctccatcttaatgtcctgtctcagtgctggtgactctcaagtgtacatccaggccctggatgcaagactcatgtattcaacatctcctcttgggttttgaatagacatttctctcttctaaatttcaggcacatagaatcataatctgtggttgatgacactcttgtttttgtcagtgcttggccctctttctaaattttatttatttattgttttaaataatccaataaattcctgtgaacacacatcccaatacagaaaatagaacattgacccaaggcccacaaggccctacatgatctaactctatgcgtcctcatctgctagcattctccttgctgttcctttggcatagtctttgaagttgctatttcaactgtctagaatactcttttctgagatatcttcatgtctttctccctcattttatttgcgttgttacttatcagtgaagcctcctcagcatcttcattaaaaataatattcttgcttggctcctgatatagtttggctgtgtccacacccaaatgtcatcttgaattgtaattcccataattcccatacttcccatgtgtcgtgggagggacctggtgggaggtaatcgaatgatgggggtggttaccctcatgctgttctcatgatagtgagtgaattcttataagatctgatgttttgttttgttttatttgagatggagtttcactcttcttgcccaggctggagtgcaatggcacgatcttggctcactgcaacctctgcctcccaggttcaagtgattctcctgcctcagcctcctgagtagctgggattacaggcatctgccaccacacccagctaatattttgtatttttagtagagacagggtttcaccatgttggccaggctgttctcgaactcctgacctcaggtgatccacctgcctcagcttcccaaagtgctgggattataggcatgagccactgtgcttggccgagatctgatggttttataaggggcttttcccccttttgctcagcacttctccttgctgccaccatgtgaagaaggacatgtttgtattcccttctgccatgattgtaagtttcctgaggcctccgaagccatgctgaactgtgagtcaattaaacctctttcctttataaattacccactcttggatatgtctttattagcagcatgagaacggactcatagagctcctaggtcactttccaatttgcttattctgatcatcacctcctttaacttattatgtgtgtatttgtttattgtctgtcttctcccagtagattgtatgctctgtgagggcagggacctgttcttgttcactactctaagccacaagctagaatagtacctggtacttggtagccacttgttgcaggttggttctctgggaagcagactctgcaataatttgatgtgcatgacttctattagggagtgctcttaggatcaacagctataaaagggaaaagaaggaaacaggatggggcagaggaagaagttgagctgtgatgcagtcttgacgatagccccagccaatctcataggaggctctgaagttgttccaaattagtgtatgggcctgaacctttataaacccacatagaccagttattcatgcaggttgtcctagaaagggggcatgactttggagaaggggctctttttaggtagacaattgtattgtgtgataagggctgagggcttgctgtcagcagcacccccaggagctggatagcacatcacagtgtccgtaagagcacccaataaggtgtatggttgaacacatgaactcagtgagatctaaaaacagagtggatgcagtgaggttcatgacatgcaagacagaaagacaaggagaaccaggtcagtgaatcctcatgcccaaagtcctccattttcttgtttatccattttcctattatagacaaagccctgtctgggtactataagggatctaacatcacagacaatgtccctgacctcaaggaagagaatgaaacctaggcacaaacatccatggtacaaagcattgtgatataatttacatgtatagcacaaatgggtgcttatagaggggaaagagaagggagagcccttcccgcagagggaaggaggaggaaggcccagggaaggcaacatggaggaggcttttgaagccctgaaagagaactaagatttcgttgcacaagggaggacagagggcagccagcaggaaaagaggtagtagaacaagggttcagttgtagaaaatcccaagcttggggtcaacagtcctctctcctcctatgctctgatacttaaaggttggaggcttgaccacatatgaatccctcaaatgccatacaacccgtgtgttcaggtcaaatcctgaaagaggaaagaaagtgctgcctctttgcctgccaacacaatcagcctcaggggctaaatttgtagttctgtgtgacttgttctatttttaaaactgtaatgagccagtaaatctaatcatccaaactgtaaagcagtccattgtatttgggaaatggagtgtaatctgcatggaaaagaccatacctttctgaagagaaaccaatgggatgttagctgggtccctggttttaaaagtttagactcaagtacgtggtataaaactcatcactagggtaatgttacagatgaagaaactgaggcacagaaaggtgaagggacttcctcaaagtcacacaacagatcagtgtttgaggtgaaatccaaccataaacacacagtccctgcgttccttgaacagccctctaaagcttttggtcagagctccttgtatgatgtctgctttcctgcttcttgaattaaccgcaacaagagccactggccagccaatccagctgcaggtcaagtggcccctctcatctaatcgtaaccactgcaaagaggcctgacagcaatggagtcagcttggagtgtgttttcttgtagctcgtggatggcaagcccagaaataaactatgggctttattgttggagtaagagaatgatttacaaggccctggcaggtcatcggccttggctctgatggaaagaaggaaatagtctggggctgcaatttcagggagtaacaaatagtcacttgaaaccatggtttcagcttgagattccaacttggctttgtgttttcctgccagttaactaatttctgtttgcctaacataatcaaactgagtagcaacttcctcatgtgcttctaaaacagtctcttcccccactccccatactagaaaggcacccagcattttttaaggaactagactcctttgactattgaacagtgatctcagactttagcttggaatgtgtagagtatcttgtgatcagaccagggaccaaggtgaacactgggtgccaatagcagttactgcagggtttgactttctagaatcaaaacccagatgggaaatgacactgtcagaaattaggcctgaaagatacaatgagcccacatacaaaattattcaaaatgtgttatcagacctcaagaaatatagaagcaggtaaatgtttattatttattccaaacgtgatggcttttaactagtgaagaggcacgcccagttttcttagtagcaagccacatgaccacagatacctgggtgtggaccacatgaatcctttattcataattatgggaattcaaatggtccatgcttgccctacaagttctggcagggaccaagtacatacagatgttcagttgataccaattattctatttgtcaggatcccccacaatgcccagtttcaagatgaaacttgggtaggatgaaaggttatagaattacactcaggctcaaatatcatcattaatgtataaaagccagctagtgttagaccaggcagaagcagtgtgttaggccattcttgcattgctagaaagaaatacctgagactgggtaattaataagaaaagaggtttaattggctcatggttctgcagactgtacaggaagcatagctctggcatctgcttggcttctaggaaggcctcagggagcttttactcatggtagacggcaaagagggggcagacacatcacatggaaaagcaggagcaagcaagagagaatgaggggaggtgccacagacttttaagtgaccagatctccctggaactcactatcacaaggacagcaccaagccatgggggattctcccccatgatcaaacgcctccaccagaccccacctccagcactggggattacaattcagcatgagatttgagtggggacaaatacccaaaccatagcaagcagttacacagctgttgtgcttgtgtgatggagcttattagatactagtggcccgccagcttaagggttaggcaactcgtaaaaacgtttttgcttttctaaaaatcttagaccagccactccttatgggtcacagtttggagactacagttcaacctgtcacttgttagtgcctcaagtttccattctctccatcattcacttctctatgccagacttttgtccaattgtcttgttcaaagatggattaaccatgccattaacttgaccctttcacatctactaggtacctgattctatcgttctccgcatggctgcaaatctcaatttaatcatttcttactattcagattctaccatgatggcctggtggtggtgatggtgtgtgtgtctgtgtgtgacatacgtcatcttgtttcgttctaaaagcagccatgctcattcccattttacagatgacaagatgagaggatgcagtaatgacatggtaacaggtgccagatgaatgcagacctcataggccaggacagtttagctcaagtgggaaacgactggagggttgttaggaagtacatgatgtgatctgccttatgcatttgatcactgtggctgccactgtgtgaataacagacttggtgataagagtatcgaggagcctgcgaggtacttcagaagagagttcatagcttctgttgcccattgctaatccttgatcttcactcacccagcaggctgaaagcaagtgagggaagctttggtgctgcctaggatagcaagatactggttcttctcccacatcccctccacccattgctgctcaagtgccccttgggtggagtggttggaagcagactcaacaggactgactgctgtcaaaccctcttccctttcagactcagtgacactgatggctctacctcaggaaggccacgagccaagaatatcccataaggctaagatgcttgatagcctgctttggtttggttctggttttggtaagaagggagttatggggtgttgggggacatggggaaagaggtatgatgatgaaagacaaattgaagtaaaagctggctgcgatgaccagtgaaagagaggaaaggagaagaaaggaagtcacagaaagtgcccacatttaccgaagattcttatgatgccaccaatccagggactatggaagcagtaaaaagagggtttggggcttcatcccacttttgtgtccctcacaaatgtttggggtggcagattattctgcctaactaccattccaacccctttcctccctttatatctcccttcatttttttctttctctctccctcccttccttccttccaacctgagaggcttttgatctgtcatgtagctgatttcaggatagtcattttctttttacgtgtataaggcactttcctactaaatcggagcttcccaagaacagcaattgaatcttataattgtacctcctgaggtgcttggtacatgctacatagatgattgatggatcctggcatgattgatgccaaggtctctcatctatgagacagagataagcattctgatttcgtggcttgttagaaagatcaaattagacagcatgtatgagcatctctgacacacagtaaatcttcttcaataagtctatgaatctgaattaactggggtctttccacaatcattgggccaaacccatcatcagttatttggattgggtggatgtggccttagtcatctgtgtctaagaccgcccactgggagatgggtacatctctcattatgggaagccacagcagagtggggcaacatgattttctgatagggccacaagttctgggagtgattatattggaccagcatttctgaattcataattgtcagtttcttacctggaagtttgcctccccaagctaagttctccctctctattgtgtgtcccatggtcactgaagacagctatgcttttaataagcaatcatttgtggagcggctaccagggacaaggcattatgttaggggctgtgagggagaccgacagaaccaccatttgttgagtattgttttctgtgtaccaaactctgagctaggccttttatataccttatttcatttacaaagatgaataaagtttctcaccatgaggaggtaaatattatttaaggaaataagcatatagacacaaaaggataatgaagaaggaagaagtcattgctaagggtgtggtcatgaaagtctgcaaatgaaaagttggatttgatatgggcttgcaaggaccagcaacatttgggaagggagagagaagaaaagtaggccaggccggacgcggtggttcacgcctataatcccagcactttgggaggctgaggcgggtggatcacctgaggtcaggggttcgagaccagcctggccaacacggtgaaaccccatctctactaaaaatacaaaaattaggcaggcatggtggtgggcacctgtaatcccagctacttgggaggctgaggaaggagaatcacttgaacctgggagacggaagttgcagtaagccgagatcatgccactgcactccagcctgggcgacagagcgagattccctctcaaaaaaaaaaaaaaaagaagaagaaaagaaaaggaggccatccactggaagcattgcatgagcaagtctacaaatggggatgaatttctgtgcccatcaggcattgaggaacccactcctgaggactgagtaggataaccccctccaataactgagagacaatagcgtcagcgtcaaacaaacttggactcaaatcccacttgtgtcacacactaactaaattagtaaacctttctgagtctcaatttcctcatctctaaaatgggaataaaacgtttcatccccagagtctgaaagaggattagatcaagttatactatatgtaaagtacccagccctttatgctggcaatagtgagaccagaaaaacagtttacatcatgtactatgtggaaattgattgagcttctggtgttagagccccacatggtttgcaaaacattctcacaaacactacctcaacagagatagcctcccaataatcctgtgggtaggtagaggtggcatgactctgattcccattttaaatttgggaaatctgaggtttagagaagccttgactttcccaagttcctggctttagggtcagacagacctgagttcagaagctgactctgtcagtgagcagcagggacacttaacctctctgagcctcagcttctttatggcctgtggtcaactttttacatccacattatttcctaaatatttaattttattatttcaattcttgaatagatagtacaagtttcaaaaattaaaaaaatacaaaaagctacatgatggaaagtctccctcccacttctgtccattatgtgccctgttccaccacatcctatgggtaatctgtgactcctatgctagttttctgtgtatccttttctggtctctttatgcatatagaagcaaatccaaatgtgtgtgtgtgtgtgtgtgtgtgtgtgtatatatatatatatgtacttctgcaatttacatcattttttaccaacacatcttgggtattttttcatatcagtaccttccagcttccatatttttttcacagttgcatagtatttcattatatgactatacaccacctttacctacccacaggattattgggaggctgtctctgttctggtagtgtttgtgacagtactttgcaatccatgcagtcctttttttttttttttttttttttttttttgagacagagttttgctcttgttgcccaggctggagtgcaatggtgcaatcttggctcatcacaacttccacctcctgggtttaaccaattctcctgcctcagcttcctgagtagctgggattacaggcatgtgccaccatgcccggctaattttgtatttttagtagagatggggtttctccatgttggtcaggctggtctcgaacccctgacctcaggtgatccacccacatcggcctcccaaaatgctgggattacaggcatgagccaccgtgcccagcctgcattctcctattgatgggcatttaggtcattgccaatcttttgctattataaacaatactgcatattgcatataaacatttgcatataaacaatactgaataaccttgtgcatatgtcactttctatatgagtacactgtaggataagttcctagaaatacagttactagatgaaacaatttgtgcatttgtaattttcatagctgttgccaaattgtcctccatcaggttttactcccacccacagtgtatgagagtgcctgtttcctcatgtctttaccagctcagcatgttaccaaacccttgtatttttgccaatctgacaggtaagaattctatcttgagggagttttaatctgaatttgtcttactatgaatgagattgagcgtatgtccatatatttaaacaactatttgtattttcttcaccgtgaactgtatgttcataatctttgcccatttttctactgagttgttgggctttcatattttataagaaggaaatttacatagggaaaagtgtgtattagaaacctaagccctttgtttgtggtatgagttgcaaataactttctcatgttgattttgctccttacgtcagttatttttttctgtgtacaaaccatcccaaaattgtttggctagaagcaacagtcacttgtttgctcaagattctatggtttgggttccgctgagacagttcatctgtattcgtatggtggtcacaggttccaggaaacagcaagagagcaagcaccaatgcccacgtgctttaagaccctacttgcatcacatttgttattgtccctgtggctaaagcaagtaatatggcaaggctagagttaggatgggaagggaataccaaagatgtgaataaaaggaaggaattttgtggctatttttgcaaacaatctaccacacttatgacatttgtttgcttggtttttatttcttttcttggtgatagtggtgttagtttatttttctatcaagtatgaaatttttaagtaatgcagtttgtaatgcaatcttttccttcaaaggttctgagttttgaataataattagaaagcccttccccactctcagcttatgaaggtaattcctattttcttctagtacttttacggcttcatttatcacatataaagtttgatccatttagaattcacctttgtgttcactccacatatatgttcttagctaaagcctagttctcctctatttgggaaggttgtcttttcattcgggattggcaaagttatgaccaataacaaacaacttttaaatctcagtggcttttaacagcatggtttatttctggctcattctatgtgcccatcatggtttggcataagctcagttccatatgaaccttcctccaggccccaggccagtggaccacttccatctagtcttccattaccagtctcgcccagagggagagaaagcacaaccaagcatgcactgcctctcacagcctcctcttggagatagcccatgtccctcccattcatatttcattggctaaagcaagttacatgaccaatcctgctgtcaacagggtagcaaagtacaatcctcccgagaccttagggacagcaaatattgggaacatttcatcctccatcatcgtcctttctgttgatgtgcagctttgaaaaagcacacacctggagccagaagcaggctggggagcccatctcaccaggtaggccggcacatcatcactggcctgtgatgatgtgtctcagagccaaattaaccccacacccaacctttctctccaagatcttgcatcctgctcagagcagagagcatgtgtgcagtcaggagcagcagagtggagatagggaggaaagtgggaatcctccagggaacattaggatcaaactgtgtcccactatcttaatccatttgggctgctttaatagagtaccatgaactgggtagtttaaacagccaacatgtatttctcacaattctgaggctgaaagttcaagatcggggtgtcaacatggtcaggttgtggtgagggctctcttctgggatgcagactgctgaccttttgtttttcctcacatggaagagagaaggtgagagagctctccggggtctcccagctttttgttgtcgttcttgttgttgttgagatggagtttcgctctgctgcccaggctggagtgcaatggcgcgatctcagctcactgcaacctctgcctcccaggttcaaatgattctcctgcctcatcctctcgtatagctgggattataggcacccaccaccacgaccagctaatttttgtatttttttagtagagaccaggtttccccttgttggccagggtggtctcgaactcctgacctcaggtaatctgcccacctcagcctctcaaagtgctgggaatacaggcatgagccaccgtgtctggccaggggtcccttttataaaggcactaaatctcattcatgagggctcctccctcatgatctaatcacctcccagaggtcccatctcccaatgccatcacatcagggattaggatttcaacatatgcattttggaaggacacattcagtccatcacacctcccaaaaagatatactagagtcctaaacatccccctttagtacctcagaatgtgacttcatttagagttagaatttttttttttttttttttgagacaaagtcttgctctgtcacccaggctggagtgcaatggcatgatcttggctccctacaacctctgcctcccaggttccagcaattctcctgcctcagcctccccagtagctaggattacaggtgcacaccaccacacccagctaatttttgtatttttagtagagatggggtttcaccatgttggccaggctggtctagaactcctgacctcatgatctgcccaccttggccttccaaagtgctggaattacaggcatgagtcactgtgcccagcctggagttaggatctttagagaggtattcaagttacaatgaggtcattagggtgggtctaaatccaatatgaatggtgtccttatttttttattttttattttttattatactttaagttttagggtacatatgcacaatgtgcaggttagttacatatgtatacatgtgccatattggtgtgctgcacccattaactcgtcatttaacattaggtatatctcctaatgctatccttcccccctccccccaccccacaacaggccccggtgtgtgatgttccccttcctgtgtccatgtgttctcattgttcaattcccacctatgagtgagaacatgcgttgtttggttgtttgtccttgcgacagtctgctgagaatgatggtttccagcttcatccatgtccctacaaaggacatgaactcatccgtttttatggctgcatagtattccatggtatataagtgccacattttcttaatccagtctatcactgatggacatttgggctggttccaagtctttgctattatgaatagtgctgcaataaacatacgtgtgcgtgtgtctttataacagcatgatttataatcctttgggtatattcccagtaatgggatggcttggtcaaatggtatttctagttctagatccctgaggaattgccacactgacttccacaatggttgaactagtttagagtctcaccaatggtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcacccactttttgatggggttgtttgtttttttcttgtaaatttgtttgagttcattgtagattctggatattagccctttgtcagacaagtagattgcaaaaattttctcccattctgtaggttgcctgttcactctgatggtagtttcttttgctatgcagaagctctttagtttaatgagatcccatttgtaaattttggcttttgttgccattgcttttggtgttttagacatgaagcccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaacagggaatcctttccccatttcttgtttttgtcaggtttgtcaaagatcagatggttgtagatatgcagcattatttctgagggctctgttcttttccattggtctatatctctgttttggtaccagtaccatgctgtttcggttactgtagcattgtagtatagtttgaagtcaggtagcgtgatgcctccagctttgttcttttggcttaggattcacttggcaatgcgggctcttttttggttccatatgaactttaaagtagttttttccaattctgtgaagaaagtccctggtagcttgatggggatggcattgaatctataaattaccttgggcagtatggccattttcacaatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagtaattgtgaatgggagttcactcatgatttggctctctgtttgtctgttattgatgtataagaatgcttgtgatttttgcacattgattttgtatcctgagactttgctgaagttgcctatcagttttaggagattttgggctgagatgatggggttttctagatatacaatcaggtcatctgcaaacagggacaatttgacttcctcttttcctaattgaataccctttatttccttctcctgcctgattgccctggccagaacttccaacactatgttgaataggagtggtgagagagggcacccctgtcttgtgccagttttcaaagggaatgcttccagtttttgccaattcagtatgatattggctgtgggtttgtcataaatagctcttattattttgagacacatcccatcaatacctaatttattgagagtttttagcatgaagcattgttgaattttgtcaaaggccttttctgcatctactgagataatcatgtggtttttgtcttcggttctgtttatatgctggattatgtttattgattgcatatgttgaaccagccttgcattccagggatgaagcccatttgatcatggtgggtaagctttttgatgtgctgctggatttggtttgccagtattttattgaggattttgcatcgatgttcatcagggatattggtctaaaattctctttttttgttgtgtctctgccaggctttggtatcagaatgatactggcctcataaaatgatttagggaggattccctctttttctattgattggagtagtttcagaaggaatggtaccagctcctccttgtacctctggtagaatttggctgtgaatccatctggtcctggactttttttgttggtaagctattaattattgcctcaatttcagagcctgttattggtctattcagagattcaacttcttcctggtttagtcttgggagggtatatgtgtccaggaatttatccatttcttctagattttctagtttatttgcattagaggtgtttatagaagtctctgatggtagtttgtatttctgtgcgatcggtggtgatatcccctttatcattttttattgtgtctatttgattcttctgtcttttcttctttattagtcttgctagcggtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttctctagtacttttaattgtgatgttagggtgtcaattttagatatttcctgctttctcttgtgggcatttagtgctataaatttccctctacacactgctttgaatgtgtcccagagattctggtatgttgtgtctttgttctcgttggtttcaaagaacatatttacttctgccttcttttcgttatgtatccagtagtcattcaggagcaggttgttcagtttccatgtagttgagtggttttgagtgagtttcttaatgctgagttctagtttgattgcactgtagtctgagagacagtttgttataatttctgttcttttacttttgctgaggagtgctttacttccaactatgtggtcaattttggaataggtgtggtgtggtgctgaaaagaatgtatattctgttgatttggggtggagagttctgtagatgtctattaggttgctttggtgcagagctgagttcaattcctgaatatccttgttaactttctgtctcattgatctgtctaaggttaacagtgggatgttaaagtctcccattattattgtgtgggagactaagtctctttgtaggtctctaaggacttgctttatgaatctgggtgctcctgtattgggtgcatttatatttaggatagttagctcttcttgttgaatttatctctttaccattatgtaatggccttctttgtctcttttgatctttgttggtttaaagtctgttttatcagagactaggattgcaacctctgcctttttttgttttccatttgcttggtagatcttcctccatccctttattttgagcctatgtgtgtctctgcatgtgagacgggtttcctgaatacagcacactgatgggtcttgactctttatccaatttgccaatctctatcttttaattggagcatttagcccatttacatttaaggttaatattgttatgtgtgaatttgatcctgtcattatgatgttagctggttattttgctcattagttgatgcagtttcttcctagcctcgatggtctttacaatttggcatgtttttgcagtggctggtaccagttgttcctttccatgtttagtgcttccttcaggagctcttgtagggcaggcctgatggtgacaaaatctctcagcatttacttgtctgtaaagtattttatttctccttcacttatgaagcttagtttggctggatatgcaattctgggctgaaaattcttttctttaagaatgttgaatattggcccccactctcttctggcttgtagagtttctgctgagagatcagctgttagtctgatgggcttccctttgtgggtaacccgacctttctctctggctgcccttaacattttgtccttcatttcaactttggtgaatctgacaattatgtgtcttggagtttctcttctcgaggagtatctttgtggcgttctctgtatttcctggatttgaatgttggcctgccttgctagattggagaagttctcctggataatatcctgcagagtgttttccaacttggttccattctccccgtcagttttaggtacaccaatcagatatagatttggtcttttcacatagtcccatacttcttggaggctttgtttgtttctttttattcttttttctctaaacttctcttttcatttcatttcattcatttgatcttccatcactgataccctttcttccagttgattgaatctgctcctgaggcttgtgcattcatcatgtaattctcatgccgtggttttcagctccttcaggtcctttaaggacttctctgcattggttattttagttagctattcatctaatcttttttcaaggtttttaacttctttgccatgggttcgaacttcctcctttagctcggagtagttcgatcgtctgaagccttcttccctcaactcaactcaaagtcaactctcaactcaaagtcattctccatccagctttgttctgttgctggtgaggagctgcattcctttggaggaggagaggtgctctgatttttagagtttccagtttttctgctgtgattttccccatctttgtggttttatctacctttggtctttgatgatggtgacatacagatggggttttggtgtggatgtcctttctgtttgttagttttccttctaacagtcaggaccctcagctgcaggtctgttggagttttctgaaggtctactccagaacccgtttgcctgggtatcagcagcggaggctgcagaacagcagatattggtgaacagcaaatgttgctgcctgatcgttcctctggaagttttgttccataggagtacccagccgtgtgaggtgtcagtctgcccctactggggcgtgcctcccagttaggctactcaggggtctgggacccacttgaggagacagtctgtccgttctcagatctcaagctgcgtgctgggagaaccactactctcttcaaagctgtcagacagggacatttaagtctgcagaggtttctgctgccttttgtttggctgtgccctgcccccagaggtggagtctacagaggcaggcaggcctccttgagctgcggtgggctccacccagttcgagcttcccagctgctttgtttacctacttaagccttggcaatggagggtgcccctcccccagccttgctgcttccttgcagtttgatctcagactgctgtgctagcaatgagcgaggctccgtgggcataggaccctccgagccaggcacaggatataatctcctggtgtgccgtttgctaagaccattggaaaagcacagtattaggatgggagtgacccgattttccaggtgccatctgtcacctctttccttggctaggaaagggaattccctgaccccttgtgcttcccgggtgaggagatgcctcgccctgctttggctcatgctcagtgcactgcacccactgtcctgcacccactgtccaacaatccccagtgcgatgaacccggtacctcagttggaaatgcagaaatcacccgtgttctgcgtcgctcacactggcagctgtagactggagctgttcctatttggccatcttggctccaccccaaatggtgtccttataaaaagaaaaagttcggacacagaggcagatgcatagaggaaagatgatatgaagagatataaagagaagatggccatctacaagccaaagagagaggtgtggaacagatcctttctcgcaggctcatgcctgtaatccaagcactttgggaggctgaggcgggcagatcacttgaggccaggagttcaagacaacctgaccaaaacctgtgaaatgtggtgaaaaccagtctctactaaaaatataaaaattagctgggcgtggtcatgcacacctgtagtgccagctactcaggagactgagatgagaggatcacctgatcccagaaggtggaggttgcagtgagctgagatcatgccactgcactgcagcctgggcaacagagtgagaccctgtctcaaataaataaatcagtgtgggttctgctgaccagggattccactcaggccccaggacattctgacttagtgataacagtaggggtcacacaaatttgtgaactggtaaatcaataggcagggctgctaggaatcgatgcctgagggcttctggctgaaggatgaggaaggaggaatggagaggaagcatagcatctgccttagatactggtcctctgcctggccagtgacgaagcaatcagcccttcccttatatggaggccctagtaactagtggaagaaagtcaaggtctcagacaaagtgatagctcgttaatatttcaccagatgtcagcatccctttcaattagccgtttgaagtttgctatattaagactacaaggtctgctcttcccagctctgcaaaatattataagatctcttctcctttagcaggattccaaattcctgctaatgacaaggtgtttatcagaattgagactacctttgcagaaattataacagtgagaaaattatggcagttggggagatctgatctagccaactcatttctggcctttagccttcaagctatacttaattattactgggcttgggccaagctaattttgggagacatttagtttatagtttaagtgagaatagcccttccgccaaacttaactgcctttgtaaagctaatgagagaccaccaggctaggaggataggggagcctgaattctgctaaggtgtagacataaacaattgccagccattactccagaagtcacaatgacacaggatttttcttgatcactctgccagttggagagctcctgccagcaatgcccctgcccaggccttgttcaggcccaaccctttgattgtcagcatgacctcattttttttggacatgggactggtgaagggcagctgccccatgcaacggaaagcagtggtggtgccaagtttgccccagagctgctggcgagagtggggcaaggaaatgacagagctgttaacatgccactgtccactaggcagcagaagccgggactataagagctaattagcatgctgtaacaccccctctggggctttggggtcatggacacccctgcctaggtgccactgcattccccttgtctggatgccagagaccaccaggggagtggcttgcaacatgcctggtccagtcgcaagcacagcacagagcctgcttctgtgccagcacttggaacaaccggctaggtccacattcactcatgggcgggtgctcttcctatcagagccagaatgtgctgtgattccaaggaaatgtaagccttatacgcaggaaaatatgcagctacacaatgagaaaacagagctccaggtgactgggctatttaaataattttttaaaaaaattcataggccgggcgtggtggctcacgcctgtaatcccagcagtttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagtgagactccgtctcaaaaaaaaaaaaaaaaaaaaaaaaattcataagacattttggttccagatacattaagtaatctctgtctctctctttccccaagatcaacaaggagagaatagattttgtgcttatctcctacgtctgctttacctttgtcctaatcataaattgttcctctatctcaaatgcaacttgttctctgctgcctctaatagtgtcaatccagctcagaagacatctcctctggaaaatgactgatcacaccccaagttgatccctgcttactcatccatcaaatgttactgagtgctttttatgcctggcacggtgctaggacctgataacaaaaaaagatgaacgaggcctagtttttaccctccaagagctcacagactagcaatgagatagatgcataaatggaaaatagtaccattactgtgtgctgtgaaagaaaaatgtacatttatccaacaaacatctaatgattgcttactctgtgcatgccttatgctggtgtgaaatacaaaaatgaataagacacctttctatttctaaggtgtgtctagtgaaggagacagacaattcaatggtcccaatttaggagcatagtaagtagcaccaggttcacatgggatcccgaagcatggcacctgccagatggtagttgttgggaaagtttcccataaattttatataaaacaagaaaaaggcagggatggattccaggtagaaagagcaacttgtgtaaaggcaggatggcttgggagagcacgctggcattttagagcaacctgaagcagtgcagtacggctggtccacagaggaccaaaaggagacatgagggaaaaatctggagaggtaggcagaggccagaccacaggctctggagaggcattggtcatttcaagcaggcaagtgcctcatcagatttgcattttagaaagatcattctagtggaagtgggtggatcagcacaagtagaggcagactaggaaaaggacactatttaatagtttaattcaaattggaaatgatgagggaggaaatctgggcaatagtattggggatagagagaagggatggacttaggaggcatagaggagttttacgggctgaattatgtctctcctcaaaattcataaagtcctaaccccctgtatttggtgataaggcctccaaagaagtaattaagttaaaatgaggtcatcaggatgggccctaatccaatatgactggtgttcttataagaagaggagattagggctggcactataatcccagcactttggggggccgaggcgggtggatcacctgaggtcaggagttcgagaccagcctggccaacgtggtgaaaccctatctctactaaaaatacaaaaaattagctgggcatgttagtgggcacctgtaatcccagctacttgggaggctgaggcaggagaattgcttgaacctgggaggtggaggttgcagtgagccgagatcgcgccattgcactccagcctgggcggcaagagtgaaactccgtctcaaaaaaaaagaagaagagatcaggacaaacacacacagagggaaggccacgtgaagacacagggagaagaaaccatctacaagccaaggagagaggcctcaggagaaactaactccgctgacaccttgatctcagccttgcagcctccagaattgtgagaaaatacatttccattgtttcaaccaccagtctatggtacttttttatggcagccttagtagactaacccaaggaggaggaatcagggatgtagggagccaggcaggcggaataaagggtgactttgaggtttctgactgtggcagcctagtgtgggatgctgttgtgttccaaaagatgtgacctagggggagcagccgggttagagatgggagatggtgccttctagacagccgattggagatgtccactaagcagctgggtatgtggggttggggcttggtcaagggaagggagctgaggatgcagatattgtgatctccagagcagtcgaagcagagcagtggtcaaggttgcccagggcacatgtgtgctatgagaagaaaaggcagaggacaggaccacagggacccctatcacttatgggagaggcgaaggaaaagggcctgggcacaagacagtgaggggcattagtgagagtctcagagaacagtgtcaggggagccaagagaggctttcaaatgctggagagttcaatgtttccaagactctctctttacacgtgcacgcgcgtgcacatgcgcacacacacacttttgggctgttgctttgtaatgatttccctcattattttgtgtgtgatattcttcaagttttggagtcagaaccagagtactgtccatttgcttctccagaggcagcagaatgcttttcagctccacatccctgccaggtaatgcctgccctctaacaggtgggccacttcagctacattttccctctcactcggaggtgtctctgctgggttgtcttgattttccctccagggtcatccttagctgtccctttagtgatgatgcatggctagaagagagaaactccatggctctgccccagggtgtttgaggtggggctgcttttttgttttttttttaagacagcatcttgctttgttgcccatcgtggagtatactggcacgatcatggctcactgcagcttcaagccccactcaagtgatcctcccaccccagcctcctgagcagctgggactatatgcccagctaattttttgtttgttttcctgttactagatggattctttttttttttttttaaattttgtagagacgaagtctcagtatgctgctcaggctagtttcgaactgctaggctcaagaattcctcctaccagccaggcgcagtggctcatgcctgtaattccagtacttggggaagtcgaggtgggtggatcacttgaggttgggagttcgagaccagcttggccaatatggagaaaccccgtctctactaaaaatacaaaaattagctgagtgcggtggtgcacctataatcccatctacttgggatgctgaggcaggagaatcgcttgaacccaggaggcagaggttacagttacagagccaagattgtaccattgcactccagcctggacaacagagcgagactcagtctcaaaaaaaaaaaattcctcctaccttggcctcccaaaatattgggattataagcttgagccactgtgcccagctgaagctgctcttcttaaggctcattgaggggtagggcagaatccctgtgcctttggttggaattacagaaaccactgctcccactgccctcagcttccccagacccgggaagtgaccattcagcactggcactgcatagattccagggcatcaccctttacttattctggggaagggaaagcacatagacccgcctctcatttatccctcactgcaacccagtgagacacacattgaagtaaagtgatgttctcaaagccacatgattaattaggaacccaggaattgaacctagctgtttgactctaaaggtctttccactgtgaccttgccctctcctgctgccttattttcaccactcagttctctctgctccatctttactcaatggttgctccacctgcccatacgcaaacactaggaggatgctgctgaaggcctggagcaccttcactgcaaacatagtcagtcagcagcagcagtaagccaggcaaccagtcatgaaactttcccatccaaggtacttctgggggctggaggaaacaataaggagagagagagagaataagagagagagagagcaacgtttaggctttaacgagaatcttgcctagttggcaatctgctggatgaaatgtcagagatttttgctaacccactcacctttgacagcaatagcttctgagtattgggatctccagagagaggggcagttgaagcagagcacattcagtgtctttttggagtctcaaaaaaattgcaaggtgggaagtgctggccctctcctgctcccactgaaatgaagctggaagagaattgcacacccagctgggcatctcaggagacctaggcaagttcagtcttgagtgacaaactcagtggtcttgtcacttcagctcatggccttcctgaggtcccccagcatgagtctcctccacgagagacctgaccaatggtgacccagcctctgtttgagcgtcatctaccagcagagatggggactcctggccccaaggctcccagcatagcctgacactttgagctattccagtcctttcttattttgagattaaatctccctccctacagctcccttccacagtcaggaggaaagtcctgctgaatgcaggccctgaagcaagggccagggaagcttttcctcgtcaccctcccaaagtcaagacttggaaaggcagctctgagcccctggcttggctggctggccggagcaggcagccactgtgcctgcagggaattctgcacagccagtttcctcatacctgagccgtctacagctgcacgcaccactcccggcctcaacacactatttaaggccaatacacgggagctggttgtgagtcaccaaggaaggcagcggcagctccactcagccagtacccagatacgctgggaaccttccccagccatggcttccctggggcagatcctcttctggaggtagtatatactcttctctctatccttatgggtgaagggaacagcagtgaggtcttttggggatgctgagcactgctgggctgtcccataggaccccacctgtaattttatctgatccagcattgggccagcgggagcctggccagacaagagcctaactggatttgacttaacatcccacctcagctgctcaaggcacctgttcagggttagggaggtttttggttggtggcctgccatggagggctggcgcttgctgggcagcttggactgaggggagtacgtgccaagctgggcattcccctgagatgtcaaggctgtgagcaccatggggacactgagcaggctggtgtgggttgcatggtgggatggcagggaatccatgactgcgacagtggaggggatgcaggaggaccctttatgcagcccccagggggacggaggagaatgtgctttcattctctgtgggtgtgatttcttgctactcttgagcaattcacaccaacacccctccccaggcccccccagctcaaaggttgggtccctagttttcctaggagctccttggagaggagaacttgctgctgctgctgctgctgctgctgctgctgaactccccagagaggaagaaggaagcaagttccctcccctaccttttgcttctcccctgagctacattctagttgcctctttttccctcagaacagcatttaccctcctggaaggaaagagatggaaagtgcagggttttcttgaaatgattgattcagtgtcagtcacaactcaggacagtgtttagggaggctgatacttgttggttctagaggttgtttgaaggaccagtcctccaatttgtttctttttcccacaaaaggaagaaaagaagagagggaaggagagaggaaaggaatcctcaggtcaacagtgaaaagtttgtgaagagactacgagagtaatgttacttcccagaggcagcctagaaagttcttttccttgaaacaaaatatcagctcccctgactcgactcacgtttatctgaaatcacctgccgggtagcagaggtgaaggactctgcagggctggtgggggtggctgcagcggcacttctgcccccacccctgtgcctggctacagcactgtgctccaggagaagcagtgggtggcaggggcttccctctagacccttctgccctgagaggatgtccctaagaagcacctatgtcagaggagctagcattttgtgagtgactccttccctgccctgcactaggtgtcttagagcagcgtgtccaccactgccttgtgaagactcgttatcacctcagagaagttaaggccagatgactgtgaaactgtgcatgaggggatcttgctctgaaatcccaagctctctccccctgccacccttgcccctgctcctgccagtcccagttctccatgcccaccattcctccagccttgatcccaaggacatgaaacactcctcctgcaacaagtggctccattgttcagaggtcagatgggatgtgtgggctctctcgtaatgctttgcatccagtctgactggttttgctggaggattagcaggaggtgggtgttcaaaattcgtatcccctacccttcagaaacccactggaatcaacagagactcctcttgttggctcctgcatgccttgttggctattcatgctctgcagtttcagaagcagcgactgtccatgagggtggcagatcctttgtgcaagggacctccaggaagagggccaatgagcagcttcagtggggagcaggatcatgaaagctcatctcagggatgcaggtggagcctgcctggggtaactcttgaccctaataaccctcttcctttgtcataatggccttaattcataaaaatacctctcctggaggtgatcatgacagtggtgatgttggaacgctcatgaaagggcctgccatcctctgcagacccagtgagttattctcctaagtattcataatttccagagagcctaattccttcagatctcactctcagcatgcatgctgctcagggatggaatgctgatgtgcagattttaccgtgcctggcctctgtgcacatttaggaactgtgtgactagaaccctcctcccctctccccatcatggctgttgacagcagcagcattcgctcatgaaacatttgcagaatgcttgctaggaggacaggggtagaaaacccttgctctgagggggttaagttccagtcaacaatattaactgagcactcactgtgtcctgaatattgcactagacaatggggcaaaagtgactaagatgctgtcaaggtcataacctaatggaggagaaagactcccacataacaactctaacgcgccacccttaagtcctcagacaataagcacaggttgcaaggggagcacttccctcacccaaggcttttggggagggtttctgagccagagaatgggtgggctgtgtcttgaaaaatgagttcatatgacccaggtgaagaagggtggaaaaggctgtctaggtagaggaaacagaattaaatcaaatacaataaaactcatgaatgagcatggtgtgttggaaagctacacactactgtgtattatcatcataacatgaagtttgaggcaggaaatgctgggagatgaggctgagaggtcacaccaggtcacactgggccttcgatagactcagaactgggatttgtggtgatgaggagcccttacaggcacaggccatattggtgtccaactttcagcttccctgagcctataaaatctgagccttcagagccttcagaggggggtcaaggtggttttcgtctcaggtgggcagcaagcctggaggccagaagaagagttgggaaacagttgtggtcagagtatacaggatgacagggacctggcatagatgagagtgagagtaaagaactacaggaggaaaatggattcaggaaacactggacttaaaactggtgatatttgatcaatgattggaggggcaggtaggatgctgcagaataagagtaggtgaggcaaggggcagatcctggaatgactaccatgtttctggattgggtgcagtgagttggggacaaggaagagagaggagagctagttaatgtgttgagcttgagattcccctgggaccttcagatggggatgctccctgggcagcagagggcatgaggctaaaactaggagaggtcaggcctggggatagacatctagtgtcaatagctcaagggcaaggaatagtcatagggggtggctcctacggagagcatgtggagggagggaagcaaggggccaggacggatggctgaagaacaccaacattcaagggtgggcagaggaagaggggggtcagggaaagagctgagaataaatggcaagacaggtagcaagaggccaggatagagattaatggatgtcaacagagcagagtttcatggaacacacaaggctagtgatccataaacctttaccctgtttcatctgaaatcactagtgacaatggcattgataaaaacatgtcacaggaaggaagctactgagtagagaaggagcagggatctttctaccataggaaggtggatgaagtagagaatgagggatcctgggacaaggaggctcagggagtttgctttggaattttggtttcccatttctcctaagtttgcaagctggtgcctggctcagacatctcagaccttgaaggtcagagaaaacagtgcctcgcaacaccatggaagcttgtctggtaagaaaatcttgcttgagcctgggctgaggagatctcagcacaggccgtatttgtgtccaactttcagcttccctgagcctataaaatctgagccttcagaaccttctgagtccatcccgtgaacaggacaggaatctgcaaaatgagataaattgtacattggaagaaagacttaaataggtggcacctgtgttcctgctcctattgagggtagatgattttctgagtgttatgcttttcccccatctccacctgttgcaatgctagtcatttctttcaatattcagctcaaatgccacctccactttgaagtcttacaggatctttctagttgccatcaattgcccatcttatgttcatagtcagcatcaacagatatgaatatctgttcctgtgcctgtttccctcaccagggttcgctccttgagggttgggactctgtcatgcaccttgttgtagggaggcaatgtagcactatggctgtgcatctggattcaactccttgtgccaccatgaacatttaccctccaagagcttcaattgccctatctatgaaatggggcagataatagtacctaactcctagggctgtatgaatgatatgtaataattatgttcctggcacatcctaagaactccataaatgttagctattgctatactcattacttgcaactccctctacaatccatggttcttggttggctctccataaaaatttgttaacttcaatttcacgactccactggcacttctgatcctgaaacagatgttgcagtgagggtatactttggattaattgccccagggatctcttaaattcagttagctctaaaagaactctggagaatactcatagagttctccagattcttattctacaaaaaaaaaaaaaatgataataataaagtccaccacaccttttgttgtcgtgaatctgagacacaatccttctctaaacctgaggatgctaggatttagacttattaaatgtctgactcttttaatgccagtatagagcattaaaagttggtggtgaagagcttcagggtgggtgagatgcatctgggaggtcctagtgtgtacaagctcagcgtctagatctctgatgaggcactgctgacaccaagaacaacaacctcaggggccaattggagcgatgcgactatgaccaagcacgtggtaatgcttaactagctaaactgtctcatagtcctaatcatctccatttcacagatgcaaatgttgaggcaagttaccttgctcaatatctcctaggcagccaatggcaggaaccaacatgttactacctagtcctctatacctacttttattgaaaaattacctttctaatcagctgtgcttattctcttgctagttaagcagaacccttcatcactggcaaaaacacacctcctcagtgactgtcatggcagaagaattcttagctggccacgggaagagctgctcccagaattagctgcagcctgtggattgttggtctgtgttgcttcaggcagctgctctagatgaatgagtgcaggagtaaggagttactgaaactcagtaagaattatatgctggccaggcatggtggctcacacctgtaatctcagcactttggaaggctgaggcaggcggatcacttgagtccaggagttcaggagtttgagacaagcctgggtaacatggtgaaaccccatctctacaaaaaatacaaaaatcaacaaggtgtggtggtacatgcctgtagtcccagctactcgggactgaggtgggagaattgcttgagcctgtgaggttaaggttgcagtgagccatcattggtgttactgcactccagcctgggtaatagagcgagacccccctctctctctctctctctctatatatatatataaaaatatatatatgacatgtatatatacatatacatatacatacatatacatacatacatatacatgtacatatacatatatacatatatatacatatacaggacacgtatatatatacgtgtatatatacgcatatatatatgctttcagagcttaaaagttcagaaagtcagtacacctcattttatcaatgggataatcagaataaagtaggcagcttgtccaagggccatacattaaaaatggtagaacagggttttttcttttttcttttttgtgagacagagtctcgctctgttgcccaggctggagtacagtggtgtgatctcggctcactgcaactttcacctcccatgttcaagtgattctcctgcctcagcctcctgagtagctgggactacaggtgcatgccaccacacccagctaattttttgtatttttagtagagacgaggtttcaccgtgttagccaggatggtctccatctcctgacctcatgatccacccacctcggcctcccaaagtgctgggattacaggcgtgagccaccgcaactggccaaaacagggttttttcaagatcctatattgcccagggaccctagctaagaactatgttggaccctagcagaccacattttacccaagcagcaagaatccacaaatctgagagaccaagacttcatacatacttacttttgccatatgaaagtgtggaaataatgtggaaactggagttagtctgatctgtggatgtattccagctctccacttcctagctgggtgacctcaaggaagttacttaatctctctgtgtcttcattaccttatcagtaaattgggcattaataatagtagcacctaggtcacagggctgttataaagactaagtgagttaataaagtaaagagctcagagcagcgtcttgtatatagttagcactttatgtgttaattagtctcaaattattccctccgatgtttttgcagaaaaacagagacttgcagggagggagaggaatgacaagtccaacaatagcagctggacttaaggacattttgtgtctggaatcttttgggatttcaatggactcagacatcgtctttctagtccttgttctgtgaggtgcgggaaatcctctgccacctgaagtggtgaactagatgaaccctaaggccttccccatccaaactcgatgttcaaagtatggtcttccaaccagcagcatccacatcacctgggaactattagagatgcaaattttcattccccccatcctgcaaagaatcagaaattctgggggcagggcctggtaatctgtggcgtaacaagacctccaggtgattctctgtattagcagccgctctgtgctccctgattcctccagaaaagcacaaggatttaatccagatagatataaatttcacctgggatcatttatcattccacattcttctttaagaaatgtgctaaagagccacagatgggtcttgatgaaaacaaaggaaaagccatgaagtttctacaggtaagaaacccaggctacatttctctctgtgtgcgcttttcacaatcccaaaccatctgcctgcaatgcttctgatttcctatcacatcacttcagatgtgttcctgctgctgccagcacagcggtcatgggaaagagggcaggcagtttttcctctttctttttctgcaatttaaaatgaaaaatttcatagataaaaaccatgaaagatttgagagacagacagtgcatccataaaatttaggaattgtctcttgtagctccctgcctcacctcctcattgtgttttctcagcacctccacccccagaatggccatttcatacctctcttccctcttcaatcctcttacaacccccatcccttctccccaccccagcctcagatgattatcttgctctacccttcactgagaaaagagaaaccagcagacaggtactccttcatcttttcacatccaaaactacccgctaccctcactgggtgccctttttctttgcctcccctcctggtaccagaggatttgctgagctcctatcaaaggtcagcccctctgtgctctggatccatctcatctcccagctcgcaaacacctcctccagcagacatcatcaatctctcctctgcacctctattatccccatcagcatgcaacccgtgtatcaggattttctgtcttaaaagaaaactctctctcagccccacaacctctccagctacccaccccatctctctttttttccttttcagcacttgtcgctagtgttgtctggagtgagtgttcatcctggtttcgtggcattgtgaaaggagagtgaggtagaggtttcaagcacaggctggagccaggttgtctgggtccatccaactctgccactttctaactgtgagactttgggccatctagttatcctctctgtgcctggattcctcatctgtaaaatggggataatattagaatctacatcataagattgttataagaattacatgagctaagacataaagcgcttagcagcatattcttatttccttttcaacttactctagatggattttgtccccactataccaagatactgttccggtcagtgcctctaatcacctccacattgctgagtctaatgtttacacctctgttcttatcttgtcttcacttcagcattcaacacagatgtcctcaccacctccctgaagctctttcttctcttggtttccatgacactacactcccctgatttgctgctctccccctcactcctgacatcaagctggtctctcagcctccgtttctctatacccggttgctggtggcagcttttctcctctgctgccccaactcgaagccaccaagctctgtagtcaggtacaaggacataaccctttcatccatttcctatatttgatgattgaccctacttttgccaaaatacctaagtgttcaggaacagaatataacagtatgagaacaattatcctttaaagtggtgggcagaagcttcttaaagtcttacgaggcatgatagggtaagtcatgtaatagcaggtactgtgtgggagggaatttcttttcacatccagaggagccccaggcataagcccttaaagcttgagataaggtttccagacaggtcctggtggaaagccctgaggcaggagagagttagatgagggaggcaagaagctgagatttgatttcacttctgctcatccaaggaaactgccttctagcctcttccttctttcttccatttgttaaagagagaccaaatattaatgattctctgcagccaagagagaagcagccagatttgatgggaaagtcatggtgtcattttattggccttaggccaggggatctttgtctaatgaccataatgtagggtcatagcaatttagcaaaacaagccaagtttttaagctccccctcaccccatcccacagtggtcaccttcaccttggggccagctctgtgggtgcttccccataaaggggctatatctcttgggtacttactcatgccaggtcctccagaaggacagtatgcaaggaatattaggggcaggcttgcaaattgctgctggctcagaacctaggaacaaggctgcatttgggagtgggatgcatgcagggaaagggggagatcaggattccagaatttcccctacacagagggattcccccacagagccctggagagaaagccataatcccgagttactgtgcctttctggtcggcagctctgtgattctgctgcactgggactccctcccgcaggccaggctttgtctaaaggcctggacagaggaattctcttgggctatgacagtctcattctccatcaagaggctgctgaggggcttttgggacagtgacctaagcaagcccaggaagacattttcccgtggacacagctttataagttggaccttattccctaagttaaccctcaagagtatattctatattgtagttgtgcatttatgataggattatttttctactattttcctttcccattataaatgtatagaattgtctgggcagggtggtttatacttataatccaaacactttgggaggccaaggggggcagatcacttcagtccaggaattcgagaccagattaggcaacatgcagaaaccttgtctctacctgctgcaccccaccaaacaaaaaacaaaccaaaaaaattagcctggcgtagtagctgggattacgcctatagtcccagctactcaggaggctgacatgggaggttggaggttgcactgagctgagatcacaccactgcactccagcctgggtgacaaagtgagatcctgcctcaaaataaatagatgtgcagaacatctaaaacactggaatccaacagacatctagggccttgctggaaaagctaaccatcatttgtaaatagtgttgctgtaagatcctgtacagaacttcaaataaccaacttaaacacaaactttggaaaagagccactgggtggtgggaatacctgaagatttggggatctatgtaggcgggctacatctgggtaaggaggcaaagaagatattcaaagggtaatgtttacctgtcccttaggtcttggagtccacctagctcaatgaggaggtcagaggaacttaatactgaagtcctggctggaggtcatcttatccttgacactactctgcaatcttggaaagaatggggagggggtgcactgggatttttctcagaattctgttttccaggctggaaggcagcagtgagatcatggctcattgtagccttgacctcccaggctccagtaacctcccaactcagcctcccaggtagctgggattacaggtactcaccaccatgcctagccactttatttattatagagacagagtctccctatgttgtccaggttggtctcaaaaactcctgggctcaagcaatcctcccacttcagcctcccaaattactggaattacaggcataagccactgtgactggcccatagttctatccttataaatgactcttttcttttttgtttttgcccttttaaagcccaactgtgaatagttttttacatagttattaatacaatgtgtgtgcttttatgctctgctttttccatgaaaactttttgcattaaaacaaaattttaaagcaattttacagttaaaagaatccctgcaggctgggcgtggtggctcaaacctgtaatcctaggactttgggaggccgaggtgggcggatcacaaggtcaagagatggagaccatcttggccaacatggtgaaaccccatctctactaaaaatacaaaaattagccaggcgtggtggcacatgcctgtagtcccagctactggggaggctgaggcaggagaatcgcttgaacccagaaggcagaggttgcagtgagccacgactgcaccactgtacttcagcctgagcaacagagcaagactccatctcaaaaaaaaaaaaaaaaaaaattccttgtggccgggcacagtggcccacgcctgtaatcccagcactttgggaggctgaggtgggtggatcgcttgaggtcaggagttcgagaccagtctggccaacatggcgaaaccccatctctactaaaaatataaaaatttgctggacgtggtggtgggcatctgcaatcccagctactcgggaggctgaggcaggagaattgcttgagcctgtgaggcagagtttgcagtgagcagagatcgcgccattgcactccaacctgggagacagagtgagactcagtctcaaaaagaaagaaaaagaaaaatggtaatttcaaaggatttgacctaatatatattcttctaggacattcattatccatattagcatattaaaggatttcaaaaatcctatagacttaagtctgtttaattgtgattcacccaacattatgaaaatgtaatccctttaaaaataatacttgttaatgtacattaggacaccttcaagaaactaggcactggggtaattacaaaagaatagaagccacgaggagacaaaactatgtgaatgtgggagcccaggagcagcatctagggccttctcccaccttccaaactggatgcagatgctggctgagcagatgcccaggaaccaaagggcaggctggtatttttactttccaggaatgccctcccatatttgatatccaaagtcatatttttcaggtcttccccttctacagcagtgctttcttgactaaccttgccccacattggctttttttgtaactgacctatgctcttgcctctctcataaaagtatagggaggattcatgaggtgatatgaatggatcaccccgtatttctcaaatgacaggtattaaataaacgtgggtattgttttgactgccgtctcattgttataattttaattactttatctttcagggtattattctcatcttagtttataggtgttcctttcatttgctgacaactaccaggtgggtggtgctgatgtggatgcaggaggcgatgcagccctgggttgcttatgcctctacagagaatgtggatgctgaaggcacacgtagccagaatttgaattaatttttctgcagccactggagccaaatgtctaagacagggaatggaaatgttggatgggggtagaatcagagtacagtgaaacaatggccggccaggactaaatccccagtgcttctgcctttttttcttgttttactccactgtcccactatctggaatccttcccatgagagatcctttaacaggcttgtctgtcattcacatataacacacaagcctttaatagggctgtctgtcattcacatgttagtatgaccaattctctagagagtgagtaggcattttgacatcactgtgcagatctgatctggttatctagcagttgttagatgtgagtagaaataatcatgatacttcagggaagtggaagatgagagttgaaaggtagggtggggcttccctatgatagcacacgttaatttaattaaagtggttaactgtagctgagtaaggttgaagtgacattaaatggggccccaacagttttgtgtccctgcagtagaaggcagtgcccagagtgagtgtacctacaggagaaattcttggactttcaggggcattggtacaaacacccagttaccagcaggcatacaaacaagccttttgctttctcatgatggaaatggaagtacagcccttgacttagactcactgaagaagcaaacgctggcaaaccttgaacaagccatgccatctttcagatccttacctctcattttgttaccagtggagggtataaatatgttactggtggagggtggccaggttctcggagtcttgaacaaagaattgaagaaaatgcacaaagcaaggaaagaatgaagcaacaaaagcagagatgtattgaaaatgaaataatgctccacagggtgggagcaggccaagcaaaggggcgcaagagccctgttacagagttttcaggggcttaaataccctctagaggtttccattggttacttggtgtacgccctatgtaaatgaagaggatgaagtaaaggttcaaagtcgtttactcagtatactccctaagtaaatggagagaatatttactattatagctgaagtgtttccatttgacttagttctaggaagtcagcatgaatgggccctatgttccctgtctccagaccctattctcctgcctcaaatttgtcctctgtaaaagtcaaaaatatcctaataatatatcctgagttctctgagagcaatgagaagggggaggggtgtgaacattgctacttctctttaggtgcatgataaatctgttttctcatatttctacattgatattttctagtagacaaattactgggtcaatgaaatgcttgacttttatgggcttagcgaataagtacttacagtttcactaatactgaccccaacatattgtacttatcttaataaacatgttgtctaaaagtaaacgatgattttctgaggcagaaaaataggtgaactgcaagagaatctttttaatatgggtagaggctcctgctagcttcacaattttctacccttaaggcaaataaagttgtaaagaagtgagctgcaagatggtggctttcattagcattccccaaaggtgtcaaactgtgaaggaagtattctgtttatccgaaaattctaggggctccaggtgctgctggcttgagctctctggaactgaggctgctgtctaatcattgcctggggtagtttgtgagccatgtattgacttatgaagaacatgcttgctcacttaaatgaagaaaaacaagttatctataatttatagcatatattcacttgggtactagctctttctatgagagctcttctgaaaatgcaaaccactaacccaggaaagtatttaagttaccagctttatgggagcattaaatggagagatgcctgtttgcccaacatctaaaagagttagactgtactcttaaaaaaaaaaaggcagagttttcttttttaacatatgttttccttgtttgttttataagaataatattggattagtgtggaaaatttggaaaatacaaaaaagcacaaaggaaaaaaatatctatcggtcctaacctagagataaccactatttatatgtccttccagtcttttttttccgtctctctctctctctctctctatatatatatatatgtatttaatacatagtaaaatactgtacatattattttggaaatgactttctacttattggtcttataagtatttctcaaataaatcttcttctataatatgattttttaacaaatgcatagtattgccgctaatgatgaaccttaattcactcactaagttccctattgttggacatttaattgccttcaattatttgccaaaattattacatttattttattttattattatcatcaagacacagtctcactttgttgcctcacctggagtgcagtggtactatcatagctcactgcagcctcaacttcccaggatcaagtgatcctcccacttcacccttccaagtagctgggactatgggtgcatgccaatatgcctgactaaattttttaaatgtttgtagaggcaaggccttcctatgttgcccaaattggtctcaaacccctgggctcaggcaatcctccctactcatcctcctaaagtgctaggattacaggtgtgagccaccgcacccaatcctattacattaattttagtcaacactatagataaccttggaaatgtatcctgttgattctgtagaataaattcctagaagtagaattactggatcaaagttggctgtgcatatcataagccttctgatatatgtggccaaatttttcccctctccccacactaaagttggtaccaacttatgctcctaccaaccatttatatgctttaaagtaataactttcactaaagcctttttccagaaccagcactaaccctgccaacatattgaaaaagaaaatgacaaaattttaatttaacattaccatcttcttcaatatttgaggttttctttctcgtttcttagcctcccttctcttttttccccacagcttaattgaggtataattgacaaaaattctatatatttaaggcatacaatgtgatgatttgatgtacatatacattgtgaaacgattaccacaatcaggtcagttaacacatatactttacctcagttatttgtgtgtgtttgcagtgaagacacttaagacctgctctgttagcaaatttcaagtgttcaatacaatattattattattattattattattattattattattattttgagacggagtcttgctctctctccaggctggagtacagtggtgtgatctctgctcactgcaacctctgtctcccaggttgaaacaattctcctgtctcagcctccctagtagctggtactacaggcgccctccatcatgcctggctgatttttgtatttttactagagatagggtttcactatattaggctggtctcgaactcctgacctcaggtgatccacccacctcggcctcccaaagtgctgggattataggcatgagccaccgtgcccggcctacaaaacaatattattaactacaggccccatgctgtatattagatccccagaacttattactcttatacctgaaaatttgtaccctttgactaacacctctccattttccctaacccctatcccctggcaaccatcattcatctctctgcttcaatgagtgtaactttttaagattccatatgtaaatgagatgatatagtatttgtctttttgtggctgatatatttcacttagcataatgacctccaggttccatctgtgttaccacaaatggcaggatttcctgcctctcataggctgaataatatttcattgtaaatatgggacacaatttctttgtcaactcatgtattgatagacacagtttgtttccatatgatggctcttgtgaataatgctgcaatgaacgtgggggtacagatatgccttctagacattgattacatttcctttggatatatacccagtagtgagattgacagatcatatggtagttccatttttaattttttgaagaaccttcatactgttttccacaataactataccaatttacattcccaccaatagtatacaaatgttcctttttctctgcatccgcaccaacatttttatcacttgtctttttgataagggccatcctaacaggtgtgaggtgatatctcactgtggttttgatttatagttccctgatgattagtgatgttgaccaccttttcatttgcccgttagccatttacgtatcttctttgaaaaaaatgtgtattcaagtctttgcccatttttaaaacttgggttatttggtttcttgctattgagttatatgagttccttatatattttgacattaactccttatcagatatatggtttgcaaatattttcttctattctttaggttgcctgttcattttgttgattgttttcttcgctgtgcagaagatttctagtttgaagtattccacttatttatttttgctatttgcttgtgtttttggtgtcatatccaaaaagtcattgccaaaaccaacatcaaagggagcttttttcctatattttcttctggtagtttgagttttgagtcttatatttagtcttcaatacattttgagttaatgtttgtgtgtggtgtaagataaagatccaatttctttcttttgcatgtggactctggttttcccagtaccatttattgctgctgctgttggatggaatgttctatgtctattaggtccattttgtctgtagaattattgaggcctaccatttctttatggattttctgtctaaacgatctgtccattattgaaagtaggatattaaagtcccctactattttggttttgctgtcttttctcccttcagttctgttaatatttgctttatatatttagatgctccaagttggatgcatagatatatttacaattgttatacccttttgatgaattgacccctttgtcattatctttgttactatctttgtcttcacaacaaattttgactgaaagtctactttgtctgatataagcatagccattgctcttctcttttggttaccatttgcgtggaatatctttccatttcttcactttcattctgtgtcctaagggtaaaatgaatttcttgtagacagcatattgtaggatctttttaaaaaatctgttcaatcattctgtcttttgactgaaaaatgtaatccatttacatttaaagtagttattgataggtaagtacagtcatccctaagtatctgtggggaattggttccaggaaccactcccccaccccaaaatgcctgataaaaaaatccacagatgctcaagttccttatataaaatggtgtagtatttgcatataatttatgcacatctcccatatactttgaatcatctctagattacttaaaatacctaatacaatgtaaatgctatgtaaatagttgttatgctgtattgttattcttatttccattgttattgctgtgttgttattttgttttcttcctaatatattaatatttgatacatagttggttgaatccacagatgtagaacccatgaatactaatggctaactgtacttactatttcattttgttaattgttttctaagtggtctgaagtttctttccttctgtctttctgtcttcctttgtgatttgattacttttttgtagtgttattctttgattcatttctctttatcttttgtctactagaattttttttgagttatcctgaggcttacgtaaaatacctataacagtctattttaagctaacaacttaacttcaattgcacatgaaactctacaatcttacccccaacacacacatcttatgatattaatgtcacactttacatttttaatagtgtatacccattaagaaattatagctatagttatatttaatactgttgtcttttaacttttatactacagtttaatgtgattcctgtaccacagttacagaactagagtattctcaatttgactgtatatttactttttccagtgaattttatacttttatatgctttcatattgttacttagcatcctttaatttcaacttgagaaaccttctttagcatctctcataaggcaggtctagtagtaatgaaatctctcagcttttgtttgtgaatatcttcatctgtccttcatttctgaaggacagttttgttaggtttagtattttgggttgacagttgttttcttccagcactttgaatatatcatcccatttcttcctggcctgtaagacttctgctgaaaaatccaccagtagcttcacaaagtttcccttatatgtgacaagcctgttttttcctgctgctttcaaaattctgtctttgtctttggattttattttattataatgtgtcttggagtaatattctttggggacgctgcttaaaatcttttgagctctgtaaatttggatgtgtatatatatatatctatatatctcctaagaattgggaaattttcaactactacatttccctcccaccccacagggtcttgcttggttgcccaagctggagaacaggagttcagtggcatgatcatagctcactacagcctcaaactctgggttcaagagatccttccaccttagcctctgaagtagctaggactacaggtgtttttcaccatgcccagcttattttttattttatttatttatttattgagatggagtttcactcttgttgcccaagctaaagtgcaatggcgtgtatcagctcaccacaccttctgccacctgggttcaagcgattctcctgcctcagcctcccgagtagctgggattacaggcatgtgccaccatgcccggctaattttgtacttttagtagagacagggtttctccatgttggtcaggctggtctcaaactcccgacctcaggtgatctgcccaccttggcctcccaaagtgctgggattacagcaaccagtctgttttttattttttatagaaatagtgtctggctatctggctatgttgcccaggctggtctcaaactcctggctgcaggcaatcctcccaccttggcctccgaaagtgctgagattacaggcataggccaccacgcctggcctattacatctttaaatagtatgttttcccctttctctcttgcttctccttctaagactcccataatggatatatttgatcacttgatggtggcccaaaagtcttctgtgctttctttactatttttcattgtttttctttttgttcctctaaatgactgattgcaaatgacctgtatttaagttcattgattttttttcttgtatgatcaagtctgctgttgaagccctctatcaaatgtttctgttctgtgattgcattcttcagctccaaaatttctgtttagttcttctttatggtttttgtttctttattaaactcttcttttttatgtactgtttttctgatttttgtttaatggtctgtctgtgttcttttgtgcatctcattgagcttctttaagatgattattttaaattcttgtcaggcaattaatagactttcatattttgggttggttgctgaaattttactagtttctttggtggtgtcacgtttgcctgatccttcttaatgtgcatagacttgcattagtgtttatatattgtaaggaccaaacatctgttttagactttatagattggttttggcaggtaaggacatttgcctgtcagttccctggagtgatggtattgcctccaggattgtagttaagcaaggttggagtggggttacataactgctcctgagtctgcagcagggtccactgttggtgggcccattaccagtggcttgggcagatatggatcctgtctggaggagtcctagattttggtcagtagggctgatactgaaccaaaggtctgcctcaggatctgcagttgggtctgtggacagtgggcttgttatcaggtgtgtgtatggctatggctcctgccaagtctctgtgggaggatacctgctgagttagtaagcaggaaatactggctctggtctgtggctaaaaggggctgaaaccaagtcacagagttccttcagcatccacaattgagaccaaggttttcaggcctacctctgcagacatggatgggcatggctcctgccaggttcttgggtggttaggactgctgaggccacagcctgaaaaatgctgaaggtaggtcatagggctgcttcacaatcctcagttggactgagattggcaagtctgtcttcgtgggcacagacagctatgtctcccatcaagtcctgagtgaacaggactgttccataagcacagcagagagggactagcactgggtcataggctgatctgcagtccaaagatgggaacaagatcaatgggcctgttacctgaggcacttgtgtgtggtgtgtgactcctcctgggctccttagccgatggttctggtggcaggaccaagaccaaatggggttgtagctgaatccacagaggatgaagctatttctggatctgtagcttgtggtgggtgagtctgccaccaaggcatgagcctaccttggtcttgggcttcactggggttttgcaacctcctacgtggattccaaggctcccacaaaggcactggtatccaccagtggttgccaaattaacattgctgtgggggaataggagtgggggatctcctatcccattttactgatgtccctcttcttagctgccttcctcttaatttaccacccaactctacttccagtaaggtaactaatacattcatttacctagctatcgataactaatgagtgaaatgttatactaaatattttaatcaggaacaaaaacaaagaaataacttccttgttctaaagtttcattttattatcaagctaaagatgagagttattttggggtgaagaaagtccacctctgcagggcttcagatcgggtaaagcaggtcatctgttcctcttgttcctgatgctgacttttgccaagtctccctttcgtggaacgacagggaaaaacagttaaatactcacagacttttctttctctacccaacttctcatgaaaatcttggcaccttttgctaaatctccacattctccaactcacaattacgagttcaatggagtaaatcatgcagagaaaactgaaaaggaaatgagagaaagggcagaggatagtggacctgcaggtgcgagacaagaaaataggcagcagggtaggcacagagggagaagagacgaggaagtgaacttcagagagagttttgaggaaattctaggaaagggaaagtttgggggaactgataagaagggtagaagttggtaatgagggtctttttaagaggaagttttgctatgcgttatccatgtaatgcctttgatatttttctagatattcattggtttcacctaaacttttccgccaggctgatattttgtttaccgtgacactgccaaaacctagaccacagacatctggactttatatgggttataataacattgtatctctggagttagaaaactattttttacttatatataataattaagagcagatttctaaatgtgtgtttatatttagttaattgtaattgttcacataaaacgacctaaaattattcgcataaaacctacccaaaagtataatttaaggagtcattaccctgaaataaaaatacgaactgctttcaatggcctgaaggatcttgggggaaaaaatgggctgccatgcagctgggctgtgtcatggacatattttggtatagtagtagaatatgtcccaaaatcagatgagctcagtttagcatttatcagatgcctaggatgagtcaggcatgatgtctgacacttagagaaataaatgtgattggtgaattgattcagcatgaccagtagttataatcaaaggaataatttctttttatatctgaccttttaaagtgcacatatagaaatacatgatgaaacttctgaagcctctgatgaaaacctggtttcaccttcaattgcctgatattgcctcagtcccttattccccaaaagtctacttcacacatgactctcactgctcagttccctctcccggttattcctattggtgaggactccacatagttctaggacatctgccctgctggaagggtacacattccttgcttcataaaagagtggtgactctcgcagctctctgtgttccctctctctgtctctgtctgtccgtctctctccttctctctctcgctctctgatctgttctagatcatattgaatttctcaagtatgatttaaattctaatccatggtgttccccaccttaccccatcaagaacacattacaagctcttcaagttaagctttgtatttgtgtgttagagagggggaggaggatgtttacatagcacagaagaaaaaaaaatccccgaagaaatatcttcccaaatcttttcctaccctgggcccttttaatacccttcatctgagtgaggcagctaagcattatggaaataattgtcaaagtgagtgaagtgggtaagaattatggaaatgattgtcaaagatcccccctttttttagtttttttcttttctttttttcattttataatttcttttattttttattttttgttttgttctttaaagattccctttttaaactctgcatagtgatgtggcacctcactttggtatgcagcatctattttatcttggaacctcagttgaaactttaaatgtaacatcctgttacacaaaaatgaaaagatatggtccctgttcttgagaaacttagaggagactaaaggagacacaaatgtgtgaccagataatttcaatacaatgtaacacatttgtgttagagcaatgtatctggtataatgaggacacagagacagtttctgatgcatatggctagtagtttccctgaaaaattatctggagggaagctatacactaaagaaggaggagtctgtgtatctcacaaatgcactgacaggatcctgtatgtcattggggacttcatgctattgctttgtcccctagttcctcaagtgcctgaaggaacaataatgaaattataggttcttggtaatactgttaaattggtaaagtgggtaggaaaaagctccttttttttttttttttttttttttgagacaaggtcttgctctgttacccaggctggagtgcagtggcatgatctagctcactgcaacctctgcctcctgggctcaagcaatcctcacacctcagcctcccgagtagctgggactgcaggtgcgcaccaccacacctaactaatttttgtattttttgtagaggcagggtttcaccttgttgctgaggcagggtttcaccttgttgcccaggctggtcttgaactcctggactcaagcaatccacctgccttggcctcctaaagtgctgggattacaggcatgagccactgctcccggccaaaaagctccttttttaaaggtttgtaaaagggcccagaaatcttagcagccacctgtaaaaatagtaatcccctctgaatctgccctaaggaattcaagaacagggtcaattctggggcctgaataacactgtttaatttgatttatggagaccaggtatgttgcccaggctggtctcgaactcctggcctcaagcaatcctcccgccccagcctctcaaggtgctgggattccagatgtgagcaaccactggcctggataattcagatgtgtcttcctacagtgcccatggcttcatggacatcagtgaatgtacagagaatatctggacttgaagtggagagggaaaataaggggccccatccattatacctaccctctcattccctgcattctatctcttatccaattatttcttttccttcacaataactagttcatttcactttccaagccccagttccaacataaaacacaacattataaaatcacaaaatacttaaaaagcataagaatgaacttgcttctctaatactgctgaggcaggcatggaggaagctgtaaccagttaagggccttgcctggtttatgcttctgagccccagcatcttgaagacgcttcatttggctgtctaagcaggtacaatccactttatacactaagaaaatgcctccttgggggtccaaccacaccatagctacatgactcagatttaatacgattgttctaatttcagctatattacttattgtctctccaaccattgacatattccagaaattcgaatagctatgaagccaaactatgcctttcagatctctcatgcctggaaatagctctcatgaccattgttgaactacatttccagtttctggaaaagatggttcctataactagggaccatatttcagaacagtgaagcagaatttcatgcaaggaatgtgtgaaactaaaagtatctgagacaggtcttaatcaattaaaaaagtttattttgccaaagttaaggatgtgcccatgacacagcctccagaggtcttgacggtatgtgcccaaggtggttagggtacagcttgctttgatacattttaggaagacataagacatcaatcagtacatgtaagctttacattggttcaacctggaaaggtgggacaacttgaagtgggggttggggggcttcaaggtcacaggtagatttaaaaattttctgactcgcaaatggttgaaagagttactatcaatagaaaggaatttctaggttatgataagagcttgtggagaccaagattttatcacgcagatgaagcctccaagtaggcttcagagagaatacattgtaagtgtttcttatcggataaagcctgtgttgattgtaatgctggtgggcttttcttgaattctaaaagagaggaggatataatggggcatgtctgaccccctctgcttcctatcacggcctgaactacttttgctgattaactttggaatgcccttggccaagaggaggggtccattcaggtggttggggggctcagaattttatttttggtttacaaatgccactttggcactgatcaggacatccccagcctaggtatattttgattctgatggcagcccatggaaactttttctggtggaatgtggttggcttccatgaagtagtagaaaaattgcctagatggcaaaggaccaagaccctagtcattcctgcctcttttcccatagggccctggtttctgctgccacaacttggtctttcctgggtttctcaggaagaaacctgagacttgaagtgaccacttggaactgttgtatttgactgaaatatgagaaaatgtctctgcccttggtttgggtaagatatgcctaaaagatggaagaaactaagaaacattataaatataaaactaacggtgctagttatttatcctaacttcttaagtctaagtcaagatctgacttagctgtggcagcattagaggtaccagcatttgttccttttcttacctctgggttagcaagaagcaaagctaattagtttctagactaagggaaaactggctgggcattgcttccaggcctaggaggattctcagtccctaacagaatctgcctctaagtgtctctggatgaaacattcttctcctaactctatccttcacccctttggccttgaaacacaacacgcttggtatccacagtcaccctggctcttgctgtggtccttagcctctgagtagcaggaaagggagccaacatctttagtgcctttgctccatgccaggcactatcctcccaacgctacatacacacatcatgaagaagggcaccaagtgaagaaaggagcttcctccctggactttaaatattcttccctgaagctcagaaatatgctgtaagtattaaaaagatggtagtactgcccactgacacccctaccagccagcatagaattcaaagtataaagaacactgaactataaaaatacacacaaggtaaaaaaaattgcttaaagtcacttctttctagttttcctgattataaatttctagataagttcattgaagcttaacttttccctctggtcactttttgtgtgtgtgttggtcagggatggcagagacaggttgccactcctgcttggctaatgctggaaggacaagctcagtcagcctcgcagatagcccagtgctgcccagacttcaggtgactctggactggcctaacaaatgccttccatatcttaaggttcttgatagcttggactgctgcacagcaaagctggggcagggggagtaccagaaggcaacaacctcacttggtcttggtgctgggtaaagaaaaaaatatatattccctgaaactgtgtatatataagacagtcatcatgcagatttgaggcctgaattcataacatctccatttcccaaaacctctgaaaccaagatttcattttaaagggctcctacttggcagtgagtccccagcttgaatggccccttagctttgtctctggtgtttggtatggctctgaagacagaagcttttggtccctggaatgcatagccattgcgcccagcactctcttactgatctggactcatgtgctggtttcatttttagcctctgcaaatctccctcatttttcttgctggcaaaaatgaagtacccaaaaatgtgtgtgtggttttgtcttttatttttttctttttattcagcatttcaagtatttttatcaaggatttttttaaaggctatttagtatgcactattctggaaatttaactcttcattccctacaatgtcctttctcttttagagaaacacttctattttgccccttgtttgtggagagaaatgtccaagaggactcaagtttaacaagtattcaagcacagctattatgaatctctaggtccccttcttagccacagccaaccaggtcttccatgtacaaccctccaaggcattttgttacaatttatagcatcagcaagatttctgataccacaattttttaaaagactgtttaaagagaaagataaatgatcatttctcccataaatggtttctcaaaagttaagaatgtgttagtttctctcagtagcacagcatggatatttatttattcattaattcaacatattttaaagactatgtgctagacgctccaagggaagcagtctgtaaggtggggcatttattcaacaagcatttggtaagttccttgcatgttccaagaacttgaaaaataataggaacgaaggcatggaggcaagaagcagcctggcgtagtcagggacccagagtggtttagaatggatggagtgtggaggtgacgggagatgggagaaagtagtcacaggtttatataaaatcttcttgagcttatatttttattcaaactttcaggtttagtatgctttcttcgctttctatgcttaaatcaatactttatattttaatcttattctttttctttaaaaaatggtatcagaatgtatagaaggcttagaaaataaaacagacatcttgtgattcataagagctccgtagcccatctccaggtcagtgtcaggccctgggcttcagtgggtcagaatggcaaccaaaggtggggtaggtacaggacacagcacatagcatcaggttgggagtctctaccaggggaatgttgaaatctatagaagaaaactaagactggtgccctggaagtcaggctggaccagagagaaaagaccaagtaacagaatctgaaatcacgaggcaggccctgtgttgaaggcagctccagggagtaagaaaactacagattccaggctggaaggcctgggaagcttcctttgtgtctgctacagatggtcaggaccacagaagggttctacataaggttgcctccaccctaggacagggagtgtctccctgccttgggtttcagaatgccccttgacataggcaggcaagggttgttatggtaccagagcagccgcaggggctgcagccgggaaattgctcaggcaagccaggccctcaaggggtgggtctggcagcctgattttcatacctaaattctcacaagctctacatagctacacctacagaactggggcccagtctaaaatatgagaatgtaggtcccagcaggcgaggatttgcattggaactcctggtagatcttttggaagactgaacaatacatcctctacttacttctaggatacagtggtctgcttttcactgggaggactttctgccattataaaataaagatagtggatgacagaagacttggagtgtacaaatatgacattgtacatagagaaatcagactgcctaagacaggtgtatgggctttcgtagagagaagctctgagggcaatagacgtacttgtttccagctttattaatgaataaacagtgcactgatcccagggctaggctttccgagaagcagccagcccaagtgcttctctgaatctcttcagtgacaggcacaggtttcctgaaggcaagaaaaggaatgaaattcaaaacagtcacggtggctttagggtgttgcaaaggtaatctagattacagctcactctccctgtcaggccatccatctgcctgaggcccagatcacggtgactgatgaccagggtgactgatgaccacgctgactgatgaccacactgactgatgacctcgctgaaatgcacgtccctcacagggagcctgccctgttcttcctctcagctcttttggggcctagttccccctcccagctcctgtctcaaaccttagtgccactcaagcacttcctcctcttgtcttcacacatgttcagcctcctgaggttcacctgccttcccactcccttaaatccatttaaaaaagagaagggagggcacgttctgggctggccctcaggaaggagcctgaggcaggtcagagctgagctaggctctggatgggcctgcttctcattacctgggaagaggtggaagggtgttctaagcagagagcaactgggcagtgaacagtctgatgagaatacagggattcctaaagggagaagggttagaaaaatagctcggtgcatttaaaggtggtcttaaattctaggatcagtttcaactttcctttttcttttccatgaccaccagtcaagaacagtttgaactttcataagcaatcaggagttacttaaatttgggaatagtgaaaagtaaaaataagcatttactttttttttttttttgtaaagacagggtctcactatgttgcccaggctagtttccaactcctggcctcgagcaattctcccaccttggcctcccaaagtgttaggactacaggcatgaaccaccactcctagccaagaattaacatttatagttttaaaataacagctaatatttacattttgtaaggaagagtttgtttctttggaccctcacgatagccctgtggaaaaagtcgtgttgaatctggaggcaggtataggatgaattgcagtgttgcccaactgttcatgtctcctgctcctgtggagcccccattaggaaatgccgggttctctgtagagtggataaggggaggaatagcagcagcttctttttgttgcatccattccagaaatgatcaggctgtccctgagcagtgctcctgcccttatctatggctgggctggaggaggagaggtgagcagaagtggagagaggcggggagagcaaggggatgccaagattatggtggggaggagttggtgaatggacagcagccaggacaacagccaaccatgaaaagaagtgttcattagcagccagatcccacccaggtgctgtgagcacccctgcaatctctcttaacctccactttggaagacagacaattaggctgtttttgttcacatggcagagactgcttatgggatactcagcttttctaacagtacaggccctttgtgggagggtcatgaaaggtttggagtgtgtttgttattcagtacaatgggatcagttatgctgctgaaggaatcttgtggaaatgtttttttctctgcagtgagaataaggaggagcaggaaacacaggtatgattacgaaaaggactggtaatcaaccttacattgccttttgtctcgctctgcttgtaccagtgaaaaatagtgtgcacaaggatgatgaagaaatgctaatacatgcttatggcaatcagggtgatgctataaataggacaggcttaagaataatatagaatggctttgctgcaaactcaaatacggtttaaggaaaggtgtctatttgttaacagtgtgaaattttccacctgatactcatgccccctccagttttccttccagagtcccaaatgaaagacacttcctgggggggagagaaatttttttcaatctatgtaagattgtatgtgctgtccttccatcagttacaactgtacaaacacaagcctagccactgattcgaatcccaagatttacaagtcttttgattaatataaaatatgggataatggttaagaccaacgatgatggcatctgagacctgagtctaatcctgctctctttaatttcccaggactgagtcctcaggggaattacttaacattaggcctcagcttcctcatctataaaacaaagataatagtatctatctccgtaggtcgtcatagggattagattagatcgatgaggcagtgtactcagataaatattagctatcattcttatatgattaacaaaggttttaggaggcatgtgcagacaaagccaaggccagagcaaatcccagggaatatcaaattacagaatcatgtaactaattatttgaaagggcctttcaaaattgtttgaagctttatctggtactagaaacttttcccaccccctgtgtgtttacccaggccctgcttgcacatgcatttgcaggccagtctccgcgagctctgttggaaagtttctccaaagtattttgagtctaaatctaatctcctagaactttcactcagtgcctctgtttcttcctccagagtgatggagaacaggccaaacaccacctttcaaatactgaaatgatatcactatatttagtcttcttcaaattaaaccaccctagttccctcaactatttttcaaaaaacatgatttccagtcatatcaccgccctgatttcccttcttctaaatcagtggttctcagctggggtgacacgtctggaaacatttttggtcgacacagcaagggtagtgtcagtactggtatctggaagttacaggccaggaatgctgctaaacatgctacagtgcacaggatgacccccaataacaaagaattatctagcacaaatagttcgtagtacggagtttgagaaaccctgttctaagtatgcatgttaatcagtgttctttttaaagtgtgggccaaaaatgtgcatggatgagtgtcagctaacattgctattgtaccgccactacattgctattaaattagcctgagattcccgtggttttgtagctagcagtgaattaaagcctcctttcatgtgtttctgctaacccagggatggaatacacagggcccacgtgctcacttagaaaacattcataaggctgggtgtggtggctcatgcctataatcctaatactctagaggccaaggtgggaggattgcttgatgccaggagtttgagaccagcttgggccacatagtgaaaccctgtctctacatgaaataaaattagctgagcgtcgtggcacatgtatgtagtcccagctactcaagaggctaaagcgagaggattgcttgagcctaggagttcaaggctacagtgagatatgactgtgcaactgcactgcagtcaggggaatagagccgggccctgtctctaaaaaaaaaaaaaaaaaaaaaacgaaagaaagaaaagaaaacactgaaggccaggtgcggtgcagtggctcacgcctgcaatcccagcactttgggaggccgaggtgggcggatcacttgaggtcaggaatttgagaccagactggccaacatagtgaaatcccatctctactaaaaatacaaaaaattagccaggcatggtggcacatgcctgtaatcccagctactcaggaggctaaggcaggagaattgcttgaactcaggaggtggaggttgcagtgagccaagatcacgacactgcactccagcctgggtcacagagagagactccatctcaaaaaaaaaaaaaaagaaaaaaaagaaagaaagaacaaaaacactcagccaggtgtgcctgtaatccccacacttttggagaccaaaatgggaggatcacttgaggctaggagtttgagaccagcctgggcaacatagtgagaacttgtctctacaaattttttgttttttaattagctgggtggtgtgcacctgtagtcccagctacttgggggaggtgtggtggaaggattgcttgagtgtgggaggccaaggctgcagtgacccaccatcgcaccactgcactccagcatgggcaacaaaatgaggctgtcgccacccccaacctaccccgccaaaaaaaaaaaaaaaaagaaaagaaaacactcattagtggtggcactcttccctgtgagcacagaggcaatcttgcagtctttttcaacacaatattctaagccaccactaccagtcattcaaatgattgttggcatacaagatgaaatctttctgccagccatattaccctagttttacagtgttgggacccaggtcatgatttaattctgggtcctgtgctttggaagaatccactaaactgtgctgtgattcttgggggtagctagaaagaaaagaggatgcttcaacctgatactcaacagcagccaagtctcttatatgcaattccccaaaattcctttcccaaatacaaagcctggccatctgctgccatgttgatggagcaggggctgcccagaaaggatgtcctgtctcttccacacacacccctcaagccccacataatgactcctcctcattgcaaagttctcctcaagcctgcactcaccattcctgatgcttctgctctcggtttcctggaccaaagccagccttgactttaccagtataaagagatacagggagaggggtagaggccaggaaacatactctacaccttgaattcttcagcaaagcaaaaactggagtagacaacaatctaagcttctcagaaacctgaaacctatgctaatcaatatctaggaaatggttagttttaccttgaagcccaatgctttattccacatagcatttaaaataattccttttcccctttataggaaatactttttccccataaagaaatttcctttcccgcttttaatcttctttttccttttttgtttttttggtttttttgaaatggagtcttgctctgttgcccaggctggagtgcaatggcacgatctcggctcacagcagccttcgcctcctgggttcaaacgattatcctgcctcagcctcccgagtagctgggactacgcatgcacaccaccacgctcggctaatttttgcatttttagtagagacgggctttcaccatgttggccaggctggtctcaaattcctgacctcaagtgctctgccctcctgggcctcccaaagtgctgggattacaagcatgagccaccacactcagccttaatctcctctttggataggctgaagtaaatgtctttaatttcagcattctttataaacctagtcacctcgttggtttgtgaacaatgtaatatgtttgctgcaacttgatttactcaaatatcctccttggtatattcaaataaatcacacatttgcaaaactaatctagttttcagggttttaaacatttatcaatcacacgagtggagctaaactaatgatctataaggaatgtggtatctcccagttctgttagtatttgagaaggaggcagaaactcgagaacatagaaaccattcatgtttgaataaaacaaaaagcattttatgttttccagactgagcattttgagctttccacactgtgtagcagatccagaaagctcttgtttttagaaaaggtgctcgaggaggtgacaggagccttccaaacatgaggcctcctgccactttttctagaagtatagcatgtagttaagacctcaagtctgtaagtcatacaccctcaaattgagacctgacattcccaccttccagctgtgacagcttcatctgttacttaagctaagcctcagtttccccacatgtaaaaaggtaatgagagtagtacttacctcatggggttgctgtagggttgaatgagaaacaatataatgaggcattatgcctgataagcatcggctcttgttatgccatgccatggacctctgataaatgaaaggttgtttaagagataggtgtctctggccaggcatggtggctcacacctgtaatcccagcactttgggaggccgaggcaggtggatcacctgaggtcaggagttcaagaccagcctggccaacatggtgaaaccctgtctctactaaaaataaaaaattagccgggcgtggtggcacgtgcctgtaatcccagctactcgggaagctgagacgggagaatcgcttgaacctgggaggcggaggttgcagtgaactgagatcatgccagtgcactccagcctgggcaacagagtgaaactccatctcaaaaaaaaaaaaaaagagagagagagagagagataggtatctctcttctggtttattttttggtgtgtgatacagtaatacagcctgtccgctgcagtatatgtttctatagcatcaatgagctcatgtgtggttgcaaaacgggaatgatggcaggacaacatggacgttgtgttggttcacatgccttttctttcaaagcaaggagagttgaaatagcagaatagaatgagaacttcagtgggaaaagcttagcatggctttcagttctatttttattttatgaaaaagaatttttttgaatgaacatctgcacacggggctccctctccagagaagtacatcctacccttgcgtgtcctaggctgcacatccgcttcacagcgaccacgccggctcacagcacccagcagcgggagtgtttattttattatatctgtgcattttttatatcccctgaagtagtttctggccctactgagtgcctgccttgtctgtctaagttatctcccgaggtactagttattgtttctgttagtagactaattacaaagtcgcataggtttcgagcgctctgcctttaagcctattttcccccataaggcctgttacctttattgtgaatgtgaggcttttcaggaatgtgcatatgttttaacaaaggcccaatttctttcacatgctgcagaaggcagcagcagctgaagcaggcatgtgagggaatcgaaccaggccctcctcaggaatggagacagaattccaggctgcaaagctgctccttcacctggaaggctctgggttctgcagcctctgaaagcaccttcccagcccacagcccagagcactaaagtgcaatgcttagatcctgaccccctgcacccccagtgcagcagaaataataccttttctgtgtgtttctgccttggacagagagtgtgtaacagcatggatcagctcaatatatttctgaataaagcctttttcttcactttctttgaaatttgttcatggaaatgcactttgattatctctgtttcccctgggtttaaattcttcctacctccctagatcttggctcattgtaatctccacctcccgggctcaagcaattctcctgccccagcctcccgagtagctgggattacaggcacttgccaccacgcccagctaatttttgtatctttagtagagacagggtttcaccatgttggccgggctggtcttgaactcctgacctcaggtaatccgcccgcctcggcctcccaaagtgctgggattacagccgtgagtcaccgcgcctggcctgttcatttctttactaaagccctgatcacattctgcctcagattattacaaaggtttgtgtgtatgtcacgtcagtttaactataagcttcttgagggcagggaccttgtttatatcatctctccatttctttcatattgactagcactatgtctttcacatagtaagtacttaataaatgtttactgaatgagcaagtcctccaaaagcattgatttttatttgggcccttttgtaatgagtgggtaccaaaagtacactgtgaatcccaatgcagtggttagaagacatagttttgcattaaaaatttcctgcagcatagttattggaaaccattgaggggaaagcaaagatcagaaagcaatgtaagaacccctgaagtgaaatatttttttcatctttctaaaaaattaataagcaataggcaagaattaatttagctgctctggtagttcctgcttctctttccaaggctctggaagttgaattgtttcccaagggaatactagctcagaacaaacctcacggtgattcctgccctgatagggaatttggtgacagatggcagggttgttttcacagcgagggaaacgtgggcctggtgtgatggaggggctcaggagctttggccgaaatgcacaacttccattgtcccccctcttcttggcaagggcccaggtatctgttcagtgtcgctgttcaggtcccctcccgtaaaagtcacagcttttaataataaacttacagcaatagtttataagtaaaatttatttatagtaaaaagtagtgtatgaatagccctttctgaataatgccacatttattatctaatttgatcctgaaacaacctttttgtattagtttgctagtgctgttgtaacaaagtactgaaaaccaggtggcttagaaatggaaatgtattatctctcagctctagaggctggaggccaggatggacatgtctgcaggatttgttacctgtgagagcagtgaaagagaatccattgcatctctctcccagattctggagttttgctggcaacctttggtgttccttgagttgtagatctctgctttcatctttacatggtgttgtgtgtgtgtgtgtgtgtgtgtgttcatctgtgtccaaatttcccctttttataaggacaccagccatattggattaggaattaaccactaccctactctggtatgaccttaactaactacatctgcaattgtgtccggaatttattccttctggtgggttcatggtcttgctgacttcaagaatgaagccgctgacctcgcggtgagtgttacagctcttaaaggtggcgcgtccggagttgtttgttccggagttgtttgctcctccctgtgggttctggtctctctgacttcaggaatgaagctgcggtccttcacggtaagtgttacagctcataaaggtagtgcagacccaaagagggagcagcagcaagatttactgtgaagagcgaaagaacaaagcttccacagcatggaaggggaccggaggagtttgccgctgctgtctggggtgcccagcttttattcccttatttggcctcacccacatcctgctgattggtccattttacagagtgctgatccgtgcgtttacaatcctttagctaaatacagagtgctgattggtgcatttttacagagtgctgattggtgcatttacaatccttcagacagaaaagttttccaagtcccccactcgacctaggaagtccagctggcttcacctctcacaatgaccccattagtaagtaaaggcacactctgaggtacttggggttaggacttcaacatgtgaatgtggggggggacacatgcagcctttataataggtaaagcaggaattactctgtttcccattttacaaaaaaataagcctcagagcgatgaagtattttatccaaagtaaatgaaaaccctaggccacacacaagtcggctgcctgtgtcagtagtcaaagacagcagatggtgcctctcgctatgactttatctagctgttctcactctcttggaccagtaagaactgaggctacactgaggtgtgggaaaagaggagcagtggccaaatatggtctcccttggaatcaatttagcagatgccctattatttaaagcttcgcttgctgccttgtggctgcaccttatgagggcttggccggcaggggaactgttgtttctgtctggtgggcccattcctgagccataggaggctgggaacaatgagcctattcagggcagaaagtgcaaagccccgcgtttcttttttctctctatagcatcgttctttgcctccctgtgcctttcttttgtcctgcctattgagtaacatcagcgtgggtgttgggagcgtgtgaattggcagccgtgtgagcgggcggctgaggacgtctgaccgatgatgtatgcgccaggacaggcagcaacgggcgagcttcccaggaaccactttgacctatgccttctgctctgcctgagtcactctcacgagctaaagcaggtgacccctcatggagtgcttgttccccttggcaaagaaaagggacacgccccatcggtgagctcctacccttggtacacttggagggagttgagtacagatttaagagacaaattctaatctctgctctgccacttgccaactgtgtgactttagggaagatgcttaatctccctgtgtcacttccccatctataaaatggagacaataaaatttgttctcctcctaaggttactaaatggataattgatataagttatacatgctgcttggttggaacaacatgtctgccatataattctagcacttagtacatgtaagcaatacttccttatttgtttatttagtttcccgggtgtcatttgttaatctgttcattaaaaattggtgaggatccaccagttagaatgctgataattaaaaagtcaggaaacaacacatgcaggcgaggctgtggagaaataggaacgcttttacgctgttggtaggagtgtaaattagttcaaccattgtggaagacagtgtggtgattccttaaggatctagaaccagaagtaccatttgacccagcaatcccattactgggtatatacccaaaggattataaatcattctactatagagatacatgcacacatgtggttattgcagcactatttacaataccaaagacttggaaccaacccaaatgtccatcaatgataggctggataaagaaaatgtggcacgtatacaccatagaatactatgcagccataaaaaagaatgagttcatgtcctttgcaggaacatggatgaagctggaaaccatcattctcagcaaactaacacaggaacagaaaaccaaacaccacatgttctcactcataagtgggagttgaacaatgagaacacatggatacaggaaggggaacatcacacactggggcctgtcaggggggctgggggcaaggggagggagggcattaggacaaataatgcatgcaggtcttaaaacctagatgacgggttgataggtgcagcaaaccaccatgacacatgtgtacctatgtaacgaacctgcacgttctgcacatgtatcccagaacttaaagtaaaataaaataaaaaataattggtgaggattatatcaaaacacagtggttgtatttagatgatgggattacaggtgatttatttgtctcatttttgcttgtttatattttctaaactttctgtagtaaatatgtttttgtttttgtttttttaataaaagaaaacagactcccactgatgacttacggagtgcagtagatgaggtgtgagtgggtacaaagtgaagaagatgtgaccattgtccttaatggagtttaaagtctatggaaggagataagacagggagacaaatgacacaagagagtggacagtgatgctcagggaaggctgggaacaggaccagtccttctcaagtggcacctggcattaaagaaatgttttcatcattcttgccccaacagtctccatatatggtcttccctgatctggaaataggacagtaaatggcacagtcagaggcaagggtcactcttttcattgatcccagagccccagggggatggggatggaattgctgaaattcctttctaaggtacccgtttctaggaacaagcttatgtggaagaaaaagttgagatgctttatgtaactcatcttatccacaacagatttgtaccccagttgcaaagcagcacatcaagaggaatggagaactaattttctgtttctctctctcttcccgtagcataattagcatcatcattattctggctggagcaattgcactcatcattggctttggtatttcaggtatgtgatttcttgcattactacaatctattcacccctcaccattaaactcctaatcactcagtgcgttagcatggaaagagcccagagctttgacccagaaaacctcagagtatagcattcattcttctacttcttgtgctttctctacattagtcagttaagtcctcgacttcagtgtcctcattttttattatttatttatttattttgagacagggtctggctctgttgcccaggttggagtgcagtggcatgatctcagcttactgcaacctccacctcctgggttcaagccatcctctcacctcagcctcccaagtagctaggactacaggcatgtgcaccaccatgccaggctaatttttttatttttagtagagatggggtttcaccatgttgctcaggctggtctcaaactcctgagctcaagcaatccacctgcctcggcctcccaaagtgctgggattgccggcctgagccaccgtgcccaggctagtttcctcatttttgagtggggagatactgtcaacatcaccagttagttgagataatcaaatgagatgtttatcagtagtctatctatcagtcagtgctgaagatgtcattctgggatcataggtgaagtgctgcctctgagccattctgtcagcggttggcctgggtagatgatttctttgcaacgaagcttcagctgaagtgttaaagaatatcaagtctttgtacacaggggtcttaggtaaagagacaactggtcatgactactgtaccatgtaggaaacagataccgctgtagcacagatggttagtttctgaacgtatctagccaatgtcagttgcagaagagtctcttcactttcctcttctgcataggccactgctctgaagcatcttttatggatgctgctttaattttgacactgaatgagttaaggctggcagttttcttctctgaggcaaattgtctgctctttttttcataaaccacctgactcagtccaacacattcattttaactcagtctgtgaccaaagctccgtaactttattttctatattccagtggcctttctgccatgcttctccagtgtagacatgctggcactcaatactgtcacaaagtcgaagctaagaaaacttgctagagttgtgtttgctagaaaagacattcatcccttccccactttctttgtcatcaatcatatattttttaggccagttgtggtggttcacgcctataatcccagcactatgggaggctgaggtgggagtactgcttaaggccagggttcaagaccaacctgggcaacaaaaagagaccctgtctctacattaaaaataaaaaaagtaaataacatgtgtattttatcttccattcatttttttctattggggtatttgtctttctctttttgatttgtaggtaattccttctttatcatggatgcaaactagttacaggtatcaccaaatctcttctactctacactttgcttttttactctcttaatgatgtttttcaatgagcagaagttcttaattttaatttttattgatccttttctttatacttggagctttttgtaacctgtttaagaaatctttgcctattccaaggtcgtgaagatgttcttctagattatcttgtagaagctttattgttttgtctttcacatttatatctgcaaaccatctcaagttaattttatatgtagtacaagagaggggtcaagattcattttttccttatggtatccaataaacccagcaccactactgaacacactgtccttcccccacttcccttcagtaccgtcatggtcgtaaatcacgtatccaaatgtgtggggatctgtttctgaattcactagcctgtttcattctaatactaatttcctatgttaatttatttcttttcctgttcataatcttggttgttttctctcaaccaagtttctgaaatcactagcctgtttcattgtaatattgatttcctatgtttctgtttctgatctgtttctgaattcactagcctgtttcgttctaatattgatttcctatgttaatttatttcttttcctgttcataatttcggttttttttctctctttctttctctctagtcttctctctttctctttttctttcttctgctctctctttctctctctctcatatactaaaatagatttataaggtattgttagctttatagtagttttgaaagaaccagcttttagcttatttatattttctctgatctgtattcctattttactaattttggcttttatctttattaatattcctcttcctgctttacttggccatctttcaattctttttctactgtctcaaaataaagcagctcacaaggagtgtgagtgcttaaaaaagcagctcacaaggagtatgtccaaaaggccaataaatagcttttagtagatactgccattcaattttccaaagtgatgagtcaatctactcttcaccagcaatgcatgagagatcaagctctccacaccctcaccaatactgggtgttgtggaattttgtggttttaatttctgtttcctggtgacagagactgagtacattttcatatgcaaaacataatgtggaactacagaagagcacaaaagagtaagttctgtatgattctatgcatatgaagttcaaaaacaggcaaatggatctctgctggtcaaaggtagaataatggttcttattacctttggggacaagtaagcaggtagcagtgaggaggggcatgagggcactgctgggagggcagtaaggttctatttcttggtgtgatgatggttacatggaataaagttataatcattcttcaagctgtacagttatgatgtgtggatttttatgtttgtatacttcagtacagacatacaaaaacatttgtaaatgtatatataaaaacataaaatgcatataatgtcatgtatgtatatatacattttatgtttacatacatatatattcttttttttttttttgagacagtcttgctctgtcgctcaggctggagtacagtggcataatctcggctcactgcagcctctgcctcccagcttcaggttattcttctgcctcagtctcctgagtagctgggattacagacgtgcaccaccacacctggctaattttttgtacttttagtagagatgggattttgccctgttagccagactggtctcgaactcctgacctcaagtgatccacccacctcgacctcccacagtgctgggattacaggtgtgagccactgctctctgatttacatatatattctttataaggaaataaaatatagactgataaaccaaatattttggaataacttttaaagatagtaatgctaaagtacattttggtaccttcctcactaaggcttaactctttttttctttttctttctttttttttttttttgagacagagtagctgggattacaggcgcgcaccaccacacctggctaatttttttgtatttttagtagggacagggtttcaccatgtgtagccaggatggtctagatctcctgaccttgtgatccacccgcctcggccttccaaagtgctgggattacaggtgtgagccaccgcgccaggccactaaggcttaactgttaattataatttaccctattcctgatcttatacatcaccttcaactaaaaccctagtatttatttgtcactctaaatcttgatgactaaactttcttggacctaaggctcactggctttgcatcagaactcttaagagagttgtttatcttttggttgttagtggtgttgactctcctagcaagaattttcacaatatcataacttccctgtgttagtcaggaggtttgctacttatatcttttcctgttgcatagcgacagccacctcaagaactgtactcagctccttgaatgcacagggtgctccgtaagtgctttttgaatggacagttggatggatgcatggaggtgtgaatagatggaagtaacagtctgctcaatccagtaatgtaccatcaaaaatttaaaactctactactgccaataaaaaggtgttctgcctccttcccatttcacagggtgacagctggttatttggataaaatgggcagtttgttagtttaatactgtttagttggattttttcaattgcctctattaaaaggactataacctttatcagagatcgtattatcacattttaaatgaattcaataaaatattagctggtttaatatataagacattgaaattaagcaaatagcgttaagcagatgatgatatgtattaggccgttcttgcactgctataaagaaattcctgagactgggtaatttataaagaaaagaagtttaattggctcacgattctgcaggctttacaggaagcatggtgctggaatctgcctggcttctggtgaagcctcagggagctttcagtcatgatggacggcgaggggaaacagtcatgtcatatgtcgaaagcaggagcaagagggagagagagtggtggggaggtgccacataagtttaaacgaccagatctcatgtgaactcagggcctgagagctcacttatcaccaaggggatgacccaagccatttataagggatctgccccaatgacccacacacctcccaccaggcacctcctccaatataatataattggggattatatttcaacatgagatttgggtgaagacaaatatctaaactttatcatgatgatatcttttgaatcctttcttcatgcacttcactgtactaaataactttgcatgcatgatttgccttactacacacaacaaataggaggtagatgttattactatgatgagatgagaaatgtgtggaaggacacacaacagtcagcaagtgagcatggctgtatttcaagccttgggaatttgtttcccgaacctacactcctacccatcaccccataccaatgacaacgttcacacagagttgtagtggagaagggtgttttatggtttgccttgcaggcatgattcctgagaccacagcttttgaaaacataaaacttttccccaatacagaaagaaattctatttctttgtaactctcctgatgctgtatatgccaccttctcatagccatcctcctccttacaaattctaaataaaaaccccagaaaacataaaatgcatttgcggtggaccatttgaaagagaggttgaggggttccaatcagcccctggttaaaggacaacccttgtggataagccttcgagaaggaaggagacgtgatggaaaggcccctaaccatacccagcccagtccctgcgctatcacgcaccctctgactttgaacagctctgtataatggaagaatctcagaatcagagccattccaatctcagcgctcacactaactgtatatcctttgggatacaacttaaatgtttcctcattggtaaaataggcagggtcattgtgagaattaaaggagagtccactcacacacctgtgtgtgataaacagctgccattgttatttatattgatgccatcaatgcttttagtaaaaatctgctattattaacgcattcatatagcacctcctaggaactgcacaatttcctggtcaaccaggaaaggcctcctttgaagccacaggatgctgcctcctaataattgttacaaacaaaacctggaactgtaacatgtgtcccgtatcgcccccgcaaccccacccccctgccagaactgggaagctgttgaaagaccaaagaatgacttagacaagtccagtttggtgagtaaatgagtttattaggacttacatacagggcactcctgggtggcagcaagacagccctagagatctgtgccatctcccatatctaagctgcttttaagctggttttctggctctttgcctgctgtgtgtttgcaatgagactgtttttcttggtgtgttctcagatactctctgggatgtttaggttctcagggacatctgctcctcagctgggcaccaaggccttggcttaccacccagctgttggggttcaagcagcagacatacacccctaaataacctggtgagtgacctatcacactacagtaatgctccagcttcagacattggataaaccgactaggtgtgtgctgataacaccaaaatggaaacattgcacagtttatttagaaaatatttgatctgtccaaaaaaaccttcgagtcatctgagaaaataaacagctgtgggcctttcttacacttattttgtggtttttagttgttttgatttttaagtgaagtagggatatcttcttattgggttggcactctacatgtctcaatctggccctgggtatcagcaaaatatggtagaaagggcataggctcagggccagaccaggttgtgtttgaccctgactctactaacagctagatccaaggcattcggcaagccatttaacctcatggagtctctatcctcatccataaatgggtataatggtcattcttactctctcatggcttaaaatgagtctctgtaagcaaacatttagtgaaatgttgttttccttacctcctggggctctgatctgcaatctttccaaatgattgtagttaataatggttattaatatcaatactgatttaaggtttagcatgtggcaattcaggtacaatatttagcactttacctgcattgtatcattaagtcctttcaggaaccctctaagggagcatccccattttacagattttaaaaaatggtgaaataaagggttagaaaacttgaccaaggtcacatatccaataagtggcagagctgggacttcaacccaggcagcctgtacctgtgccatgttctcaaacaccatgttctgctgctttcctacattgttcccgtatctggccttgcccagtgtccttttaaatttcttctcacggaagcaactgttctccccaccccaccgtcttctttggcaagagtgacactcacaggtttgaccccaaggttaagctttgcatttcgaccttgtaagccatgtactgtggtgcccatctggacagctgagttttagcagatgctggtgaccatctgctgaagacatctagcatgctctctatgctactggaatgtacgaacctgtctttctgagtcatttcaaaggacagctcattttccaggttttatccagcgctgtgggctgccccagcatcatagtttctgtaaagaatccttgtcttgtgttacctatacccccacttcaagatattcctactcctacaacggagcgctgattgaatagtactcccactgtgtgaacccagagctgctcaggtttcgtcttgcccctgctttaacagccccactttcctcatgcagacaggagctgtggtagttaattagccctcacaagctggataattaattttcagtaagtggctcagtcttccaattttaaaggggtttaatgaaatcttagaggtaaatgaaatgcttaaaatctgtgcccatttaatagaattctctatcaataggtacctgcctctagcccatctccatggggtccttttgtcctttgactcaacaagtcacacaagaatctctggtggagtgagtctctgtctccaaaaaataaaaaaaaaagaatctctggtggtcagtaggcctggagagtcataggaggccagatggcataatcctccttgagcctatgtttgtttgcaagtctgaatagtttcttttcttgtgagaagtaatatttacatgtggttgcttgcaaattaaattttgtcacttttaacaatcatttattcacttaacaaacaagtattttattgactgctttctgggtgcaaagcaatggctaggtccctgtggtttttttaagttctcactggctcttatttctcttctttatttgacattggggtggaggggatttaatcaacattacactcattccatctgccacatcattaatgcaaccttaaatgactagaacctgcagcaggtccctagggcattccacagctgcctacttttaatcattaacttctctgggagatatttcaacggattccctaactgtgagctcaaggccaacatattaaaattaattcagtaatacagttgctgaactaaggtatgtcattaccatttcattctctccataaactgtgctaatcatgtattttttctgagaagtaatctttcaattcaactttaatggcactttatcaacaaccatcaaatttacctttgctgtaacatagttgtatttgattcatgattttattgtgaacctctcagtatttttattgccttccttttcattggatcacatttccccaaagtttagatgtggtaatcctgccaaacgtcccttactcctacaataattttagcctatctcaaacaatgctttgatttctactgatttccatttatttattcatttattcataaactcagcaaacattatttttctctgcagaaacatagctctaggcactacaggacttacagataggattaagacagtttctgctcttgaaaagctcacaaactagttccagagatagattagagaccaggtagagggagacagctgctataataaaggccaaaaagacaaaaagttacaggaaagtaaagagagaatctactaatttttcctttggtgaattaaaagaggatttcatgggagggctgccatctgaacggactttgaatataagtagaatttgcataactggtgttaaagaagtgtgagctatgaattaataggtacaagatgaacagcagtgtgaaggcgcatagtgtaattgtgtaacccatgctagcctgggatgccttggatatcattctctaagtaacaatacttgcaaagcaaactgaatctttaaatcaatgttcaagaaaataccaatgcagggaatggaggtgtgttgtgttcttattacacagcaaaaacttcattttgtcctctttcataattcgtctcccagatctcccacaggaatggccatgcatggcagctgcttccaaagtgtcttttctcacgctctcaagcctccaaaacatccttccaaaccaggctatgtacttgtttttgtctcctcttcctccttttctagctataatttttcttccatcagtagccttctgttctttctgctgcaaatccatctagattagcttctccagttctcttcctcattcattaccctcatttactttgtagaggtctaggagtcaatgagataattccaacccctaataggctggaagaggagaagagccaaggatatccttatgttgataatgtttacctctcacattaaaacaacaacaacaacaacaacaaacacgtctgctttgtttgtatgttttttatttaaggcagaaaatcaacaaataatttgatacagacagacagaatggactatgaaaggatgtagttggagagaaggctgcaaagacagcaataagggctaatatgtatggagcatttactatgtagcaggcagtgtttagctttgaagtccaggctggaaaatctgaaatccattccacagctcttaggaaccattaaagatgagtgattagaaaacagatatgttcaaattgtactgtaagaaggtctacctgtaggattaatgcatgtaaaatggattggatggaggcgaagatgaaaggtagaaataccaataaagaagctgataagtccagttaggaagtgctcaggacccgttatgttgggcttttttggctgtaagaaagagagacttgtgcaggccactttaatatcaggtgttgtttaaaggatgtgcagagattaggacaggaactagacctgaacaccccaggatccaagacagctctggggatgaaagactctttccatttttctctcccatggtctctcccccatacttctttgtgtctcctccactctcctcttgggctccaaggccatctgcccttagtttcatatccaagccacagaaagagcctctcaagaagattcagttaattaaatcaccccaataggtgtcctcagtcagcagcccccagtgtacaatgaacagctgattgatccttccttgactgggtaggctgtaggctggccaagtgaggaggaagcagttggatacagctggcacataattaatatttctactggtggtatgtcagtagaggagagggtggctttcattttaaaccaaaaatcaactgaattaaatacagttcttcattatgctatagctagcactgtaaacttgatcaaatcagttattttctcactgccttagtttctatgtcattcaaacagaaataaaagttacagcactttagaattcagcatttttcagaatgactaggccacatttagttaacatgagatttcacttctgtgctacttctggttaactgagaataacaataccttatatgtgtaattacagtttgcaaatcaggttaatatccatttgatttgatcctcacaagaaacctttaaagtaggtgatatagtttggctctgtgtccccacccaaatctcatcttaaattatactcccataattcccatgtgttgtgggagggacctggtgggagatcatttgaatcatgggggtggttccccccatactgttctcatggtagtaaataagtctcacaagatcttatggttttatcaggggtttctgcttttgcatctttctcattttctcttgccactgccatgtaagaagtgcctttcacctcccgccatgactctgaggcctccccagccatgtgaaactgttaagttcaattaaacctctttttcttccaagtctcgggtatttctttatcagcactgtgaaaatggactaatacagtaaattggtaccagtagagtggggcactgctgaaaagatacccaaaaatgtggaagcaactttggaactgggtaacaggcagaggttggaacagtttggagagctcagaagaagacaggaaaatgtgggaaattttgaaacttcctagagacttgttgaatggctttgaccaaaagccttatagtgatatggacaataaggtccagactgaagtggtctcagatggagatgaggaacctgctgagaactggagtaaaggtgactcttgttatgttttaacaaagagactgatgatgttttgcccctgccctcgagatttgtggaactttgaacttgagagagatgatttggggtatctggtggaagaaatttctaagcagcaaagcattcaagaggtaacttcggtgctgttaaaggtattcagttttataagggaagcagagcataaaagtttggaaaatttgcagcctgacaatgtgaaagaaaagaaaaacccattttctgaggagaaattcaagctggctgcagaaatttgcataagtaatgaggagctgaatgttaatccctaagacaatggggaaaatgtctgcagggtatgtcagaggtcttcatggctgcccctcccatcacaggcctggggtcctaggagaaaatagttttgtgggccgggcccagggtccccatgctgtgtgcagcctagggacttggtttcctgtatcccagctgctccagctgtgcccaaaagggtcttgggccatggcttcagagggtgcaaaccccaagtctcggcagcttctatgtggtgttgagcctgtgagtgcacagaagtcaagaattggggtttgcgaacctccacctagatttcagaagatgtctggaaatgcctggatgcccaggcagaagattgctgcaggagtggggctctcatggagaacttctgctagggcagtgcagaaggaaaatatggagtcggagccccaacacaaagtccccctggtgcaccacttagtggagctgtgagaaaacagccactgtcctccagaccacagaatggtagatccactgacagcttgcactgttcttctggaaaagcaacagacactcaatgccagcctatgaaagcagctgggagggaggctgcaccctgcaaagccacaggggtggagctgcccaagaccatggaaacccacctcttgcatcagcatgacctggatgtgagacctggagtcaaaggagatcatttggagctttaaaattttggacttgcataggccctgtaactactttgttttggccaatttctcccatttggaatgactgtatttacccaatacctgtacccccattgtatctaggaagtaactagcttgattttgattttacaggattataggtgaaagggacttgccttgcctcagatgtgactttggactgtggacttttgagttaatgctgaaatgaattaagactttgggggactgttgggaaggcatgattggttttgaaatgtgagaacgtgagatttggaggggccagggatggaatgatatggtttggctgtgtccccacccaaatctcatcttgaattatactctcataattcccatgtgttgtgggagggacccagtgggagatcatttgaatcatgggggcagtttccctatactgttcttgtggtagtgagtaagtctaatgagatctggtgggtttatcaggggtttctgcttttgcatctttctcatttttctcttgccaccaccatgtaagaagtgccttttgcctccctccatgattctgaggcctccccagccatgtggaactgtaagtccaattaaacctctttttctttccagtctcaggtgtgtctttatcagcagcatgaaaatggactaatatagtaggtaagacagacattgttacctccaattttctaagatccaaggaggttacatgacttactgaaggttacatggctattaagtgacaaagccaagacttgaattttcatcttcaaaccccaagtccaatgtgttctcaaggtttgggttacttggtcttacataagccattatatatgacagatctgctatatatatatatatatatatatcaaaatgattgtcttcctgctctttctcttcttgtcttcttattgcctctcatgttcttctgtatttttaatttatcacagaagtctctgtctggctttcagcaatgaagggtttggttgtagaagttccaaggcttcccttagcattgatctttgcttcctgaactgcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggaggtgagttacttttggagagagattttttaaagcaccaaaagtatttgaggctaaagattatgagttgcttatgaaatatgttgtgaccaatatcagacaatgatgctcccaattctgctaacagctgtttttgccattttatggccaagactcacaccaaccccaaaagtagccaactataagagaggccttaaaaatcttttgttctgggttctctctgcttcagaatttccaggtgtgttctctattcaacaaaataaatgtagcctcttttgtggtagcccctggtacagctaataagagcagcctagcctgggacatttccacgctaagtagacccaagcgcaatcctgaaatcagtatcttcagagactcatgacagtgagtgcattttagaagttcaaagggaactaaccaaaacgaaaacaacattgtcctataaactcattaattccccttcccctgcaacaatgaaatccaccctttgttgccaacccaatttaacatatgttttctgaatttatatacaagggactcaggtactgtgagagtataaagatgattaaacagatttcccctacccttacagagctcataatatagatctcacagagttaggggtcaggacagagataataaaagtctgtaaatgataataattagtaaagtgtatcaaatgctttaagagaaatataaatggagtgattgagaagaagagagagatcccgttcaaatgcataggagggaagggatgggaaagccccctggagaagctggcatttgaggggagccttgaaggataggcagaaaccgggcctttccagcctaaactagtatgcacaggtctttcttgcacacctcataacatgcatatgcaatgattcgaagctcagatctagaatcagacctgtgtaagtacagtggcctgggcaaagcaatctctctgagcctcagtttcttcatcttaaaatggggtcatgtcaaagggatactggagccaactgaaagagcttccaatggcaaagctggaacaatttaagcaacaaaataagtaacatagtattgaattataactcaaaggtatagaataaatacatatgacttcatacttatttaaataaatgagggatatgaaacaaattccccttacagatgaattccaaataatttatttagatctcttccctccaaaaagtggagcttgaaaccttccctatcccactcagggtatattggacttagtgaagtccagcttccaaagaaatccggcaaacactgctttagccaggtgatccaggttaacatcattaataagtcatgttaacagcatgtaccttctgatataatgtgatgggaagggcactttacctcctgtgctcttcctctctaaaacctgtaacctcagtctaatcaggagaaaacatcagatgaattctaacagaggggcaacctacagaatacctaaccagtactcctcagaactgtcaaggtcatggaaaatacctaaccggtactcctcaaaatacctaaccagtactcctcaaaactgtcaacgtcatggaatatacagaaaattgggaaaacatgacagactagaagaaactcaagcaacatgatgactaaaagcatggtggtgttctggaaggaatcttggaacagaaaaagaacatcagtggaaaaactgttgaaatacaaatcaaatctggaatttagttgatagtaatataccattggcggtttctccgttttttcttttttttcttttctttcttttttttttttttttttttgagatggagtttcactcttgttgcccaggctggagtacaacagcacgatctcggctcacagcaacctgcgcctcccaggttcaagtgattctcctgcctcagcctcccaagtagctgggattacaggcatgcacctccacagccggctaattttgtatttttagtagagactgggtttcttcatgttggtcaggctggtctcaagctcccgacctcaggtgatctgcccacctcagcctcccaaagtgcttggattacaggcgtgtgccactgcgcctggcctccagtttctcagttttgactaatgcacattggttaagatgttgacattagaggaaactgggtgaggcctatgccagaactctataccttctatgcaacttttctgtacacgtgaaattatttcaaaattaaaagttgatttttttttaatggggatgatagtattcacaggagtgttgtgaggatcaaatgaaataaggtctggaatacagtactggcacagaatataccctcaatgaatggtggttcattgtcatgtaaacttagtttcccacatcatcgcccaagagcgtgttccctgcctgctccgagcatgagtcttgtctcccctgctagagaacagactccttaagggttaggcaagggctttccttttactacttactcagcaccagctcagtcccaggtaaaggaagacgccaaataaattaataaattatattttaccccaataaaaagtccaggcttaaacattttcccacaactgtctctctgcctggatatggggggaagctaagtcttaatttcaaaatgcagttaactctcctgcgaggagaattaccttggaggaaaacaaatgtctgtttctatccctggataccagagctggacaatctctacccaagcaaactccaaatccctgtgatgacaaagcttgtgaatggaatttctgtgggtgatagatgaatgctgtttgtttcttctttctccttctccctacccaccctaactttatcctccagggagaaaaatacataaaatccagaagcttcacagatccctaggaaaatgcctaattccctaagggataggcttttttatgaccactgaagttcctcttacttggagaaaattttctattgtaaccataatatacctagaatttaggtccttggggtttgtgattggccaaagggttgtgatgtatagcaatactatgagcaaataattattcgcacctataatacaatgggctatacacaggtggacctctgaggaagtactgagtggcttcaatgataaaaaaaaaaaaaaaaaaatgactgcatttttaaggcctagcgcttcaaaggctatattgtcttacgtgtctgactttggcatctgccctttctgacttttgaccctgcagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacaggtgggttcctgcatgcttttgtatggatttactggggaaagagtaaaatctaaattaaaatttaacttcattaatagatatataccaaggcacaaaaatctctagagtcctcttcactaagaatttgatcactcaattccagttgagattgtattacataagagaaagcccaacacaaaacaatatgtatggcatataggtcaaagatggcaattaggtttcatcttgtatgctttctcattgactggttgtctggagaacagtgtttaggattctgaggctctgtgtaactcagtaggactaccttgctacagcagtgaggaagtgataattacttgacatctttgatatgttcagctggacttcaagccctccaaaacttaggctagaaaccaaggtttgcttccaccctgcctttgagaaggctgtgaatctgaagactaaaagtctggagtctgacttagttttattcatccctcatgagactgactcatgatcccactaatattggctcaagattaatctgaaacccctagatggaactggtctcccagcaccctagctgagagctggctgagaagacccagcaccctagtctccctgcagtgctttagtgcatacaaaaccttaggttgagctagtatcaagaaaatgcatagactgaattctgacttttaagaccatccttcctggggcgaaattggattcaaactgtagtgaaaggagtacgtcaggaggctgccatttaaatcaagcctagcactgggcacaaaataccttacacattataagtaccctataaatgtttgccgaatctaactgaataaatcatattcttatgattttttaatttgaaattatacatatgaacccaaaattatctacaactcagatatatcaatttaaaaaataaattacactcacacacacaaaagtaacctatggaatgggagaaaatatttgtaaatcattttaaggggtttcaatccagaatatattaagaactcctacaactcaacaacaacaaaaatcaaataacctcattttaaaatgggcaaagtacttgaagagacattcaacccaagatgatataaaaatagctaaaaagcaaatgaaaagatgctcaacatcactaatcattggagaaatgcaagtcaaaaccacaatgagatatcacctaatgcccattagggtggctactctaaaaacaaaataaggcaaaaacagaaaataacatgttggtgaggatgcggaaaaattggaaccctcatgcactgttggtgggactgtaaaatggtgcaacttctatagaaaatagtataaagtgtcatcaaaacaattaaaaaaaagaactactgagatatggagccagccggacttcgtgggtcgagtggggacttggagaacttttctgtctagctagaggattgcaaatgcaccaatcagcactctgtctagctaaaggattgtaaatgcaccaatcagcactctgtaaaaatgaaccaatcagcactctgtaaaatggaccaatcagcgctctgtaaaatggaccaataggcaggaagtgggcggggccaaataagggaataaaagctggccactggagccagcagcagcaacccggtagggctgctgtctgtgatgtgcagggtttggtgttttgctgttcacaataaatcttgctgctgctcactctttgggtccacactagctttaagagctgtgactctcactgcgaaggtctgcagcttcattcctgaagtcagtgagaccacaaacccactgggaggaacaaacaactccagatgcaccatatctgaacatctgaaggaacaaactccggacacaccatctttaagaattgtaacactctccaaaaaaaaaaaaaaagaactgtaacactcaggttgggcatggtggctcacacttacactatcatatgatctaacagtcctgcttctgggtatgccttcaaaagaattcagagtctgaatgagatatttgaacacccatggtcacagtagcactattcaccaaagtcaagagatagaatcaacccaaaatgtccattagtagatgagtagataaacaaaatatggtatacacatacaatagaataccattcaggctcaaaaaggaaggaaatcctatcatatgctatgacatgaatgaactttcaggacattatctatgtgaaataagccagtcacaaaaagacaaatactatatgatttaaacaaagcatctaaagcagtcaaatgcacagaaacagaaagtagaatggtggttagcagagggcagggtggaagagttgaaggagaaaggtttttgtttaatgagtatagagtttcagatttgcaaaatgaaaaagttctaatgatttgttttataacaacgtggatatacttaacactactgaactgtacacttaaaaatgcttaagatggtaaattttgttgtttttactgcaatttttaaaaagtatctaactaaaaaattacatatgagagcgagagctcttgcaccatcttgaggaacaaattggcaactatcctggttaggattattagttgcctgtaacagaaaaccaatataaataaatctagtctgaaagggaagtgtaggaagtgtactagaatgttgtggaaccaaagacaggaagttcagttgacttcaggatcaactggaaccaggaacttaaatcccattgagattctttttctctcatttctacttaattctctctttactctcttgttttagtccatatggcaagacgtgattgccaagcattcctatatttaaaaatctcttactcaagagagtggtgagactgaacctcaattcatcagtctcattctacattcccaagaaggactttgactccacttgggtcagctgcccatacctaggccaatgaggcagtatctgatgaaaggccttcccagaagagaaggagggactgaagtattggtcatttaaaacaatgggtgctgacaacagtatctcagtccagttcccagtaaaaagctccaagctgtgtaaataatgtcttctagtagcaagggccacaactgaacaagacatagacattgagcacaccttttattcaattaacagatctgtcttctttacatgtttgttggatacatcaaaacaagtgttcgaagtgtcaggctaggatgaaatacaacttttggtagctcaaaattaagaaaatagcagaatttcttattgttgtagacaaagtaggtgctccatgcatgtttttaaacaagtagggccatgggatttacatattgtgttctctgcctatactgctaatttaggtcattcatttaacaaatatctattgtgtgccaagtatgttcagagtacttttttaagccccctgagatactgaaatgaatagcataagtatcaaaagagaagttaatcacagtgtagatttagtacctatgggaaagagttgttaattatgactgaagtggatccatagataaggcagagttccggctgggttttgaagaagaaaaaaaatggtttggataaaatgggaagacctgaagtcaggagcttacagtaatggtctgggggagaaattatgagagtattaactggagcaggggcaatgggaaagaaaagggggaagaatcaaaagttgcataaacaaaataatgtacagtccttggtgatgcaaatgtgaaagtcaagagaaatcacaagtcaaagtgggtttgatatttctacccaggatacttaggaggttggtgatgctaccagaaaaaaaaaaaaaacccaccccaaaacataggagcaatatgtgtggggagtagataagggttttagagatgtcgagtttgaaatgcccatagtgtacccaggtagagatgcccagtgcttagcacaatagccagcatgtgataggttttggggagaacactacacccttactccatatatttccttttatgagaagggatccccaccagtgtcatctttttagcctctctcttcctccctctttcactcttcctgagagaacaaggaattaatttatctgattgatgagtatattaggagcagctggacataagtagctcagctcctcctttttctttttgtttttgctaactctcaggaagcccgtgtacattctgctgtgctcctgcaggccgtcagttgttcaggggtagaatctgctcctgcaggagacttgcaccagtctggttctgtctgacagtggggagtctcggctgtagcccacttgcctaactacaaagcctcattctctattaacatattttcagcactaaaggtgatattttgatcttccagttgccttatttttttgtccttctctttaattggttcagagctaagctggggaagaggctgttatttattggacttctttgaaccccaatagtaggtactcagaaatatttactgaataattatgtttttaaatgacatatctagcagcaactggaaatctagatgtggaactcaagacagagttcaaactaaggaggtagacttggaaatgactagcatgaaagtgatatttattaggcttgagtgatgttggctttattgtcgtttttacagccagtacttatggagtgcttattataggccagacactgttctaagtgctttgcatgcactaactcattaatcctcataagaaccctatgaagtaggttattagtattctagccctatttatagatgaagaaactggagcacatacattgagtaacttgcctaaagtcacacagctggtaagtgacagagctgaaatgaaataaaagagataggattgtctagggaggaaattgagcaaaagaagtatgatttcatttctttacatctaccattctctgcttcagaatgagaataatacttcctagacactttatagtggtatgatgaaagctaatgtaatgacgtggatcctgtaaagatcactgcctggagggaaaatgcgtctcaagccaagaactggccatggctgtttgtttagcctattctttatttggtaacccataacaatctcttattggtatagtttttcattcggctgagtgttcactggagtggaccacagaatggaattttctttgaagaaagagaaagctctacttttaagccagttacggagaggtgggcaaaggggtaaaaaattgcctgaattaggaacaacttgttctgtttttcaggtacttttctttgctaaccagtcatgtgaagaagacatccagcttctcctgtatgaccctaaactttttctctcacttcacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacaggtgagattaatcacaaatagtgtgggatattggttctgtgggtgcttgtgctcctaatgagagtcggatagccttcagcatcagccacagaaagaaacatttaatgacaccagggctgtgacattatttccactagtactgggaaaggtaatcatttgttaggtcagcaaacagcatagacttcattgacagacccataggaaaaataacatacaattcaagtatttatgtaaattcaaataccttttaagttactcagtcatcaatgaaggcaaaataacttattgaagagaaagagatatttagccctgagtaattaccctggattccactgttatttataaagcatatcatcattcacataaaacccctccctgcccttccagccggcccctgtggacagttggcagatgactcaccaactagccctcctgctgagatttccttctcacttcagtcctctggctccaattattgttaggatatttccttttgaatattcttctgcatatgaaatgtgtataaagctgagatcatgaagttccagtcgatactcccatattactcagtggcatccccaccaagcctccagggttacagcctcagagctatttttgtctcccctctgtcccgcatgtcaatttcttatcaacccctacctatcacattttcccctgtgttgcctctcagattgaccctaatccagccttcatcatctcacaccccgactggttttgaaacactgtacctgctccttcctttccctgttttagctgataggaaacacggtgccagaatcgaagtattctgaaacacgatttcatcatagccttcctttgctccagagcctaaagtgactctctgggcataactatatcgaagtcaaagtcacagaagcatacctacccaccattactacctaccactactgctgcctaccactacctgctaactaccattactttctggtcttgctccctccctcactgtcttttcctggaaatcttctctactctgtggcaatttatacccactacttcctttatccattttaggaaaatgcttcctagcttatatcccacctccccaagagtctttgtattttatatcctcttggcatgcatgtatgatttatgtcttacactctccagggtacatgtattccttgcctacattgctaagtcctcagaggcaggtaaagatctgttgatctgcttcttttcattctttctcttgttctccaagatttcactatagtgcagtgaacaaaggagattctttgtaaggaaacccgccagttttcatcatttccaatcctccacagttgtcagcagagatttccctaaggaaactgtcccttgggaatctcactagtagagtgaaaagcacttttttctttccttgattccccacaacactgcaaatgagtgtttaataacctgcaactaaataatatgtcctatataacatagctgactcatctttaccttgtattcccttagagtaataatttacagctttaaaaaaatatccacgacatacatctaatggataatgttcacatgcagcacacgtaggcttatatacaattacccagttagctgcagtccacctctttctccctggcaccatagaggaataaccataaatcaagtagattttttaaagtaaatgagtaaggctgggcatggtggctcacacctgtaaccccagcactttgagaggccaagatgggaggactgcttgagcccaggagtttaaaaccaacctgggcaatatggtgagacccccatctctacaaaaaaatttaaaaattagccaggtgtggaggtccacctgtggtcccagctactcaggaggctgaggtggaaggattgcatgagcccaggaggtttaggctgcagtgagccaatgtttgcaccactgcactccagcctgggcaacagagtgagaccctgtctcaaaaaaataatgataaaagtaaatgaatagaacattatttgagacacacattataatgggtaatggcattttaggccacacacactccctggttaggaattgaggcagaaaccacctttccacctctattcaggagcctgcccagactcctctcagttctcatttactataaggacccatctcttctcttccttgagactgccactgggatgataccccgttaaggagagattcaagccatctctttttccccagcaacccatgggaccatgtggcctcaatagaacaacatcaaaatactgaaaaataagcccctttctaaacaagagatacaccacgcagtggcagggaagctctcagttctcaataattgttttgtgaatggctataatggtatcttattgctgttatttccacaatcccagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgctactaccaactagtggatagaggccagggatgctgctcaacctcctaccatgtacaggacgtctccccattacaactacccaatccgaagtgtcaactgtgtcagggctaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctacacca

SEQ ID NO: 66 - DNA, 35737 bp, Homo sapiens
caggaaaaacctcaacctggggcaaaaacgtggtagagcggaaggagaagttaaggactgagctgctttgcagatcacagtgtttgaaagtgaacagccaacctgacaagaagcaaaaaccacagaacagagtaccacatcgtctttctgttcactttttttcacaaaatcatccaggctcttcctactctcctctcttaccacctctctcttcttttttttttttttttagttatttcacagatgccactggggtaggtaaactgacccaactctgcagcactcagaagacgaagcaaagccttctacttgagcagtttttccatcactgatatgtgcaggaaatgaagacattgcctgccatgcttggaactgggaaattattttgggtcttcttcttaatcccatatctggacatctggaacatccatggtaaggcacctgcttaggttatttctggttttatttctcagggggtcttggaggcaacattctcccttgctgaacttagtacggtgtaacgtttatacgaagtgggtaatcgtagatgaaaccaagctgttacatttgcttaccgaagacatcgtagagcataaaccaaattagaacatagtattcacctgcctaatcataggcatcgcatcaatagcttggctgactttcttaaaaacatgttgatggtaggaaaagagaactgagtagatgttataaatagttaagtacaaatctatcactacttcttgcaaaaatgctctggctgccatactgataatgaatagatagctcgttctttccaaactgagtgcagtagagtgctgcagtgctcagttgggtaggacagttgttggataatcggaattatacatatctccatggttaccctcaaataatattacctctaaataaaatctctatacttgcttcattgggatgtatgccttgagaataccgattgagaaaatgctacaaaatataggagcagaacttttcgtcattgcttctattttgttgaaagggaatggttcctacttggttgtcaattgaacacagaaaataagttggattctgcaaagatgatatttagccacccctgcaaagactttatacaggcaaaaaaaaaaaaaaaaaaaaaaaggcaatttcttttttattgtaaagtcgcttcctaccttatattgcataggaacccacatattatcaagaggaaaagcctatgagtggctcatcagaagcttctgatttttcaggttttatttttttatttttttgagacaagagttttgctctcgtcacccaggctggagtgcaatggcgtgatcccgcctcactgcatcctctgcctcccgggttcaatcgattcttcttcctcccgggttcaatttattctcctgcctcagcgtccctagtagctgggattacaggcaccttccaccacgcacagctaatttttgtatttttagtagagatgttggataaccccaattatccaacatctgtcctacccaactgagcactgcaacactctactgcactcagtttgggaagaacgagctatctattcatcatcagtgtggcagcctgagcattttcgcaagaagtagtgatagatttgtacttaactatttataacatctactcagttctcttttcttgccatcaacctgttttttaagaaagtcagccaagctatggatgcaatgcatgttgggcaggctggtctggagctcctgacctcaagtgatccacctgcctcagcctcccaaagtgctaggattacaggtatgagccaccatgcccagtgatttttcaggttttaaatattctgtcttattattccctacaagcacacatttatcagtttggctactgcaattttaaattagaaaatctggccactgaggttctatggaaagtctatctataattttaaactgtgtagtttggaatatgtctctatgatgccaggatgccacacaaccaagtgcaaagtaaaaaagtccttagttactcaaacatctttatgtttgtaagtatctagtattaagtcaactaggtgcttagatggttgactgaattttccaccttccatcagatgcctacagtcacatagctacaactggagtcaaatattattaaatagatttcttccccatttgaaggatacataaactactctctatgaaattaagaacaatgagtttcagtgctaaaccacattgatggtggggtaagacctttatttctcccaatgtgcaacctagcatttgcaaaagtgaacttggctgttagaactgggttaatttactggctctgccacttactgtatggcattgattaagtctcttctcttctctttagtttcctcatttgtacaatacaggtaataattgtacctaaattatggggctgctgtgaagactgtagatgcaataatatgggtaaagtgcctcgcatagtaagtgcacgtatttaaagctcagtaaatgttagtggtatttttcctaaattattttcaccatgcaacctctatgtaattaaatgagaattatgttttaacattattatttaaaatagttgagtttttaaagttaaaaataaaataaataagtacaatatattttgcaatatatttagcccaaaatatagtgaatcaaattattcagaaaatgaaatatggctgggagccatggccctagcctttagtctcagcactttgggaagccaagacgggcagatcacctgaggtcaggagtttaagaccagactggtcaacatggtgaaaccccgtctctactaaaaatataaaaatttgctgggtgtgttgggaggtgcctgtagtcccagctactcgggaggccgagacaggagaatagcttgaacccaggaggcagaggttgcagtgagctgagatcacaccactgcactcaaaaaaaaaagggaaagacttgagtgaagtactggtcagatatataccagttgatataatggattgcagcagcagttgcattaaattaaagctataggttaagagaaggaacatttggtgaaatttgttctcccaggcagagctgatggctccatttcttaaaaccacattaaataccttatatcttggggatttcctgtgatttacttaattgctgagttctttacagtaatacattttcagtgtttaaagatagcctttgaagattttttccccctacttcaaagcaatgtgagatccgtgtccttgttcctaggagtgaggctgcatatataataaggctggaaaaaatgtaatgttctctacaaacttcctgtttaaggtccttctttattacaaaagtatgcttgcttactttttgtgtttctctaaaaaattagagaaacttgcccctcagtgtgtggcatacagtttctgtcctgatagaagtaataaaaatgtcaatatcttcccttcatgggcagatcatgctggcaagatctagactgcaagtggaagtgtctctgtccattgcctgccctgtcatcctggaccatttgtctgaggctgccctagaccctagttcagttgaggatcaaccaaggattccacttttaggcaggcaggaacactgcagttaatgtctgggtatcaccaacaccatatatgatgcagaataaaggcagttggaactgtttgattgattactggttattgtgatttttaaaaaaagcaatcctagtctggttcagtaagggaaagacacctgtattctggctcttttgagaatacagtggttagggctatgtctccattttggtctggcttgtgtcatttttttccctttattatgatggtccagtatggtccatggaccagcttttaaacaccgtgttccacatcccacacagattgttttgctctactacaaactggccatatctttgggtcaaaaaatatcattccttgaagttcaggttttgtagcacagtatctttataaggcatatttctatggcttcagctatttgttcttattgaaatgtgcatatggaggaatgctagagatagagctctgtcttctgccaagtgcctatgtattgttacaacaatgcctgccatatattaaataaatgtttaggaatgcattctgtggttacaggacttcttgaattaaagcatgaaaagattaaccttgtgctcattgcagccttgaatatacttttcctatcacagagaagtttttaaatttcttgcttcctctgtcctactaccaaagtttcctctattgtaaagttgacgtcaaaactatttatcttgcctcattgggactttcctacttaatttccattatttgtgagtttcatctttatgtagagttcagaattgttaaaagaaaaatatttacaggcatttgtaatcaggtccaaaaaataatcattttcttttttccttggagaagctgtgtggtatagtggctaagatcagggactctaaagccagactccatggattagtatcctatgtctgccatttaatggttttgtgactataaaatctctggttctcagttttctcatctaaaaaaatgggagaataatcttataaggttgttgtgactattaagtgaattaattctgtaaaacacttagaatagtgcatggcatgccattcagtgctgtgtatatttagctaattttttttcttttagtccaacatttcattagtttaatagtcctgttaaagtaacattgggtgacaattgggaatcaaccacaaataaaaatttggagttcacaaaagtcttctataaattactcttgatattattatctactcttttttttctttatttcttctaaaaaaggaaaacaggatacatgtgcagaaatgtacaggtttgttacataggtatacgtgtgccatgatggtttgcttaacctattgacccatcctctaagttccctctcctctccccctactccccaacaggctctggtttgtgttattcccctctctgtgtccatatattctcattttcaacttccacttatgagtgagaacatgcagtgtttggttttctgttcctgtgttagtttgcttaggatgatggcttccagcttcatccatgtccctgcaaagggcatgatctcattcttttttatggctgcatagtattccacggtgtatatgtaccatattttctttttccagtctatcattgatgggcatttgggttggttccgtgtctttgctattgtaaatagtgctgcaataaacatacgtgtgcatgtgtctttatagtagaatgatttatattcctttgagtatatacccagtaacgggattgctgggtcaaatggtatttctggttctagatcgaggaattgccatactgtcttccacaatggttgaactaatttacactcccaccaaccgtgtaaaagcattcctaattctccacagacttgccagcacctattgtttcctgactttttaataatcaccattctgactggcgtgagatgttatctccttgtggttttgatttacatttctctgaccatcagtgatgttgagcttttattcttatgtttgttggtggcataaatgtcttctttttttttttgagatagagtgtcgctctgtcgcccaggctggagtgcagtggcgcaatctccgctcactgcaagctctgcctcccgggctcatgccattctcctaactcagcctcccgagtagctgggactacaggcggctgccaccacgcctggctaattttttgtatttttagtacagaaggtttcaccgtgttagtcaggatggtcttgatctcctgacctcatgatccacctgtctcggcctcccaaagtgctgggattacaggcgtgagccaccgcgcccagccagtgtcttcttttgagaagtgtctgtttaggctgggtgtagtggctctcgcctgtaatcccagcacttcaggaagctgaggagggcgggtcatttgaggtcaggagttcaagagcagtctggccagcatagtgaaaccctgtctgtactaaaaatacaaaaattagctgggcgtggtgggacacgcctgtaagaccagctacttgggaggctgaggcagaattgcttgaacccaggagactgaagttgcagtgagccaggttgcaccactgcactccagctgggtaacagagtgagactctgtctccaaaaaaaaacagagagaactgtgtgttcatatcctttgcccactttttgatgcggttgtttgtttttttcttgtaaacttatttaagtttcttgtaaattctggatattaggcctttttcagatgggtagattgcaaaaattttctcccattctgtaggttgcctttttgctctgatgagagtttcttttgctgtgcagaagttcttcagtttgttgcaattgcttttggcatttatgtcatgaagactttgtgagaaaaatgccaaaagcattatctactcttatccttggtcaccaagaaaagctaatagtgcttgagaatcatgcgcttgagttgtattgtgtcagtgaattgtatcatatgcgatttgcttcacttttctaatactctccattctcttacctcaaaataagctcaatattttgtacctttctggtatactctcatggttatggacctgatttacatgtttatctcaatggaagaagtggcttgtgtgcagcatgtgtctgtgtgtatgcatgcagaggtgtcatacaatttgagattcacttagaacagagtccagaagagtgttagatcagtcccaggaaaacatcaagtttagctggcagagctctttaatttcttttttctgccttcttgataaccatgttcatcttataagcacaacctggaactcacacacatcacaaatggcctattatccagtatttggctacaagggaggctggggcattgagatttttatctggggggttatggccccacttcattttcctctataatattagaagatgagaattaatattggaagacatttagcagattctgtccacataagtattgtttagtatcttcaagggctttgaaaatgccagtgaatctcagtgtgatgtctgtggtagaatgtattagagatgtgaggaagtatctgggaagaaagtagagatggactttccctttccaatcataatacataagccacacttaatctgaacatcacaagtaacaatccttccactgaagtcaatatttagaaatactcatgttggtttctgatcaaatgccagaggcactcactgatgctactgtcaacagcttctcaggtatgctgtctacatttgctgccctatgtttcttcctgaaatccctgtgacaaaggtggaaaatttagcctctctgaaggacagggcctatgtgtaacaggcaatcaaagtctctctaaatcattgttctttaggactcattaagttgactagaagcttttactattcaagggcgataattacatgttgaccaactaaaaccaccagaaactcatccttgttacacagagtagacagggctctaaggagtgcaatgcatatgaatcctctggcctagagaagcaaagtcagtgaccagtagggtagatctgcaaggggacatttgtgacttggcagagatgtaatgaagaagtcctgaaagcaagcttagaaaattatcaaaggacaaagtttttttcaatattctagttttgaccaaggcaagccttgctggttaatatatttctgtagagtttcctctcccacataaaagaagagcatgcttatattggatgtgctgcctttcttctctctattatatagatatatttttgcctggtgtatatactagttattatgcaccactgctgatccctagaatggttgttgggggtaatttttcacagcagagtcttctgtgtttccatcttgtctttaccattcataggctttacacctctggacaatgactcaacttctgtgtgatttccctaaattcatcctatcagaaaacataataatatctggtactttatgttgttgttatgtgccaagcatagtgctaagaatatttcctatatgttctcatttgctttcacaacaaccctactggataagagcttgtgctttggagttagccacacctgggttaaagtcctagccttgactcttcctcctaccagctggtgatcttgggcaagtggcttatattctctaatacccagtttcctcaacttaaaaaaataaaggccataatagtaattccctcataaaatcattgtgagggtcaaatgaaacaatacatgtttggtatctaaaagtgcctacctcataataagaactttgaaaatattagtcatattctttttttcctcgtgttaagatggatctaggttgggtctacagtatatagataatgtgaggtggagtgtacctgtgggcaagtggcaaagaatgtgtagcagtgattctagaggtgatctcctaaatgtaacttaaactttccattgggcatctgacctcatgacctctaaggttctcttcttgttctactcttaaatatctcaaggagaggaaatgacatggggactttgtaagctttgctaaatgtcggaaaaagcaatgacaaatactagaatgactgattttagacaaaacaagttcagaattatttcaaacatgataaaatcaagagatacagagcttaaagtcttcagtggctcaatacaactgcattgaagagatcagtcttcaaatttacttgccaaatagtcatactacactaacaatgagaaattctaactgtagaagaaattgctttaaagtgtgctaataccatatgaaagtaaacttaaagaaaaatttcataaatgaatataagaagatatgtttttataagaaggggatttttaagaggaaataataataaaagatgattgtgaaaatgctctcaattttcttgtttcatggttgctttttttttttaaataatgggcataaatgtagatttatgccctgtgtattcttggcattaatactttccagttccatttttgtgaaggaaattttacattgtgtgtgtgtgtgtgtgtgtgtgtgtgtgtgtgtgtttacccagggagaaaatggctcttcttgtctaaagagcaatatcaggtgatatccacagagaataagttaaatctactattgcatactacatccttgtctgtgatctgtattgtctatgatctgtatctttagtgttgtttttcaggaaagacatatgtaaataaactttcattttacagaagggactgagggccagtcagttttcactgtactcgtgagaacaatcacagggttttccttaaagtaacaatagtcacttttacaaaagaagctctgattttaacatatgtttgtgtgtgtcatacttacttaattttctccaggtattcctagtacttctgagaatatctgacttatggagtggtttatttaccacagagttaaagtaatacctttaatagacattacataatacattaaatgaatactttctatatgaggtggaactcccccaccctaacctcatgtcaccacatttctgattttgtgagtgtatgtgagctagtttatgatgggaaagtatgctacctgggttttctgatgtcgtccgtgtgatttcccaaggtatgcaagtcaatgtcctcccaagatccttgaagtatggttccatggctgctattgctgtgtgtggatttgccctgactatgtacaaaccactgccttatgggatccctaaactctaatttcaagggaagatttgagagacagattatttcccttccctggtggccatcatctctcccctcctctctaccattccagccttctaaagtaaggcagaacataccatctggatgcctttttgctcctgagtgtaaagacttcattccttctgtagcctccccagcatgcgtctgaagttttggtttgcttgttgtttgtctgtgatagtattttctgatagaagctaaaatcctggttgatgtcacagaaaattattggtttattataccgttagtaatcattttagtttctcaaaaaatcatttgtttaatttctatgttaaactctgacactttcttagctcaagttaaggcaatctgcattcattacagtcattcatttatttgaatggttgcaaccactttgaagtttccataaatttgtaagaatttttcaatggagacatagtgaaactcaggtgagattttcctcatgataatggttataatcaaaacatatggtatttaaaaataagaaataatgatattttataaaatattcataatcataaccctctttttttttaaatggctgattggtttcaaaaattacctactctcttcagctcagcaactacacttgctcagctgggagttacgagactatacagttgtttgtggctggcactcctttctgatcagctgatctgtgtagctggatggccatggagtgtcacttgttaaatatttttaatatccacccctgagtggacataaatcaggccttttcaaactgaatacttgtaaagtctagcttttctttggtagttataacttaaccactgtaaggtatgttgagctgcatatgttcttcacctcagtgccttttagcccacctctctaagggcttagctgtctctgctgtgcaaccagtactacatagaaaggtaacacaccatcaaggaagtagcagactagatagaagacagaaacatgaacacatatgtagttataaagagtgatgcatgtcggctgggtgcggtggctcatgcctgtaatactagcactttgggaggccaaggcgggtggatcacaaggtcaggagttcaagaccagcctggccaacatggtgaatccccatctctactaaaaatataaaaattccccgggcgcagtggcaggtgcctgtattcccagctgctccagaggctgaggcagcagaattgcttgaacccggtgggtggaggttgcagtgagctaagatcgcgccactgcactccagcctgggtgacagagcgagactccgtctcaacaacaacaacaaaaaaggagtgatgcatctcacacaaaatagcatcagacatttgctagggagtggggatatgagggtatggtaagtttgcataaacttactgggctaggcccagtgcggtggctcacgcctgtaatcccagcactttgggagcccgaggcgggcggatcacgaggtcaggagatcgagaccatcctggttaaccgggtaaaaccccgtctctactaaaaatacaaaaaattagccgggcgtggtggtgggcacctatagtcccagctactcaggaggctgaggcaggagaatggcgtgaacccgggaggcttgcagtgagcggagattgcgccactgcactccagcctgggcgacagagcgagactctgtctcaaaaaaaaaaaaaaaaagaaaaaagaaaacggaaactgtgacagtgatgtggagaattgaggtggagggagggaaacaaggccaagtttggaatgtagaagaccatttggtacgctgtgacaataatccacatgaaacagaatgagatccaaattaaggcagtgtcatggaaacaaatatggaagacattttccatcctgaatcaattgaacttcatggctgatggaatgggacggtgacaaggaaggagactaagatggctccccaggttctggctaatgtgattaggtagatgatggtattatactgtgataatgagaggaggaccaaatttgcctgggggttggcttggaggaagaaagagatttatcttcccccatgaagcctttcctgattgacccagccagaaagactgtcttcctcttgagggatctgaaagctctgagagattatatcatatccaaaataatacaacaaaaatctaatggcaaaattgaaaagtggtgtaagactttcagcctcttctttgtgctagaaactgtctcgttactaatgtgtcaaggacagtgggatatccagactcctgggtgtgaacaagtggctccattgtctgtattgaatttaaaaacaactaaaagttgatttcctttttttttttttgacacagattttcgctcttgttgcccaggctggagtgcaatggcacgatctcagctcaccgcaacctccgcctcctgggttcaagctattctcctgcctcagcctcctgagtagctgggattacaggcatgcgccaccatacccagctaattttgtattttttaatagagacagggtttctccatgttggttaggctggtctcaaactcccgacctctggtgatccgcccgccctggcctcccaaagtgctgggattacaggcatgagtcaccacgcccggccggtttccttttaattatcaccacatactagcaaacatgaacaatgtcagaggtgaaatatttacccttcaaaatatttttggtctaagttctaaatactatggttactgttgagttttatgatatatatgtaaacttcaaattagcacatttgtagtatatatcatttgacaaacattgcattctacttgcaagttaactcagagaacttcccagttatacagctggccttggacatataccattcagctacttgtgttcattttgatagcaaatttataaagtccaggatcactccagtttcctccaaggacactttgtgtcctcatctctgtggtactacatactccagcctttcaacattcaattttaaataaacaataataccacagagaatgctgagacaaagaagcagaacaggagctgtttcatttttgtcatttggtgcaaacttcttgaatttttatttgtgtttaaaatttaaaacagtgaaaaggatacaaactgtgatatataaaatcttcggcttggcaactttatttcatgcataaaatgttagattgattaatatttttacaattgaaatttttttaatgttgttttaaaactaactttagaaaataaaactttagtgttacaatttagtagttacctaaattgtatctttgcagaatttcagttttaatacaatccatttattagttattggacaactatttacataaactattatatcagactataactaaagaatcaaagttcatactgtttaggtggatataaaaatgattgaataaatacctgtgcatttttctttttttgtattttaatttttttaaaacattttttcatttgtatggttttatacatgaagttcagcacaagaaaatattcattgtctatatttcttttctggccattttattacttgttttatctcatgattatttctgaaaatatttttatgtatagagaaaggggttgctcaaatgatgtactctagacctaaaataaaatatcatcggtaccacctgatcgtggaatatatataccactagtggttttgataaaaattttaaacatgaaagaatttctaaacctatagtgacttaacaagggatatttcattatataagagcctgggggggagtagaagtttttattctttgtttgttggtttgttttttgagatggactctcgctctgtcacccaggctggagtgcagtggcgcgatctaggctcattggaagctccgcctcgcgggttcacgccattctcctgcctcagtctgccgagcagctgggactacaggctcccgccaccacgcccggctaattttttgttttgtatttttagtagagacggggtttcaccgtgttagccgggatggtctctatctcctgacctcgtgatccactcgcctcggcctcccaaagtgctgggaccacaggcgtgagccaccgtgcccggccagaagtttttattcttttactgcatgtatttattttaatcatttttagcattgaaaatttcctgtcatcagatatgaatgcttgagaaaaacagcagagataataagagcaggaataaaaataactgatggttccggctacttgggaggctgaggcaggagaatcgcttgaacccggggatggaggttgcagtgaaccgagatcgctccattgcactccagcctgggcaacaagagcaaaactccgtctcaaaaaatacataaataaaaaatgaaatcaaataactgataattggaagttgagtaacagccaaaagcaactgtgatagttattcctcttcgggaaatatttatttgataagacaaacttttgggggatagctttgtgtgtcctaagtatcataagatggatatgcataattcagaacaggcagaaaaggggtgttaacaagcttgtcagatggacaattagaattgtgctatttgtcggccaggccggtggctcactcctgtaatcccagcactttgtgaggcagaggcgggtggatcacctgaggtcaggagttcgagatcagcctggctaacatggcgaaaccccgtccctactaaaaatacaaaaattagccgggcgtggttgtgggtgcctgtaatcccagccaccggggaggctgaggcaggagaatcgcttgaacctgggaggcggaggctgcagtgagccgaaattgcatcactgtactccagcctgggcaacaagagcgagacttcatctcaaaaaaaataaattaattaaaaaaaatagaattgtgctatttgtctcagtgtgtcatttttacactacaaacatcagtgttagcctctgagagataggaggtattataataccttgtttgtgcacagagggagtactcttgatttctaatgcctgcttgcaagcctacattcatcatcggttcattcctccattcaagaaaaattcctgtgccagtcagtgtggttgtcaatgatcattatcctgctgataagaatatttaggaactgcaatgtttccataatcctattgtgaatcagtgatgccaccaacacaaaaagctagctcttttctccacccctaacccactttgcgcactgctccggagcatacagtcacaaaagacagaacttgaagtgatgtctaattgtgccactaacatcaagtgatagccctatggctaaatagaaaggtaatatattgtgataggaatagaaattgcaggctagaagtggtttcgtagtttcagtcacacattaaggaaggtgaagttgtgtgtgtttgtgtggtcaggggatggtgagttagaactttcctacttttacagttcaatcctttcatcttattttgaagaaactgaggaccagcaaaactgggggactatcaaattcgctcaatgtgttagcatttgaaacagacatgttcaaatgaatagtctcatttgtagctatttccgtgccctttataaatatccccccaaaattaggcattgtattttctcatggtggataagcaaagtttaaactcctgcctaatgcttattccatttgttctgaaacaaccagtggtctccatatcactaagtcagaaaaccatgatccagttgtgtatcaatgatctaaatctatcatgagattcctggtccctaagacttttccgttccatttcctcactcttaaaatacctcctctgtcccatgcactgctctgattgccaaagggctactcattcaccaaggttcagctcaagtatagcctttccatgaagctttgccccggctgaagttaaccttctgcagacccatgcaaagttgtttgtatctttttttttttttttgagacagagtcttactgtgttgcccaggctggagtgcagtggcatgatctcagctcactggaacctccagttcctgggttcaagcaattctcctgcctcagcctcttgagtagctgggattacaggcacgcaccaccacacctggctaatttttgtatttttagtaaagacggtgtttcaccatgttggtcaggctggtcttaaactcctgacctcaggtgatccacctccctcggcctcccaaagtgctgggattacaggcgtgagccaccatgcccggccttgtttgtacctctttacagtgttatataacactctcccaattgccattcatttttatttcccattagaaggcaagctccacaaatgcagacatcctatctgatttattcctaggcttcctaacaaccagcatgcaacgtccctcaaggcttgctttcagctcagtaaactgaaagaaataaagactggtatatagtaaattgattctagaaaagtgtctagaaggtaaattgattctggccaggtgtggtggctcaagcctgtaatcccagcactttgggaggccgagatgagctgatcacctcaggttgggagttcaagaccagcctgaccaacataaagaaatcccgtctttactaaaaatacaaaatcagctgggcgtggtggtgggcgcctgtaatcccagttacccgggaggctgaggcaggagaatcgcttaaacccgggaggcagaggttacggtgagccgagatcatgccattgcattccagcctgtgcaacaagagtgaaactcttgtctcaaaaaaaaaaaaaaaaaaaaaaaagaaaggtgccctctttgttagatactcctggggcttaccaattaaatggtaaactctttgagggtaaaagatctttgtctataaccatctcattgttttttataattctagcacagacttagaggctccataaaccattattgacttatccaagaaaatgaaaagggaagttaggaggctgagggagtctattaacttcagggagaggaacggacttctggaaacaagagtttcacttgacctttctgcctctggccttcttactttttttgtcctaagtctaaccacattcaggtacacttccttttggtaaaatattttaccctttctcttcatttttttgaaaacctcatccttataacttacctttcagtttggtttcattttagttctaaacttttggaagcaactgaattaagaagtcttaaagtgaacttgcttgaggtctcaaagcaattataaataaataaatattaagaggttctaaaagttgtctgcaggtcctttttctcactctgattcctggaaactcaatcaggtttctattattctgagcagagattcatgagatgtgagcaggaagggtttttaagtaggatgtgagtgaaaggtgtattaggtgtgaggaaatagataaaatgagaatatttatgctggcaagggtgtagaaataaggtgaaaccttgttctggatagacatgtatgagaaactcagggtcaaaatttgctccttggttcaacatctgacaagctgtgtgatcacaggcaaggcctttagctgtctttgtatttaaaagagagttttggctatcatctctgttacacttatgtcattctaatgtatgatactgtacatctattcagaagaatgcatgaaaatgagtgaaataaataaatgaaggagatgaactagacattgctaagagagacggtagttcaaaacatagaaagaaaggctaagaaagaactgtaagagtggagaaaaaaataatttaaaagaaaatacttttaggatcacgtgcttagccttaactttactggaaaataaaaaaatacaaatcaacaccaagtgcataactaaaaggaaatgagaaacaagccattggaaactggagtaaaggccattcttgtcatacagttgctaagaacttggtggaaatgtatctatgtcttaggactttacggaaagcagaaattaagagcaataattcaggatatctggtggaagaaatatctaagccgcaaagcatttaggctgctgtgtggctacttttaactgcatacagtaagaggcaggagggaaaaaaatgacttaaaaatggaatttataattaaaagagaagcagaatagaaagatttggaaaattcactgcctagccatataaaaagtgaaaaggcatgaatgggagaaaatactaagggtgtggcctagtgaccattgttaaagagattaatatggatagaagggagtgaagtactattcaagaagttgagaaaaaggccctgaaggcatttcaaagcctttgaggctgcccctcccatcataggctcagagctcagagggcaaattgatttcaggggaaactagaatgccctttacaggcttgctgcccagatctgcctcaggtttctgttctctgaattccagcacagtgctccttagctgctccagccatggctcaagtgagcccaggtgcagttcaacccaccactccataaggtgcaattggtaagccttggtggcacccacttgctaagtgtgcaggctagcagaatgcaagaggtgtggaacacaacttcctccatgtagatttcaaaggatgttgtggacagcctgagggcccaggaagagtccactcccatgtcagtgcctagtagagccatgggagtggactgccactgagaccccagaactgtggagctattagcctgaagcattagcctgggagagctgcaggtaggagtctccaacttgtgagtgctgaagcatcaaccaagcccagcaatgccattttatttctctgttgggttttggacttacttaggaactgttactttctcatttttgcctatttctcccttttggaatgggaatatctatcttatatctgtcctaccactatattttggaagtagataacttgttttgatttacatgatcatagttggagggaatttgcttcataatgaatcgtgccttgaatcttacccatatctggtttagataagactctgaatttagtgttttgaattgattctgcaataaattaaaacttttggggctattgagatggaatgaatgtattttgtatgtgaaaagaacatgagttttgggggaccaggggcagaatgctatggtttgaatgccccctccaaaattcatgttgaaattttattgctattgtaacagttttgtgaggtggaacctttaagagatcagaggttatgaatgtattaatgcccttattgtaggaatggattcgttatcacgggagtaggcacctgataaaaggataaattttggcccccatttttctctgtcttgtgtgctcccttccactttctgctttctgccatgagataatgcagcacaaaggcctttgctagatgctggcaccatgctcttggacttcccagcctacagagccatgagccaaataaaacttctgtgattcaaaaattatccaatctcaggtattctgttatactagcagaaaacagactaagacagtgtctcatgtgtccgtgtgtagagaccaccaaacaggctttgtgtgagcaacaaggctgtttatttcaccttgcaggcgggctgagtccaaaaagagagtcagcaaatgatggtgagattatcattagtacttataggttttgggataggcagtggagttaagagcaatgttttgggggcagggggtggatctcacaaaatacattctcaagggtggggagaattacaaagaaacttcttaagggtgggggagattacaaagtacattgatcagttagggtggggaagaaacaaatcacaatggtggaatgtcatcagttaaggctattttcacttcttttgtggatcttcagttgcttcaggccatctggatgtatacgtgcaggtcacagggtatatgatggcttagcttgggctcaaaggcctgacagacagaggattaaatgatttatttcattttttaaacatatttattatatgcctaatatgtatgagacattctgctagtaaggcttaattactagaaattggggggttgtttttgaaaattaccaaataatgcttgagaactattgaagtcacatatatatggtacttccagaagaacatatttgattttagttttgtttttatcttttagggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacattttgaaccagtgcttcctaatgacaatgggtcataccgctgttctgcaaattttcagtctaatctcattgaaagccactcaacaactctttatgtgacaggtgagttctcaacacctagaccatctgatatttttcttataatgtttccaggaagaggggggttcagtttctcaagtgattatgttagaaagccaactcctatagcacatctgaaatctgctacacctcacagattgttatgtgccagtgtgtacatatgtgtgtgtatgtgtgcgtttgaggtgagtgagatagaggagagtagagaaatagatagtaaaagttattgtttttgactttagggattataaaatttatttgataagtccaaaagtagaccactgaaatattgaaaaaattataaagtgaatacctatagttgcgaatagctctgtgattgcttgtccttctttgttgttttttttttctctttttcccatttttctcttctttacttttgttcattacaatttcttgaagttatgtttgtggtgcttaggcaattaaacacttcttaatagttcacagtttgtttagaggaaaaacagcaaacaactaactgacttcctagtgattttctgggaatattcagagcttcatctctcttccctgttccccgaaagaggcctttaatatgctttgacaactgaggaaggacagatagaagttaagcttggggaaaccaagctgaataaaacatgaaaaaatacatagggggggagtaggtaagagtaaaaaatacttggtttataaaaattttatagccaacatcatattcaatggtgaaaggcttagagctttccccctaagaacaggaacaagacatggatccttgcttttgccatttccatttaacattaaactgaaaattctagccagagcaaacaggcaagaacaagaaataaaagatatctaacttagaaaaaaagaagtaaaactttattcacagatggcatgaacttatgtgtagaaaaattcttaaaaatttgtttaaaactattaaagctaatacatgaatttagcaattccacatgatacaggatcaacacacaaaaatcagtgatatttctatacactagcaataaacaatccacaaagaaaattaaggaaacagttccatttacaatagcatcaaaatgaataaaatatttaagtacaaatttaaccaaagaggtataagagttgtacactgaacaaagaaagcatggctgaaagaaattcaagaatatgtaaataaatgcaaagacattctgtattcatggactgaaagatgtaatattgtaaagatagcaatattccccaaggtgatctacagattcaatgcagttccactaaaatcctaacagctttttgttgctattgcagaaataaaaaagctgatcctaaaattcacattgagttgcaacagacccagaattgccaaaacaatcttgaaaaagaacaaaactgaagctaagacttccctatttcaaaacttactacaaaatgacagttaaaaaaaaaaaaaaagaatagtattgtcatggatagacaaagagatcaatgtaaatagaattgagagtccagaataaactccatacatccgtagtcaattgatttttgataagggtaccaagattattcagtggggaaagaatagtctcaataaatggtgccaggataattggatattcatatgtaaaagaattaatttgaaccctcatctcactccatattttaagcaatcaaaataagtcagacatttaagtagaagagctaaaactataaaaactgcattatataaaacaataaaactctgatttcttaggagaaaacatagggataaatgtttctgatcttggatttagcagtgttttcttagctatgattacaaaagcataatcaacaataacaccaaaaatagataaattggacttcataaaaattaaacacttctgtgcatcaaaagatactaaaattcaacaacaaatagactggcaacctaattttaaaatgagcaaaggacttgaatagacatttcatcaaagaaaatatacaaatggccaataaacatatgaaaaaaatgctcaatgtcattagttactggagaaatgcaaatcaaagtcacagtgaaaacccacttcacacccatcgaatgactagaataaaaaaaaaaaacacagaaaataataagtgttagcaaggatgtgaagaaatagaaaccctatccattgctgaggagaatgtaaaatggtgcagtcactttagaaagtggtctaacagttcctcaaaatcaaaagataaaacctacttgtcacagtacccagtaattctattcctaggtaaatactcaaatgaaattaaaatatatgttcacacaaaaccttgttcctgaatgtttatcacagcactattcacaatagccaaaaggtagaaacaacctaaatgttcagctgatgaatggataaaggaaatgtagtttatccacacacggaatattattcagtcatgaaaaggaatgaagtactaatgtatgctacaacattgatgaacctcagaagcattacgctaagtaaaagaagaaaaaggttacatacaatgtgattctgattatatgaaatatccaaaataggcaaatccatagagacagaaagtagcttggtggttgccaggggctgaggaaataaagaatgtgacatgactactaaataggtagagggcttccttttggggtgataaatatgttctgaatctagatcgtagtcacgtttgcaaaacattgtgagtatcttacatgccatttaattgtacattttaaatgattaaattggtaacttttatgttatatgtattttaccacaataaaaatatatttggatcaaagaagagtgccctttaattataagaaataatgtggagtttcttttgttgctcataaattgacccttaaagttactgggaaggagaaatttcaaaagagggttattgcaatagcagcatggctgaactctggatgcaacctcgtacagtttagttcctttatggacatcattcacttgaatgcatacattttacaactgatctttttaaaattaatttgttactttatatgcttacttttgagtgtctttcaactcccttaaagtagcccagtgaaggaatccattgaaattcttttaaaatgctttaggttagtttaaaatttcttacagcagcaccatgaaaaaatgcatagcagtttagcagtagctacaaccctcaattatgaaatatagaagaaatcgatggcagagttagggactctgcttttgcaaatatagcgtgaagctcggtgctagttacttgtgaccatccatgcactggcttataaacctcttcaggatggaagctgtgtcttaaacatctttgctctgtatgatggatggcagggtacctggcacatggtaggggctcactaaatatttctttgtaaatgaattaaagaacatagtatatgcaaagcacaaaaattgtcttcatcaacctggagaaggctatattaaggatgtatggaatgaacactttctggaaagaattgcattattaattcacattaatgagacaaaatattgaatttttaacaaatactattttttaaacaggtaaaataaattacaaaaataaggaaaatctgcaaaatattaattctagaatgatatatactattgaataaataagtgctattaactaatttatataatatattaacataatgtataataaaattaaattttgaggcattgagtccaccttccttggaagagaagccttgtgtaattcagtctttctttatgggaactaatctacttctatacgagacatgaatttagccaaggtcagatgaaaggtcagaagttaataattaattgtgatacaaaagtctgttacacaaaagtagcattgcaatttctgctctatcccatatttgggtcattcatgatgactaaagataatctgtagtttgtaaagtgcataaaggtgcctgttctagggatcaagttggggctgagattaggatcaacaatctatctattttgtggaggaaagaacccaactttaggggaaagggaataacattccctcctaaatcctgtgccttggggggttttatggaacaaagtatgtgaagtatgaagtggtgaaagagaaagtctaagagctaaataggagacatgaagggccttgtcagtttctttttgaacatttctactctcttagtttcctactcacctatccttcctatcactcccttccttatcagtttgttaattaatgctcttgatcctcatggaaaatcccagagaattttctttggcttcctactcttgtctctccacaacattccactctgtgatgtgtttcctccaattgcttctataagcatctcgcaccatcattatcttccttctaaataattccaattaattctatgattggactctttgtctttagtatttccccattttggtcaatttcagccaaatacacttaaattacctcatacacttccttcataacaacactctcttgcatagcatccccagtggtcacaatattgggctcatctttgttaaccagcattcaaagtcttccacagtttgatcccaccacctttctagattgtttctggattccatatacagcctctcaattgcagcctgacggccttacttgccataaccacatctccatcattgccctgtgtatgctgctcttgccacttgtagagcacccattcatctgtctccacctatggaaattctacccctcctttcaatctcagctaattttccaagttcttaaggaagcttttcatgatcacctgaggggaagggatcactcctttttaccaatttttatgccatttaagtctgtgcctctcatttatcatttcctttcactgtagtaatgtgtggaaatgtcttttaggtcccatgaaagattataatgtcctggaaggctggaatttgtgtaatatttcttttttttttttcttttaacttccttcacaaaaggtaaattgtttaggaattaactttaatttaaactctgtgtggatttaaaactaatttaatctaggtgtgcatttttctttagtgaagtggtgaaaacaaaaataacagggagggtcaaagaaaaattccttttccttctgaacctgaaagtgctcagtgaactaagtataaggtgaggagaaaaatatattttggaaatatgtttaaggaccatgcttttcataaagaaattttggaggtctgataaaaaatattttattttttcctgtgaaatatatttccgaagtgattttggacattttcttgtttttataagtgactttcttttgctgtttatgttcaagttaaaagttcatgtaagaacaggactgtgacagagttggggcttggatgctcttgggaaagcactattctcccagaatgaagaaaagcaccttgcacaacaagccaaagtcctaggggaaaagttgacagagctggggaacagcccttgaaacatccattggcctgccacttcacccttcccaaacttcccttggtcagtttcagattaagaacttccccaaggctgggcgtggtggctcacatctgtaatcctagcactttgggaggccaagacgaacaaatcacttgaggtcaggagtttgagatcagcctggtcaacatggtgaaaccctatctctactaaaaatacaaaaaataaactgggcacggtgggaggcgcctgtaatcccaactactcaggaggctgaagcaggagaatcacttgaacccaggaggtggaggctgcagtgaaccgagattgcaccactgcactccagcctgggtgatagagcgagactccatctcaaaaaaaaaaaaaaaaaaaaagaagaagaaaaaaagaacttccccaaaatgtgatcattatctgtggcaggaaagtgggtgtggagtgagagggcaggaagtccttgtgggcttccaccctgatttggagcacctgctgaatgtgcctcttcttattccaggtgccagagatatcattgtgcagactatactgtgtccttatgcttaaggaatggggaagaggtgatcaaagcagacagacaaagattgcgttgtatttacagtctttcagtgagcttcaaaataagcccagatatttactttgtgtcaatgatcgtggggttgatgttccacaaattgtgcttactgatcttgagatagattgttggattctctggtagtgtgcaaacactggaatcctccccaaggctagctctggttttggacacgtgagagtacaccctcatcattttctcaatcaatttcagttatttaccttgtttctctatttcagaacaaactcaaaataagttagggggagttttgagtttgttctgaaatagagaaacagtttgttctgaattagttttatttgatcaaactaatcaagtaaaattaaggaaattaggtttttttggtggttaaagaaataacagaagttggatcttcttgatccagcagatctgtttgtattagggtatctgttgtagaaaccttagtccccattgctatccaagaccctcccccaggcagctgtttctggcactcctggcagtggtttggctgctcgctaacctaaacagcagctgcaacatcaatagacaacatttgttaccactctgaataaccaaaccactttttgtgcaacttcagttgcctctaatcatttttaccccaaacctaagcatctagccaaacaaaataacattataatataattaatagaattttttttttgtttgagatggagtcttactctgtcacccaggctgagtgcagtggtaccatctcggttcaccgaagtctccacctaccgagttcaagcgattctcctgtctcagcctcccatgtacctgggattacaggtgcataccacgcccagctaatttttgtatttttagtagagacggggtttcaccattttggccatgctggtctcgaactcctgatctcaagtgatccgcctacctcggcctcccaaagtgctgagattacaggtgtgagccaccaggccagaccttagaatatcttactccagtatttttcatactgtgttaactgtaacccaaaattaaaaaaaacaacaacaacaacaacaaccagatcttacatcacaacccataatgcacacaaatataaaaaagtttcataaggtcatacttaaccataagacagagtttctccattgacactttggtctggataatgttttgttgcactaagtgggggttgcatcctgtatagtgtagggtgtttagcagaatccccggcttctactcactggttgccagcctccctccccctaccttgttacagccaaaaatgtctccagacattgccacacatgttccctgcttgagaaccactgctctagtgtgtgtgatgcattctgatgatttctatcctcttctgtttcattttttaaaatgctatttgtgacatactaaattgtttcacaacctgctaatgagctgtgaacaactgcagacaaacagggcctcaatgcgtattaacattgatcaatagtaatgcgcattagctgtgtgccatgcagagcacttttaaggctatcaaaagtatttgatatttggagattctgataagttacgagacaaggaaaggacattgtgttgaagaaacttgaatttcctgttacaaacatgttggcttgagttcccattgccactcactagctatctgacttggagcaactcttgggacaaaataaagacaatggttttcctacttaagtgatgaatatgagagttagatactgtaaatagaaaggcttaatgaagtaccttctgacagttatcatgaagattgttctgtggaagattaactctatcagaataaagaatttctgcaaaagataaattatcgcagagccacgtctgctcagcaagaaagcaagaggtggctgagggcactgggattcttgaggaatgcctctgaaggggaaatggaggcattggcctgaaatctccttcactcaagttctgacaatgcagaggggtgccgctgatcccaatatatctcagatttcctaactctctttagcatttactaacattccagatgtaaaaagtgcctcagaacgaccctccaaggacgaaatggcaagcagaccctggctcctgtatcgtttacttcctttggggggattgcctctactcatcactacctgtttctgcctgttctgctgcctgagaaggcaccaaggtgggttctattttccctctgcccccagtaccacacatttggggccattcttatttctggggctaaaggatttttagtttcttcctgttgttttctttcccaatcctgtaaaccatggataatgatttcctagaagacaactcatatttgcgctaaaaagctaaataggttggttggggctcccttgagtcacgggagaggcatgctcaccacgcacagtattccagctagagttgtggcgagcatagcacattgctgagacttcatcattctctttgcatcaatcttaggtttgtgtgagaaagagctcttctaaaccttaacaggattggaagttgaaacaatctctcagatcaagatatctgctttattttgtattatcctcttttcacagccacaccacatcatgccaatcccacacacacccttatgtaactgaagaaccaatgtccccagagaaaattaatatgtctgtattttctattgccattataaacatatgcttgacctgaattcttacccaacaataatgcatatgaaaaatgtgggtttggctatgatgggaatggtgtgatattttgaaaataattcctttctacttttgcaagaactctctcaatgtcatgaccaaatatgttaagtaagagaggaaagcatagagaattctgatctagctttggcctgaactacttcagttttctctttcctttttcttctcctccatcctctcacattcctgttttcacaacaccagctacagtgtagctatagaaactgagctagatagagcaacacttattctgtgtgacacaggaataacctttgactgggcaaaagtgcttctggtattttggagtgagaacttctggagttcagaaccttctctggattctgaagaattctctcttaccccaattcttcatctgcaactccatggctctttctatggcctctctgtatctttcatcatctttcttgagactgctggaacctctctcagaacttcagaaaaggagtcagggataaatcttttgatttaccacatccaaagtgaactaggtagtaggagatcttggctacataggtgacaggacagcagcatttctggcattgagtatggaatgtccccagagcaaggacttccagtctcttccaagtgatatactagatccctccccttccttttagatatgccatggggctatgtggactgaaaagtgatgaaccagagagagagctggtcagtgtgaattatcacaaacaagtgtgtgctaggcaaagcaaattaacaagccaaaactaacaacactatccctggcattcaacaggataagcatgggtggcaaggtggtttacttctgctttctttactccttttgattacttctttttctttttgtcttccaggaaagcaaaatgaactctctgacacagcaggaagggaaattaacctggtaagcttgatgtagctgttgaaacaaatgcaatttgtgttatactgtgtttatttatttattcaatgaatttatataacaccatgtgccaggcattattctatgtactatatatatatatatatatatatatatatatatatatatatacatagacccatttttaaaaatgtgaattttgcattctgctctctatgcagcaaagactctttagggttaacaagtctcgtaataagtggttctttggaagttcatggaaggcagtctagatccaagacagaaaagtcagagactgaaccatacaaacttgactctgctcttgcctgttatgtggcttcaggctattcatttattttttatgtaaacaccttaaggtctttctggaagagagtagggagctgatgaaagaatgaacccacaaataacctcataaaatgattagatatcttcataaatagcaccagcaaaatagagacatgatctttggcttagttattacacagaggtccctggcaatgtgtatgggctcatcaaggaagggaccactcagactaaaggaagggaattttggagtcaatctttcctataaggtttggaatgtaaatgtaggcttttcttttgagttgaatgttgtggagatattagaactaaaaaagaatgcaagatgaggcaatatatttgtggaaaagcattctgaagctctctaattaaaactaaacagtcataaatgagatactgcaaaggaacttgatgtgtgtgtgtgtttcaataaggaggaatagtgataaagaagtagtaaccctcttaaaaattccacaaaagacaaaatcgatacagccaataattctatatataatattaaatggcattcaacattccccaccaagctgcttaattttaaaccagaccaaatacactcaacttgacaaacttctattaagttttcattagcatcagtaggcactgtgtagggtgctaaggctttgttccctcaaatagggaaattttcttaaatattattttctttctatagtaaataataataaaaatttcacttgattacaataaggccagggagctatgaaattatttaagataaaaatctaaataatttactgtgcaagtaaaacccaggttggttaagctgtggacattgttcttcctgggtaggctggataaattatgatttgaagcttaattcaaaagggtattttctgtatgtgcaattgtctgggaagtttgttttaaagcgtttttgctattaacaggaatttgaagatttttgccccatttcagttgtctagcatttcagaaaataatcaaaaggataccatattatacccttggggctaaatatttcttaacataaaactagtttgggaactgtggagaaatcaaagtacagaaaggaactggtataaacatgacaggaaaggaactggtacaaatgtaacaggtacatataaaagccaaagctctgatcttaatccaaaacggtcctttgagggtataaagtgcttgcctaataaaaaccactgaattgtacacttaaaagggtgaattttatggcatgtgaattacatctaaacatatactataaatacaaattttaaaatgctttgtatactgtaacctgccataggaatgtaaggtgggattgctgtttctggctttatcatctctatccaccacattgtggtgcattggccttgtggcacccagccactttgacggggtgccacagcaggggtgctgcagagcactatattttcttttgctccattcattttaacaaaatttttcatggaaatgagccatttcttgggatgagagacagggaacccaattgacaggcttaaacagattgaaaagtatcacaggatctttgttgatatattgaggactaaaggctatttttcagttcacttgacagtcttctttagtgtgccacctactgacctcaaccaggctcttttcagtggagttgggagtactttttatcttagccaagcagcctctgcctctttcagtcgctcagccttactgttatttttgggcagccaccacatcagagggtggcactgtatcaggaattcttacatagcttctcagggtaaagccagacatgcttgcatgatagagctctgccaaggaaatctgccatagacatcctactgcacacatcacaatgaggatgacaaaggaccagacaaagtatgttgactttcaaagacagtggacttgataccttaaaggagttaggccagatgtcaagaacggaaatcgatgggcaaaacttgaatttaaaaaactgaaatagcccctagaatgaacacatcttctttgtcaggtgaacctttgtataggtaggagcggctaataaataactgaagagtgagaaaacatcaggactaattttactttttgtttttacaaattcacctctttcttagaagctctaagatatttggctatatttgaaacggtaagaattttcttgccgggagtggtggctcacgtctataatcctcgcactttgggaggccgaggcgggcggatcacgaggtcaggagatcgagaccatcctggctaaaatggtgaaaccccgtctctactaaaaatacaaaaaaaaattagccgggcgaggtggcgggcgcctgtagtcccagctactcgggaggctgaggcaggagaatggcgtgaagccgggaggcggagcttgcggtgagccgagatcgcaccactgcactccagcctgggctataggcaagactccgtctcaaaaaaaaaaaaaaaaaagaagaattttcttttgataggaataacaactggaatactgttttggaactttttctaagctttatctttccaaaactgacatcaattttttaatttaaggtctcaaattataataatatatcttggctaactcataatatttattgtttctgccctcttagggggtatttgttctgctttatccttaatctttttattctaaactgcattaaatactattcatcatgttataaactgcctgaagttttcataggatattttttgctttttccatcaatttgggctatgctttttatcttgaagggggattaaaaaatgttctgtgacctcaaaagtgaccagtaataaagcacaaaataactatttaggggtgacatagtgattctcaagcctttcatcctttaataattgaaatttagctgaaagtgtagatgtcagcagagtatgtgaggaacagtagattatttctcacaatggacatgactccatttaagcttttcattcatagtttgctaatgaatatgcactaccatggccgtaagtgtcacttaaaaccatctttttttctattgtaggttgatgctcaccttaagagtgagcaaacagaagcaagcaccaggcaaaattcccaagtactgctatcagaaactggaatttatgataatgaccctgacctttgtttcaggatgcaggaagggtctgaagtttattctaatccatgcctggaagaaaacaaaccaggcattgtttatgcttccctgaaccattctgtcattggaccgaactcaagactggcaagaaatgtaaaagaagcaccaacagaatatgcatccatatgtgtgaggagttaagtctgtttctgactccaacagggaccattgaatgatcagcatgttgacatcattgtctgggctcaacaggatgtcaaataatatttctcaatttgagaatttttactttagaaatgttcatgttagtgcttgggtcttaagggtccataggataaatgattaaaatttctctcagaaacttatttgggagctttttatattatagccttgaataacaaaatctctccaaaactggttgacatcatgagtagcagaatagtagaacgtttaaacttagctacattttacccaatatacaaactcgatcttgcctttgaagctattggaaagacttgtagggaaaagaggtttgtgttacctgcatcagttcactacacactcttgaaaacaaaatgtcccaatttgactaaccaaccataaatacagtaatgattgtatatttcaagtcagtcttccaaaataagaaatttttgctgtgtcagtctaagaatggtgtttcttaaatgcaaaggagaaatcattttaggcttgatgtaagaaaatgaaaataataaatggtgcaataaaaatatagaatataccaattggatatagggtagatgttccacatacctggcaaacaaatgcttatatctactctgttagattgataagcaaatataggtattaatggagcagtcaacgtatagcacatttatgaggaaagtagagactcactgggtcacatagactaatggataggaatgtgacataatgctgctgaattaatatacttatgggcatctgaatagtttaaaagttagtcagaataggtatcactgggcaagtgaagatagcttaaactgcttcatgcttgacttgatagcaagttaaagtgcaattaatggaatggaggaaaacccagaatatttaattggtctgtaggggtcaatttgctttcattcaccacatctgcatcttgctgttcttcttactaaggaatcagggcaaatcatctgtagtgacatattttagtttgctaatcatttattttaaaatactgaggttgcagccacttaagagtatagcaaaagatggattcagatttttggactttccaaagtacttgagttaaactatttcaaaaatagcctataattttattcaacagtttgaggctattcgaattctcaggtgctgctactgaataatgtaatagtcttcatacaaagtggatagcaaaggttaaaatccatttcaacaaatatgtgagctgagctgctgcacaaaggaatgtgatgtgtgtgtgtgtgtgtgtgtgtgtgtgtgttaggtggggtgggtgacaacagaaatggtgcacgagaaactgatcaaattgacattatattttcagtttgcttatgaagctcaaaatactagagtaaatgggtcattaaagaaaataatatgtgaaattatggagtttagaatacaagtggggtatatatacaaaaagacaaaactgaggttttgtggtggagagattttcttaagtaacactggcattaagttttagctccttagatttgggggtgcaaatattcttttgagtcactgttattttgccaattacacctagaatttcaagcaaccaattcgagataggctgttttagccaggctgcatttgtggacaacttatgtaagaaagacatgttagaatagctgcttgtggtattcttaaaaatagaaacaggaaatatggggaggatacatttagctgtcctcttatcagatgaacacacgaaattgaacagttccttcatgattctctcaaacttaaaagcaaaatatttctgtcttatttaaaatatccttagtatgtcttatagtaaagataatgctgataatgatttcatctctaagatgtattaatatatttgtactgtttgccaaaatcacaaatcatttatgtttttattccttttcaaaatggtgtcagagacatacatgcattttcccaaatgactctacttcactattatttacatggcttatttcattagtttatagagggtttgagaaaaagaatatgtagataatttaatggtttttcacaaattttaagcttgtgattgtgctcaatgagaaggtaaagttattaaaacttatttgaaatcaa

SEQ ID NO: 67 - DNA, 6173 bp, Homo sapiens
cttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaaggtgagtgagacttttggagcatgaagatggaggaggtgtttctcctacctgggtttcatttgtttcagcagtcaaaggcagtgatttatagcaaagccagaagttaaaggtaaaactccaatctggcttggctggctctgtattccagggccagcagggagcagttgggcggcagcaaataaggcaaagagatagctcagaacagagcgccaggtatttagtaggggcttcatgaatgcatgtgagttggtttagtagagagacacaggcaatttcagacccttctatgagactggaagtgatttaagagggaaaggatagccatagtcctgaatacatttgagctgggtttcaggatgagctcacaagttcctttaaaaaaaattgacttaagcaaatcctgggaagagtttttttgctatacaattcaaggttttaaggtcctcggattcatatactttataaatgaattagccagcttgtttaaaatgtagggaaattgtgggaagaatgccttctttacttaattcaaggttttaaggttctcttaatcaattctactagctaattagccaattatttaaaaataaaagtttgaaattgccaaaaaaaaaagacaaggaaaaggaaagaaagaaagccaccagtctgtttggcatacaatacttaattgttgcctgacctacgtgtgggtttcagatgcagatcctcagttttcagctcttcagagactgacaccaggtttgttacacggcttaaaatgatgagtatatccattgaatctcaaccttatctctctctagaccttcttggttaagaaaccatgtagtttgtatgaagtaggtactcaaaagatatttgatgatttaatttttactggagaagaaatattcatatatgttttcttatttttacatgttttaaatatgtaaagattaaataaacactcttagaagtatttaaatttcctaaagtaaatttatctcaaccagtaacaggaccctcccaatactggaaagttgagtgtgaccgcatttagtggtgatgagtgtgagcttgcttggggagagggcaggacatttaggatttcttaagcttagagtcaatacaataaagattattgagtgctcacttgggtgggctataatcactgctcacaggagttcatgaaccacaagtaaaagagtgaggagatatgattagctcacaaataactttaatacagagcagaaagtaatgaactactgcaatggagttatcacagtgctaaggatgctcagagggcatctctgataggcagaggtgagggttagggaaggaagctgtagtctagctagctagagctgctggaatagacatgacaatggctgctgccaaactgttttctcttctgaggacagatgtcccgtgcaagtggcttggtggaagggactagtgtctctaatatagggtgatttataagcaggaaagtgtgtcctagaaattcagaccagagtgatagattggaattggatcatgggggactcattgaatgttatttattgtatttgtttttgcgatcagtgttagtaaagtgtcaaagggattgagcagatgagtgacatcatgcaacacaagttttgagtttcacttgtcagactgactggagaggggcctggttagttacaggaaggtaatttggcatgcagccactatttttgagttgatgcaagcctctctgtatggagagctggtctcctttatcctgtgggaaaagagaacaaaggagcatgggagtgttcaagggaaggagaaataaagggcagagaggcagcggtggtgtcaggggaagcccacaggagttaacagcagggttgcctcaacctagagaggaagcgacctggtgccctcggctctgtggcttccttcatctaacaacatcttccactctacaacaatgccagggaaggcggaggctggtacagtgcatcaagacacagctactcctgggtgacagaggttcagggccagctcactaagtaggcagaagtttttgacatatactttgagagataaagcaagattctgtacctcaaccttcagaatttcccctaccactcattatagttccggagctatatagctcctatcattctatcataaccttagaataccagagaacatatcatctcatctaattatctcttactatatgtgaaaaaaatgaaggacatgggggaagtgtgacttgccccaaatcacatatttcatggtagagccaggtcttctgtttgtcatatcagtgttcttcctgccacaaccatcttgaagaatctatttctcagtaagaaaatatctttatggagagtagctggaaaacagttgagagatggaggggaggctgggggtgtggagaggggaaggggtaagtgatagattcgttgaaggggggagaaaaggccgtggggatgaagctagaaggcagaagggcttgcctgggcttggccatgaaggagcatgagttcactgagttccctttggcttttccatgctagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattggtgagcaaagccatttcactgagttgacacctgttgcattgcagtcttctatgcacaaaaacagttttgttccttaatttcaggaggtttacttttaggactgtggacattctctttaagagttctgtaccacatggtagccttgcttattgtgggtggcaaccttaatagcattctgactgtaaaataaaatgatttggggaagttggggctctcgctctggagtgctaaccatcatgacgtttgatctgtacttttgatatgatatgatgctcctggggaagtagtcccaaatagccaaacctattggtgggctacccatgcaatttaggggtggacctcaaggcctggaagctctaatgtccttttttcaccaatgttggggagtagagccctagagtttaaaactgtctcagggaggctctgctttgttttctgttgcagatccagaaccgtgcccagattctgacttcctcctctggatccttgcagcagttagttcggggttgtttttttatagctttctcctcacagctgtttctttgagcaaaatggtgagtgtggtgctgatggtgcaccatgtctgatggggatacctttagtggtatcaactggccaaaagatgatgttgagtttagtgttcttgagatgagatgaggcaataaatgaagaggaaggacagtggtaaagaacgcactagaaccgtaggcattggcatttgaggtttcagaatgactaatattttagatgaatttgtttgacattgaatgttcatgtgcttctgagcagggtttcaatttgagtaaccgttgcaataacatggggcagctgttttgctctttgtcttcatgacaactgtacttaagctaacagccctgaaacatgagattaggctgggcagaatgctgctagagaggaccacttggatggtctttattctccttctccatgtccctctccatcacctggaagtcacctctgggtgccactctggtgccttccttgtcgaagctgtagctgctcacatgacacctatccctgttatccagtttgcttgactgggacgttttgccttccccttcagccaggaagtgaaagtcccagtttttatttatcacaggtgttggtattggtggtagaagaggtagaattatggaatcaggcctcctgtcaggatttctttttgacagtccctctcagacacctctgcctaaggccagctttgccattacaaactctcccttctccctctctcccttcttctcttcctcttccttcttctcgctctttctctctctctctttctccctctctgtctcttatacacatacacaaagatatactctattccaacatcctctacccaacctgacagagatgtcctttgctgtaggttcagcagtggggatgagaaatacagctctcaaacaggataactaaagcttattatcttatcaagcttgttcccttgcagacaagattgatcaattatcataggctttctgggtgttctttctgaagctttctcaaagtctctttctcctatcttccattcaaggcaaatgattgccatttaacatcaaaatcacagttatttatctaaaataaattttaatagctgaatcaagaaaatctcctgaggtttataattctgtatgctgtgaacattcatttttaaccagctagggacccaatatgtgttgagttctattatggttagaagtggcttccgtattcctcagtagtaattactgtttctttttgtgtttgacagctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgtttt

SEQ ID NO: 68 - DNA, 14982 bp, Homo sapiens
aatttctcactgcccctgtgataaactgtggtcactggctgtggcagcaactattataagatgctctgaaaactcttcagacactgaggggcaccagaggagcagactacaagaatggcacacgctatggaaaactcctggacaatcagtaaagagtaccatattgatgaagaagtgggctttgctctgccaaatccacaggtaagagaaggcagtaaaatgtgggaaaatgcattcttcttctcattccttacctggccaagttaacttctactgaacaactgtggttcagtaacttctagtaaacaaacacataaagctgtgtaaaaattagagagctgtaataactgcatctcacttaatttgtcttacattttctccctagaaatggagtcatctatgcatttcttacttacctaacatggatacggagagtggtgagaaaggaaactatagaaagtgtatcagctttacataagaattatatagtaaaatacaaacaatgaggttattacagttgtattttgagaaaaggtgttttgcaaaagccagagttttaaatgagccatgagtcaaacagaaatccctttctcttagggatataacttaaattatgcaaaacatgtgtttctaatttgatggggtttatgagattgcacatcaagcaccttccatgttatattatcattgcttgttatttactgagcgtaagattcaagtgagagtctgaactaccttttttcttgtttgcaagtcttacctataaagtacaaggtatgtggaaaaaaggtttgccttaaaaactacattttctagtctgtcttctaacgaatgctatgtaaaccaatttatcatcaatattttaattatcaaatacagcatttttctaagcaatttacaaattaaccctttccattctcatagccatcccaaaagttatgtatgttatttatttattattattattattattttgagatggagtctcgctctgtcacctgggctggagtgcagtggcacgatctcagctcactgcaacctctgcctcctaggttcaagcgattctcctgcctcagcctcccaagtagctgggattataggcacctgccaccacacccagctacttttttgtatttttagtagagacggggtttcaccatgttggccaggctggtctcgaactcctgacctcaggtgatccaccgatcttggcctcccaaagtgctaggattacaggcgtgagccactgcacccggccagaaacgtatgttattatcctcatgttcctaatgagaagtataaggcatgcagaatgtaattatcaaactatgtagctagcaagtgccagaggccagtatgagcctaagcagcctgtctccagagtctatgatcttaaaaccattattccacactgcctctcttaagaagggataataagacattgcttattttctttctttcaatcttcagtttaacaaggtacatgggattccaggagaagatttctatgaacatgttataataattctgtagacgagtgtatttttgtttgtagctcaaacagttacagtccacatactagagagcacctttaaacacagcaaatgtttagtcagagatttcaacctaactgtgcttagaaatgaaatcctgtaaacaatttggtgatactggcaaatttaaagcatctacctccttccaatctaattttcctcttcagattgttaattaaagaaaatgaaaagtatactttaattttattgccaaaagcactagtttgctttattcatgcaaaacaataatactcaaacttgctatttgcccgcagatctacaaaaatgctgggactggatgatttcaaggatgtacttatcaatggtacaataaaaccatctttttcagaaactactaaactttgtatcatgggttttgtttctcagatattcgattctccttaaaaatgcaacaactgtgataattatgaatacctgtagaacagattccaaggagtaaagcaaaaccccaaaagaaaacaaacgaaactcttccttagctacttaaaaaaaagattctcggctggggacgggtggctcacgcctgtaatcccagcactttgggagacggaggcgggtggatcatgaggtcaggagttcgagaccagcctggccaatgtggtgaaaccccgtctctactaaaaaaatacaaaaattcgcagggcatagtggcatacacctgtaatcctcgctactcaggaggctgaggcaggagaatcgcttgaacctgggagtcggaggttgcagtgagctgagatcacgccaccgcactccagcctgggtgacagagcgagactccatctcaggaaataataataataatagtaattctgacaaggtgcagtggcttacacctgtaatcccagcactttgggaggctaaggtgggtggatcacttgaggtcaggagtttgagaccagcctggccaacatggtgaaacccctgactctactaaaaatgcaaaaaaaaattacccagcatgttggtgtgcccgtagtcccagctacttgagaggctaagacaggagaattgtttgaacctgggaggcggaggttacagtgaactgagattgcgccactgcactccagcctgggtgacagagtgaggccctgtctgaaaacaataacaataataacaattctgctagctgagatgctgcagaagctagattcactgtcccggaaacatgaaaaaaaattattggttacttttatttcttcactgaagatctttcctagaaattatgaaccaaaaaatgtctgttttatctctcataatctatctgcttcttagtccaaaggaaaataatatgttttctgattccatatagatagatacaaggcacaatctctaatctagcagaatttgaatgatcctcagtatgattcatttttaatttatattataccatttagggatcctctgaaccagagcatattactgattaaattttatacttgttgaaagtgctgtcaaataaaatgatcatcattgtgcagaacaaaaaagtattctgttatttggagaaaatcacaacaaccaaaaaaataagatgtactagatggtgaaacatagaataaaaacaacaaaaatacatttattacatttcttttgaaagttggaaacttcacaataaactcgatatacaaaaatcgttatgtaaactgtataagcctgggtttccttatttatgatacagagataacttcttgggccattacaataattaaatatgtatcttttatatatatgaaattatcgagcagagtgcctagtccactattgacatttaaaacatctcattttccttccattcaaagaacttaaaatctagccaagataaaccaaagtaggccaggcgcagtggctcatgcctgtaatcccagcactttgggaggccgaggcaggcagatcacctgaggttaggaggtcgagaccaacttggccaacatggcaaaaccccatctctactaaaaatacaaaaattagccaggcatggtggctcatgcctgtaatcccagctacttgggaggctgaggcaggagaattgcttgaacccaggagacagaagttgtagtgagccaagattgcgccactgcactccagcctgggcaacagagtgagactccaattcaaaaaagaaaagaaaagaaaaaccaaagcagcagataataattgtttaacaatttgaaaaggcataatccatagaatttatagtggaggagattggtttcaaatagagtagtcaggaggattttagtgaaacctttgaggtgaactttgaaaagctgcaaatggcagtgtttgaagagagaggaagaggtggaacacagagagggtcttcagccctgcgtgtgcagatgacaagacagaggctggtgtttccagacaggtaagccatatgccagggcaacattgcacagaatggatgtgaaggcaaggcatactatcagtgggaagccaaatctacaataactgctactactaaataaagatcttttttttttttcaaggaaaatctacctgatttttataatgactggatgttcattgctaaacatctgcctgatctcatagagtctggccagcttcgagaaagagttgagaaggtttgacatatgtattacatttgtcttcttgtatagcttcttaacattgttaacttggttttgaagcataaaacattactgagattgatttgagtcaattgctccatttgttttcagttaaacatgctcagcattgatcatctcacagaccacaagtcacagcgccttgcacgtctagttctgggatgcatcaccatggcatatgtgtggggcaaaggtcatggagatgtccgtaaggtttggagattttctcagatttcttatgctatgtgacagattttcatctaatttacatttaactttccaaaaattttctaaaagcattataactgcatcatgcaaagtttagataacacgacaaaatgataaagaaaatatgccctggcttgacatgtccactgttatcattattatatttttagtcttttacttcatttttcatcctgtattttatctggcaaccctaattacataaaactaatacagactgcaatatctaacctttaaaacacacatgggcctcccagcactttgagaggccaaggccggaggatcacctgaggtcaggagttcaagaccaacttggctaacatagtgaaaccccatctctactaaaaatacaaaaaatagccaggcatggtggcaggtgcctataatcccagctactcgggaggctgaggtgggagaatcacttgaacctgggaggcagaggttgcagtgagccgagatcctgccactgcgctccagcctgggggacaggagcaagactccatctcaaaaaaaaaaaaaaaaaaaaaaacaacaacaacaacaacaaaaaacctaactactgtattttaatcaggtcttgccaagaaatattgctgttccttactgccaactctccaagaaactggaactgcctcctattttggtttatgcagactgtgtcttggcaaactggaagaaaaaggatcctaataagtatgtaaacagtgataacaacaggaatttttggagtgtgtgccgattaaataaaacaggggttgttcattggcttaattttgggcagcgcagctttcctctcagctgggtatggttcctctcagttcctcggctgggtacggtttcttggactgctgtgtctaccactacaaatgtacacatatgtgacaggtgtatagttaacacagtaaaatgcacaaatcttaagtgttcagcttgaatttaactattatatacatacatacacccaccattctcagtaagatacagaattttttatcacctcagaaaatttctttgtgcctctttcaattccctttcctgccacagacaaatatatttttatttgccttatcaaaaattagatgatttttgttattgggtttcatatcaatgaaaccacagagtatagactcttgtgtctggcttcttttgatgagcatgtctttgagattctattaatttaattttttagcagccaattgtggttaagagtcaacacatctttaattacaggcagcaatgactggtttctcagagcagtctgctcaggatataggtgatttttacccatttaggcataagatctgctacaataaaggaaagggagaaccaaagcccacgtctctgggtgtgtgcctgtagaaaaatattctgcaaatgggaatatcataaaatgaaaggattcaatctagaaagtttcttcttattaaaaattagtttttttaaaaaaaaattcaccgggaatggtggcgtatgtctgtggtcccagctacacagggagttaaggcaggaggatcacttcagcccaagaagttgaggctgcagtgagccatgttcgtgccactgcacaccagcctgggtgacagaatgagaccctgtctcaaaaaaataaaaataaaacaactagttttgactgtccatgtgtgttccttgcatatttaattatttcattcatttgtaagttattaagttaaatgtaatgcctactgaagaaacattttaataagctttttctttttacctatgtcttacctctgatagtagcattcaatcaaatagcaacaactcatcattatttgatgttaaattggttttctttctctcttccaattggtccattgcttcatggctgctttcataaggcccctgacttatgagtaagtatctgattcttgtttgattctaagaattatttgttacttatagttgaatgtaggtttatcaatagactccaaatgcatttttaaatgattaattgaattcagccaaaaaataatttaagtgactatttagagaacaaataatctcagtctttaattgtatctatgattgtgttacaactatgtctatctgatattatagctatagatatatacaagaatactactcaaatacatctgtaggaaattaatatgcaaacatacaaaatgcacatacatctgtgtatctatgatttaataactcccatgtccataactagttaccggtgtcaataagtaaccatataccaacttgttctttttgacccaatccttactacttttgacctataatatatactaaacataggctaagagatggaaaacctgggctgggtgcatggctcacgcctgtaatccctgcactttgggatgccgaggcaggtggatcacctgaggtcaggagttcaagaccagcctgggcaacatggtgaaacctcgtctctactaaaaatacaaaaaattagccgggcctggtggcgggcgcctgtaatctcagctactcaggaggctgaggcaggagaatcaattgaacccaggaggtggaggttgcagtgagcggaaatcacgccactgcattccagcctgggtgacagaacaagactccatctcaaaaaaaaaaaaaagatggaaaaactaaggtaaatatcatcagtataaacccaccttggtgaagctagactaatgaagaggaaaggcagtatatgaaaattatgtaaattgcgatatgataaagataaggcataagaagttaaagtattgggatccctaaccaaataaaaggagtgatgggggaacccttgaagcaagttatttgaggaattagctagaggaaaaaggtaagagtattcatagcggaagaaacagcaaaagtgagaccttgaagtgacaaacatcttggtgcgttatcaaagctgaaggatggctaatgtcactgataataagtgataaaaataacagtgtgagaaaaagattaatttttttttttaaagatcgctgggaaaagtgggtgaatcacctgaggtcaggcattcgagaccagcctggccaacatagtgaaaaccctcctcttctgaaaatgcaaaaattagcggggcatggtggcacatgcctgtaatctcagctactcgggagactgaagcaggagaatagcttgaacccaggaggcagatgtggcagtgagacgagattgtgccattgcactccagcctgggcgacagagtaagaccccatctcaaaaaattaaaataaaaataaataaagattatgtaggattttattagctatgataaggagttaaaacagtatcttaagggagaaactggaaggtttttaaaaacgaggatgacatcagcagtcagtctcactttacagatgagaacaccaaggcagacggtgtcatatcttgctcaaggtcacacagcaagtaagttgcagagatggtctggcttcagataccatgaatttaaccaccacaaaactcatagatatacagatagtaagactatgtttgcaccaacgcccaaacttcaattaaaaagaaaaacagggtctaatcagttatttgaatttcgcagtcaattcctttgtaaagcatataaaccactgagaaattgaattaggctcacaaattaaaatgtgaatatgaatataattatttaaacaaaagactacctcttaaaactctacctcgcagatatcctgtgagaagttgacgggataatagaaacagaactagtttgggaatttctaattctgagtgttttttgttgttgttgttttgttttgtttatttgttttctgagacgagtctcgctcttgtcgcccaggctggagtgcaatggagtgatcttggctcactgcaacctccgcctcctgtgttcaagtgattctcctgcctcagcctcccgagtagctgggattacaggcgcccatcaccatgcccacctaatttttgtattcttagtagagacggggtttcaccacattggccaggctggtctcaaactcctgacctcaggtgatccacccgccttggcctcctaaagtgccggaattacagatacagatgtgaactaccatgcccggccctagttctgagttctaatatgaaactttaggtctcagtttaacctacttactattaattatatgatcttggacaatgggcctaaaaaaggagtcttaatattcccaactacataatggagatagtaaggcctgccacacctctctcataaaattatgttgaaactaaaatagcataaataaaaatgtcaaaaaatatcccataatttttgctaaacttcttgccttccttatccaatttcctcaggaacatggacgttttgttctcatttcgtgatggagactgcagtaaaggattcttcctggtctctctattggtggaaatagcagctgcttctgcaatcaaagtacgtctatcctcacttcaaaatttatatgtcaatttacgtaagcagagcaatcacttcggagcctaaactatactaagcatgagttaactttatccttaacaagtacaacatgggatcatttaattgggggtaaaggatcaattatttatttttgtgtattacctaaaatataaaatctcagagccatatacttaaaatccaacttgaaacctctgtaggagataaaaattttcaataaaatctggctttggaactatgatacagtgtcataaattcaatagttttgattatcaaaaatagaaatgaaacatatacaactatataaatatctttaaattaaatgctatgtgaataaaaacaaatccaagcttctataaatgtaaggaaattagtcaaatagagtgtccagcccaggaaagaaatgtaaaaatcccaaatttaatttatggattaagacgggggaatttggcagggcacagtggctcacacctgtaatcccagcactttgggaggctgaagtgggcggatcacttgaagtcaggagttcgagaccagcctggccaacatggcgaaaccccgtctctactaaaaatataaaaattagccgggcatggtggtgggcacctgtagtcccagctactcaggaggctgaggcaggagaatggcgtgaacccgggaggcagagcttgcagtgagctgagatcgcgccactgcaccccagcctggacaactgagcgagactccgtctcaaaaaaaaaaaaaaaaaagaaagaaagaaaaccttaaatgtttgtgttttgtttgtttgttttaggtaattcctactgtattcaaggcaatgcaaatgcaagaacgggacactttgctaaaggcgctgttggaaatagcttcttgcttggagaaagcccttcaagtgtttcaccaaatccacggcaagtgttgtgtgcagtgcaatagtctaggctgacaagtcaaatgttccaggtgtagaatagttgaaaaaagggaagcaaaaagcaactatcacttagtatgttttcactttaggtattttatcttactaaaccattccactttctatgtggtaggtttcattatctccattttataagtaaagtcatctaaattcagaaagacagggtaaatgacttcagattccacaggcggtgaagccagagttccaagctgggtctatttaacactaaggaacttccttgcctcccgctaaaaaccttagagaaactttccacatgggagggtggttttaagtcccgaaaaaaaaaaaatagcttctgcttgataagaactccttcctaattctgtttttttacaaattaagaaacaatacagaaaagtcattgaggtcaaaagttgttgcaaaattaacagctaaaaaactacccacaaaaaaacacacaaaaaagtgcataagcagtaatttgcaataggaaatctgccctactgaacagactcaacaaatacttgattgtttctctctgggttttgagttattgctgtttagtccttggcaagaagctagattttcaaatcaagtagggtaggagactgagtgcggtggctcatatgtgtagtttccagctacttgggaggctgaggtgggaagattgcttgagcccaggagttggggctgcagtgagctatgatcaatacattccagcctgagtgatgaagtgagaccctgtctccaaacaatttttaaaaattttaaaaatagagagggaaatctagtttctagggttttgttttggtttgttttgatttgtttttttttgtctttggtttgtttctttatgtaaacagtttacttgttacgtcagtaagcacgtaaagtaaagtagtgctaaataaatagatacagtttaatgggcttcctggaagagggtaggaaagtgaatgcttatctgcaggggctttgtttagcatagactgacctaatgccttttcctgcagcctgtgccaaaatccattatcagttgtacacaacaccttgatttccctgtatacctctgatgctgcttaattaaacatattccatctttttacagatcatgtgaacccaaaagcatttttcagtgttcttcgcatatatttgtctgggtatgtagtcttatgtttgaatttgtttgctctcacttaacaaagaacaccaccaaattctcttggttggtccctaatatccattgggtttggctaacaatttacatccaaaaattcacatggtagaaaaatactagactgttctgttatcacttggccaggaatgtactggagtgggggacaggaaagctagttattttaaaaagagtggtctgtgctagtacaaaggtaagattccattcctagaatagttatgccaaatctgctcaggattatattatttactattctcatgcttgaaaatgagcaggggcaagggggtatgaaaaaaggatcatgaaatccatctcttgtcaccttctgttcagcactagtgcaagatttggtacctgaaaattagcaattaacctaaagaatgatttttctttttttctttctttcctctgatagctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggtgagtggaaaataacaagaaataattatctcttatgtgaatacaatagtatttggatatctacaaagcaccttcccatcagcatcttatctgagcttatctgatagttttagcagaatcaggcaagtagggatttggttgccatgatcccattttaaaaatgaagatgcagaaacttaatgagagtcagtgacaggttccttgtgaaccagctagaaagtggcagagctggccaggtgcggtgactcaagcctgtaatcctagcacttcgggagacctaggcaggtggatcacctgaggtcaggagtttgagaccagcctgaccaacatggtgaaacccggtctctactaaaaatacaaaaactagctgagtgtggtggtgggtgcctctaatcccagctactcgggagactgaggcaggagaatcgcctgaaccccacaggcagaggttgcagtgagccaagatcgtgctactgtactccagcctgggcaaaagagcaaaactccatctcaaaataaaaataaaaaataaaaagccaggtgcagtcgctcacgcctgtaatcctagcactttgggaggccgaggcgggcggatcacaagatcaggagatcgagaccatcctggctaacacggtgaaaccctgtctctactaaaaatacaaaaaagtagctgggcatggtggcgggtgcctgtagtcccagctactcgggagactgaggcaggagaatggcgtgaacccaggaggcggagcttgcagtgaaccgatatggcgccactgcactccagcctaggcaagagtgcgagactccatctcaaaaaaaattaataaataaaaacaaaaagaaaaataaaataaaataaattggcagagctttcctcacacccaagttccatcttgaaatctgaacatgtctataaagactggttgactccggtgaagccaatatcacatgctctgaaaatgtatgatcagactcagaaagagacactcacctgcaaatgagacagggctgttagtggggagataaagacctcagtgacaagcagagtctgggccctgctcttgttcagctgtcccgtggccccagccacccagagcaatgcctgcaccaaagtttaaaggtgagccacattcattgtatgccttctaggggcttagctggaggggaggaataagctccaagaagaacttctttttaattttctctgttttgttaaacttctgtttaacagtcaaaggggaaagcatcgggctgggtaaaaacatgagtttttcttaatttgagcactcatttttaaaatttttttatcatatttaacttttttattttagattcaggggatacatgtgcaggcttattacacaggtataatgggtgatgctgatgtttgggcttctaatgatcccctcacccaagtatagaacatagtgcccaataggtagtttttcaacctttgctttccttcctccctccctcccctatttgaaatcctcactgtctattgttcctatctttgtgtccatgtgtactcaatatttaactcccacttatcggtgagaacatgtggtatttggttttctgtttctgcattatttcacttaggctaacttaagctaatggcctccagctgcatccatgttgctgtgaagcgcttgatttcattctttttcatggctgtgtagtattccatggtgtacatgtaccacattttctttgtcccatctaccattgatgggcacctgggttcattccatgtctttgctgttgttgaacactcatttaaacacaatctcttaaactctcttaagaatcagtcataatctgtcaaatgcagattatatatgccccttgtctataccatcagcttcttacagtagaaaagagagaaagaaagtgcaaacaaaggccaggcgcggtggctcatgcctgtaatcccagcactttgggaggctgaggcaggtggatcatctgaggtcaggagttcgagaccagcctgaccaacatggagaaaccctgtctctactaaaaatacaaaattagccgggcatggtggcgcatgcctgaaatcccagctactccggaggctgaggcaggagaattgcttgagcccgggaggcacaggttgcggcgagccgagatcgtgccactgcactccagcctggccgacagagcgagactctgtctcaaaaaaaaaaaaaaaaagcgcaaacaaaaatacttattgtgagaaaatgagtttagctcattcagttttcaaaattaataatattttacaataattacgattgctagtagcaagactaatagccaaacattagccttcaaatagaatgaccttgacctcagtgaatgctatattggtgatctcctgcccactctgacctcactctgcctttctctcctggattggggaatgctgtgacctccgtatttcctctttctctttttcctataggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaatgtaacccaacaagagcacattttatcatagcagagacatctgtatgcattcctgtcattacccattgtaacagagccacaaactaatactatgcaatgttttaccaataatgcaatacaaaagacctcaaaatacctgtgcatttcttgtaggaaaacaacaaaaggtaattatgtgtaattatactagaagttttgtaatctgtatcttatcattggaataaaatgacattcaataaataaaaatgcataagatatattctgtcggctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcggtggcgggcacctgtagtcccagctactcgggaggctgaggcaggagaatggcgtgaacctgggaggcggagcttgcagtgagccaagattgtgccactgcaatccggcctgggctaaagagcgggactccgtctcaaaaaaaaaaaaaaaaagatatattctgtcataataaataaaaatgcataagatataa

SEQ ID NO: 69 - DNA, 14341 bp, Homo sapiens
ataacatcctgtgcgctgctgagctgagctggggcgcagccgcctgtctgcaccggcagcaccatgtcgctcatggtcgtcagcatggcgtgtgttggtgagtcctggaagggaatcgagggagggagtgcggggatggagatctggacctggaggtaaagatatgggcctagaggtggagttatgggcctagaggtggagttatgggcctgaagtggagatctgggcctggagtggagatctgggcctggagtggagataggggcctggggtggagatatgtgcctggagtggagatctgggcctggagtggagatatgggcctggggtggagatatgtgcctggggtggagagatgggcctggaggggagatatgggcctggaggggagatgtgggcctagaggtggagtgatgggcctagaagtggagcgatgggcctggagtggagatatgggcctggaggtggagttatgggcctgcagtagagatatgggcctgaagtggagatatgggcctggagtggagatatgggcctagaggtggagttatgggcccggaggtggagttaagggcatgaagtggagatctgggcctggagtggagatatgatcctggagtggagatatgggcctggggtggagatacgggcctggagcagacatacaagcctggaaaggagatatgggcctggagaggagatagaagcctggagtggaaatatgggcctggagtggagatatgagcctggagtggatatatgagcctggagttgagataggagcctggagtggagatatgggcctggagtggacttaccagcctggagaggagatatgggcctggagtggagatacggacctggagtggagatctgggcctgttgtgtagatctaggcctggaggtagagatctgggcctggaggctcagtctctgcacagccgagatccttgttcctgggggcaggtaggcagcgagggtgagtttaccttcagcccagcaagggcctggctgccaagacgcacagcccagtgggggcagcagggtgccctggtttgcctgcagagggatggtccatcatgatctttctttctagggttgttcttggtccagagggccggtccacacatgggtgagtccttccccaaaccttagggtgtcatctccccacataagaggattttcctgaaatgggagggaagtcctgtcggggagtctctcatacactaggaagaggggaccctcggatgctcggcccacatttctgaccttgccttccccggcctttcattccctttcctgagtcaagctctgtgaagactggggtgagactagggtgctccaagatgggtgtgcagggaggaagtggtgtcagcagcagagaaagagagggaagcagtgctaggaacagcaggtcctctgaggacaaaggtgtaactcacaccctccagcgtttccgtgatggtaggggctgcagtgtggctgcggtctttctaccagaaaaggtgaggaaaccacagccatggccctgacattccaaatcctctgatgggggctcagttcatcaattggctgatattccattcacataggacttgccctccatgccgtgtctactttgtgttgttttatatgagtaattttgcagtattaaaatctagtaagagttgcttctccagcaacttgctcaaagttctcagctgacacttgttgtagggagacgccaagtctatgcaggatgggtccttcctgtagccctgggcacccaggtgtggtaggagccttagaaagtggaaatggggagaatcttctgggcactgggagtgaggggcggctccacatcctcctctctaaggcagtgcctccttctcccccaggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggtcagaggctttccgtctgggcttctcactgtcccacctcctgaatcccagagcttctggtgggggtgtccgtcagggtcccatcacccaggccctgactgtatttggggtcaagggagattgaatacaggggaaatgggtgctgtggtgggaagaatcactgtccccaatgatggctacattgtaatccctggagcctgtgactatttatgttacagggcaggggactgaaggggaaggtggagctcaggttgttgatgagttgaccttgagatggggagacagcctggactgtcccactgggctcagtgtaatcacaagggtccacatgagaggtggaggaagaggggagtggggattagagcagtgtagtgggagggagacgctatcagccactgcgggctttgaaggtggaggaagaccactagtcacagaatgcaggtggcctctaagggctggagaagtcaagagaactgattcgctgattctccagagggaacgcagccctgtagacaccttgatttcagcacagggagaactggatccaatttctgtctccagaagtggaaggggtcagtgtgttctctcccgctgccatgtttgtggtaattttctgcagcagcaacaggaaaccaacacaggaacccaggtcaaggacaagttaggaaaccaaacaaggatagccagatgtggtggtgggcacgagtaatccaacgactggggaggctgaggcaagagaatcacttgaactggggatttgttcaaaagagattgattcaggctgctaagagcctggacatgcagcctgtcctcttccacccccacatagacagcaggaaagagattagtgggaaacagatacaacagcccaagagatgaggctgtcttcacagtggcaagggagtcaggggctactggagacagagggacagagaagagggaggaagacagatggaggcacctgcaccaggggatatgggcacagaaaagacacggagatgcagagagggaggagagagacagacacggggaggggaaccctcactcattccaggtgccatggatgggatgataaagagagatgccttctaaactcacaacttctctttctaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtgagagtgtctagacattgttctcattgtcactgggacacagagtgaatgatccaggacttggaacccccaggtggtcatgaggaagataagtgtgggattcttatggaaagagagtgacttggtgaggtctgtaccaacagagacagagaaacaggagacataagtacagaacaggtgtcataacagaggacagacacaggggccatacagggaggtagaaaagagagaaagaggtaaaggagacactcagacagacagacatgtcccagagagaggtgtccttccatgctgactttgctcagagacctggcacaggttagaagtttcatttctgttttacctccacaaagtgttcctaccagaagaacccaaggacacccatatttctgacctgagttgggccctgtggcctcaggccttgtgccacctacagatgccgtgtttattctgacacctctgccttccatgcaatggagagtaatcatcccaggatatcatggcccctgaacaccaacccctgtatgctgtgtgaacttggggtccccagactggattctgaggctcatattccaaataatcccacatatgataggatcgctgagagacacagagaaaaatcagggacaccaaaaagcaaagacataaacacacacaaaatgagccagaagaaggagattaagagattcacagacacataaaaagaaagaaaagagggcagaatggagagaatgatggaaaggaggagagaaaagccccaaaatcagaaccctgagggagggacacaaagacagagaaagataaatatgtggggatggattgcagagattccaaatagaactagagagactgagaggcagagaaagacaaggagacggagagagagagatgatagatggatagatagacgtagatagatgataaataggtagatgatagataatggattggttatagatacatagatgatgactgatagatgatacatagagatgacgatgatgatgatagacacatagatatatacatagatgatacataaatagagacagagaggcagacagagaggtaatagagagagagatagatgatacatatatagataatagatgattgatggatagatagacagacagacaattgatagagagatagataagtgatacataaatatagatgatagataatttgtagatagacacaaaatagataaatagatagaaatgtgcagaaagttatgaacaagacagaaagtgagagactcaaaattaaagaaaaaggaagatcaagtcaaccaatccaaggagggtcagagagaataaaacaatccaaaaagggaaaacatacctcagggtggggaagtgaggtcatagacctagagagacagaaaaggtagaaggaggaaacagatatgaagagagatggggtggagggtgagagagagagagagagcattaggtcatagagcaggggagtgagttctcagctcaggtatgaggggagctatgacaaggaagaacctccctgaggaaactgcctcttctccttccaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggtgagaaaagcccatatctctctcatgtcctatgatcctaaatccttagctaaggagcttcctgctgatgatggagaaaagcatggacagatgcagagagaagacacagcaggtgtgagggcggagtcagggcgcaggatggcagacagggcacctccaaaccctccttcatggcctgcatggaggcctccgatcagggctccaggcacccaggcagatggagaaagcggtcaggacagacccagagaaggggagactgggcttagtttggggagatcagaggttccctcagcccctcaatcttatccatttcccagaagcccatcatggcctctcacccacacagagagatatcatcaccagcaacccctacacccttttcttttcattttcaaaaatatttattgaggttaaatgtaactatataatttaccacctttaccatttttaaaagtaaaatctagtggtcataaatacctttatatgctgggtgtggtggttcacggttgtaatctcggcgctttgagaggccaaggaaggtggatcatttaagatcaggaactcgagatcaccctggccaacatgtgggaaattcatctttactaaacagacaagaaaaattagccgagcatgctggcatgcacctgtagtcctagctacttgggaggctgaggcaggagaagcacttaaacccaggaggcagaggttgcactgagccgagatcatgccactgcactgcagcctgggagacagagagagactctgtttctaaataaataaatacatctatattcttttttttgttaccctccacccttcccttcctggcctctggtgtccaccattgtattctccaccttcatgagatccaccttttatctcctgcatgtgggtgagaaatgggaatctttgtaatgacctccagttccatccatgtggctgcaaatgacaggatgttattgtttctatggatgagtagtctccactgtgtgtgtgtaccacagttctctatccattcacccactgatgggcaggtaggttgactccacatcttggctactgtgaacagtgctggaacagtcatatgagtgcagatatcacttcgatacactgatgtcctttcctttggatataaacccagtagtgaaattgctggacactatgaaagttctctttttttttttttcttttttgagaaagagtttccctccttagtccaagctggagtctaagtggtgagatcttggctcattgcaacctgtgcctcctaggttcaaatgattgtcctgactcagcctccctagtagctgtgattacaggtgcacgccaccatgcctggctaatttttgtatttttttagcacagacgggatatcccaattttgggcaggctgctctcaaactcctgacctcaagtgaggtgcctgcctcggtttcccaaagtgctgaagttacaggcataagccactatgcccagcctccttttagttttttaaagaatttccatacttttctccataatagttgtactaatttacattcctaccaacagggtaccagggttctcctttctctaccatcttgccagcatttgttttgcctgtcttgcagtaaaagccattttactttactttattttatttatttatttatgttgagatggagtttcactcatagtctcccaggctggagtgcaagggtgtgatctcagctcactgcaacctccgcctcccgcgttcaactgattctcctgcctcagcctccaaagtagctgggattacaggcatgtgccaccacgcctagctaatttttgtatgtttagtagagagggagtttctccatgatggtcaggctggtctcccgacctcaggtgatccgcccacctccgcctcctgaagtgccggaattacaggcgtgagccaccggcctaaaaggcattttaatgggatgagatgaaaactcatcgcgattgtaatttacatttctctgatgatgagtgatgccgagtactttttcatatacgtgatcgccatttctatgttttgtttgtggagaaatgtctcctcatgtcttttgctcgttttttaattaaattgttttattgagttgtttgagcttcttatatttccagttattaatcccgtctcagatgaatagtttgcaaatatttgctcctattttgtcggttgtctcttcactttcttggtttatcttttgtggtgcagaagttgcttggtttgatgtaatcctaatggtctattttttgctttgattacttgtgttttgaaggttttaaacaaaatgtctttcgtcagacaaatgtcttccccattattttcttctacatgtttcataggttcaggccttagactcatgtttttaatccattttcatttgatttttgtgtatggtgacaggtatagatgcagttttattcctctgcatgtagatatccagttttccccacaccatttattgaaaagactgtcctttcctgattgtaagttctcggcacctttgtcaaagtccattaaatgggctgggtatggtggctcacacctgcaattccagcactttgggaggccgaggcgggtggatcacctgaagccaggagttcaagaccaggctggccaacagagtgaaacctcgtctctactaaaaatacaaaaattagctgagcatggtgaccagtgcctgtaataccactactcgggtgtttgaggcaagagaattgcttgaatccaggaagtggaggttgcattgagctgagattgcacctctgcactccagcctgcatgacagagcaagattctatcacacacacacacaaaaaaagccattggatgtaaatgcatggattatatctgtgttctccattctgtttcattttttatgtgcctttctttatgccaatgtcatgctgttttgcttactacagctctgtaacatatttctaagtcaggtagtgtgatgctcctgttttctctttataccttcaagtctcaagacagtgggcatcgcacacaaaaattatggagaagaggatcccaagactcccagggtccaacattagataacagagtgttggccatgaaccaacctcaaagatttccattgagtagaggacaagcaccctcatttcctcacatctctcctgtcccatgttctaggaaacccttcaagtagttggccttcacccacagaaccaagctccaaatctggtgagtaaaggacccctcttatctctgcttttggaaacctggggaggtggaagccttggatgcaagtgttggctcaaacctcccagctctgtgaatgagggcctgtcttccaccatctctgaactccagacactccaacagtgaaagggatctagggccaccaaagggctcagcgaagtctcttaacctttaatgtcctgcaggtgagacctcctacaagctagaagaatgattgccaatctgacatccttctcaggaaacatgcagtgttttttcttcctgcattcctaactggaggataaattcctggggacttgagagagggaagggaagggaacatctgatgagggcgaggtgttttagagaagttccacttgccaaggaatgaattactgttggtcatgaagcaaccctggctgactcagcagagcaagagccttgccgtaacagagaacagagctcatgcacgcacacttcgactcactgactcattcagccacggccccatgctcaggctgtgcagttggaatcctttcctattgttgccataacaaatttccacaagattcgtgggtgaaaacaaaacggttttttaattatcttacagtgctgtagctcaaagtaggaagtgcatcttactgggctaaaatcaaggtgacagcaaggctgccttccctctgaggattccaggcaagaatctgcttctcacttgtcccagcttctaaaggctcccagttccttggctcctggtccccttcctccttcctcaaagcccacaaagactggtcacatctcacatggcatcactcagacccttcttccttaccacacctctttctctgaatgctgctctcccttcttccttatcttttgaaaacttggggattctattgggttcaccaagatgaaaatccatcataatctcccggaaatcattcaggatacccttgttttaagttcagctgactagcaaccgtaattccatctgcaatcttcattccttctttccatgtaaaataagatattcacaagctatggaggccaggacagggacattttggggtgggacagcattctcctgccttccacgaacggtgaacaagatgcatttggcctctgctcttgggacactgatattgcagatggttaaatgggaggacagaaaatgaatgcacaagtggaccaataaatgaatgatccattgggaagcatctgtgcatgaaatctatttgtttgttcgttcatttatttattgagacagagtctccctctgtcttccaggctacagtgcagtgtcacgatcttggctcactgcaacctgcgtctcctggatccaagtgattctcctgcctcaccctctcgagtagctgggattacaggcaactgccaccatgcccggctaattctttttgtatattttttgtagagaggatgtttcaccatgttggccaagcttgtctgaaactcccaacctcaagtgatccgaccatctcagcaacccaaagtactgggattacaggcgtgagccactttgcccagccagaattcaaaataaataatagataatgctgagtgtataattttgggtgacagagaaggtctcactaatcagatatttgtgacattaatgaaaaacacggattgaacccctgaaagattggcggaaggattttccacacacagctgtcagccgtgaaggcagaaagctgaaaacaatctgatgtggaaggaagaggctctgcctgaaatgctgggaatgaggtggggagaatgacaagacgactgtggagagacggagagcacactgggtacacaggaaactaaggagcaacaaggagtgtgtgtttgacactcacagccattggattcacctcggggtagccaggaatccctacatgattaatagtgactgacatgaaaataagggaggcccaggtgcgtaactggaatctaggagacagtggaaaaggcaattgccgccccactggtgaaatgtggtgctgatttagaccctaagtggatgaagcagatggatataagctatgtttgggaggtagaatcatttgcagggagggcttgctgggtttgagtttcctagttgtttaatccttgctaaattaatttctttctgagatttattcctcctacacataaatcaatacctggcaaaggagtgacagatatatgaggggtggtggaaatgaagggacctattatagcatagtatacaagtctgtgaacggtggctcactcctgtaacccagcactgcaggaggctaaggccagtggattccaagaagtcaggagttcgagaccagcctggccaacatggagaaaccctatctctacatggtgaaaccctatctctcctaaaaatacaaaaattagccgagcatggtggtgcatccctgtaatcccagctcctgctctggaggatgaagcaggagaatgacttcaacccaggaggtggaggttgcagtgagtggagatcgcatcactgcactccagcctgggtgacacaaggagactccatctcaaaaaataaaaataagaaatgcataaatataataaaacacacacgaatgacaaaggcacctgaattcccatcatcatttttctatttctctataattacttctttgatcctttatcttatccattaggcaatcagcctaaaacctcttccgtatttggctttctgtgagcatgagatcatatagaaaatgtgaaagcccgctgaatcctccagcacaaatcctggaatagagaaagtgctctggtcatcacaaaaaaaacttgccccctcacccaaatcccccatctcacccctacttccaatcacctgtggaaatacagatagatcatggggaggtaaatgctaatactccttggagtgagtccagatcttggaatcagagatcagtgccagcactagctcctgctcccctttcctactaattcacaggaggacaggtggtattgaagcaatagatagtcgagggggtggtccttcccccagcctctgaggtagaacagcagcctaacatgtgtctcccgagatcacaaagagtagcacatttcacacgggcttcaacactattttctggctgtttgacataagagaattctacttcgctttttttatattgatttcacttttgtttccttttcttggagaatgcaagttgtttaactcaagaatgccgtggatgtagaaatcctaaagcacattcgctgtgtatcaatcccagtccagtcttcccagagaagactctaaacacctcctggactgcacctgggcctatgccaattcctatcactcaccgtcactccagggagacagaacacacagagaatacgttacataggcaggttcattactaacagataagcagcgagtgacaacagaagcctacatttcaatgtgagccagttccccaaggctcagaaaagctgctcgagacatgtggagtcaccccatttgcagtgtagctgggggaagccagaaagcagcccagcctgggttttgtaccctggagccacaggaagcactcagctaaagcactgcatgacgtcctcctccaggaagaacaggaagacagcccaggctgttctgggacaatcctcctgatctcaggactttgctgtcttagtccatttttgttgctctaaaggaacacttgagcctgggtaacttctaaagaagagattggtttgcctcaccgttctgcaggctgtactggaagcatggcaccagcatctatttcttatgatggcctcaggccgctcccactctggcagaagggaaggagggtctgtctgtgctgagaccacagagatcacacggcaagagagggagcaagggggagggggagcaatggagcttccaagctctttttaacaaccagctctccaggaactaatagagagggaacttgctaaccccgtctccttgggacagcattgatctgttcatgatggatccacctccatgacccaaacacctcccaagaggcccaacctcccacactgggggttaaatttcaatgtgaggtttgaaggggtcaaacatctcaactaaagtagttgtatcctcagcacgttccatggttactatgagagctataactgagaaagcaggaggaagctagatctcccgccatctgggtgcttgtccgaaagagatgctgtaagtggttacctgtcaatcaagaaatgcaagacaattcatatagagaaactgctatgattagcttcttactggtgtctcctcttcttccaggtaaccccagacacctgcacattctgattgggacctcagtggtcatcatcctcttcatcctcctcctcttctttctccttcatctctggtgctccaacaaaaaaagtaagtctcacggggcacaggccagagagctcagggccatgtggggaagcaggatgggagcacacagctgtgtgttcctcactggcaggatggtccctggcccaagacaggagccacagaggcaggactttctagagagagcaccagactccctgcccctgccttcagctcacagaccgttgcctgattctgaactgtatcctcatgtcccctgcagccactcacatccaggagaaggttccatgacaggcagaaagtgggagacagaatcaatgggatgggaactcagagctattcatgggatgggtccttgagctcagagagatagaatgtctgagtctgctgttggcaactgagggacctcaggcacctatggcctccccctgtttgttggtatctgcttatgaaatgaggacccagaagtgccctccgagctcttttgttgacttccgtctcctacagatgctgctgtaatggaccaagagcctgcagggaacagaacagccaacagcgaggtaggtgctcctcggcccagcctcgtggctagtgttattcccaaacagtcctggaaaacgtgagcaccctccctcactcagcatttccctccctcactcagcatttccctctctccaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 70 - DNA, 5973 bp, Homo sapiens
aaggtggagggaaggccgggcacaggggtgaaggcccagagaccagcagaacggcatcccagccacgacggccactttgctctgtctgctctccgccacggccctgctctgttccctgggacacccccgcccccacctcctcaggctgcctgatctgcccagctttccagctttcctctggattccggcctctggtcatccctccccaccctctctccaaggccctctcctggtctcccttcttctagaaccccttcctccacctccctctctgcagaacttctcctttaccccccaccccccaccactgccccctttccttttctgacctccttttggagggctcagcgctgcccagaccataggagagatgtgggaggctcagttcctgggcttgctgtttctgcagccgctttgggtggctccaggtaaaacggggatggcgggagggttgacctccagccccacaggaggggaccagcagggatctctgtggccacaaaggtcctgaggtccttagctctgtggattcttctaatcccttttttgggcagtccttccaccccgaaagcctctctgggcagagaagaaacagaaacccaagttcttcctgcaccctgtttctccctcgggaaacacccaggctccttctctacccctgcctctcggctcacgccccctccccttggcctctcttttgctcacctagtgaagcctctccagccaggggctgaggtcccggtggtgtgggcccaggagggggctcctgcccagctcccctgcagccccacaatccccctccaggatctcagccttctgcgaagagcaggggtcacttggcagcatcagccagacaggtatgcaccccaaacttgggcaacaggacctccgaatccagcactcaaccccacacccgtgccggtcctctgtcccctgccctgaggtgtcactccctctgaagccagtgacccagtctccctgccctcgcttgcaccgttcctgcccttgctctgcaatcagcgaccctcacgccagcatcccttctctccagaagtggatgcggccagtccaacagaggggtcgggcgtgaggggacggttggtggtcaagagaactcttggggcgggctttctcatcctcaacgggtggctgcctgcatcctcccgggcttcctacccctggagcttctcaactccattctctttcccgcccagtggcccgcccgctgccgcccccggccatcccctggcccccggccctcacccggcggcgccctcctcctgggggcccaggccccgccgctacacggtgctgagcgtgggtcccggaggcctgcgcagcgggaggctgcccctgcagccccgcgtccagctggatgagcgcggccggcagcgcggggacttctcgctatggctgcgcccagcccggcgcgcggacgccggcgagtaccgcgccgcggtgcacctcagggaccgcgccctctcctgccgcctccgtctgcgcctgggccaggcctcgagtatgtggggcgggacgatgggagaagggctgggaggtgggtccccatcccctgcctcccgggacgcaggaagggctggggcagaggctgcgccctaggccctgtcggagagctcccagaagagtagaggaagggggtgggcggcctgctggagtggaaggtgcccccgaagcacgtgtatggggggccctgtggagagattgtgtcacccccgagctccccttctcccacccacgcgggagtgcccagagggagggggagggggggagagcatggggctaaagtgattcatttcagatatctgtagctcagggggtgggcttcgcggggttccaggccaggaaaacggcaagggtggctgatgccaagtaaactccaggccagggacggggaaagtggtcctggggagtcttggggatccactttatgcacctccaggtgctggaagctgagatggggagagggtgatgtgggagaggagaagacaagtctaaagccaggtgcctgtttccaggagcttccggcttggcagccctgctgtgttgggaaattgtttccagtgggctgatgaagtcttctttatccttgcacagtgactgccagccccccaggatctctcagagcctccgactgggtcattttgaactgctccttcagccgccctgaccgcccagcctctgtgcattggttccggaaccggggccagggccgagtccctgtccgggagtccccccatcaccacttagcggaaagcttcctcttcctgccccaagtcagccccatggactctgggccctggggctgcatcctcacctacagagatggcttcaacgtctccatcatgtataacctcactgttctgggtaactcccccactctgcttcacatttgaccacaactccttcctgccccccttgtcacctcccctaactatgggtccccaaaccaggttctcggcagcgagtggcctacgtcattgctgtgggtctcactgttcgacccctttatattgctggcagcctcacagctgccatcaccccttcttgcttctcccgtggccttccagcgtcattgccggccttccctctccttccggctaagcccacttgctgggtttctgagcctcctcagctcatcaccttattctgctccttagcactcttatgagccagaccatctcctgaattcttctgcctcccttccttgcagccccagcactccctccccactgcagcacccagctttaactttgggttttcttttctcttcaggtctggagcccccaactcccttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacaggtcagcctcaggtgggaaaggagtagctgccctcccagggtagaaaggacagggaggaagggctggcagggcaaagactaggcaaacccaccctgtgatgccaggccactgggcacaagttccagagcctgcccatctcggcccccacttttctcacccccataataaagaaacgaaactgaaaatctcctcttgagtcacaagataaaagttccaccgttctctatgggactcccctgctctcaattggcgggagggtctgggaagttagaaggaaaggtgacaaaaattctgaatggttcgaaagaggtagaatatatttctagaatccttgtctactttgcagccagggcttgggttagagttgcaggaagtggcctggatttgggaggagtgaataaatccgtcccttggtcagcaaatatttactgagcaagggttttccaagacagtataaaacaaacacagaaaaaagaatactcagagagtatgtgttgactggttgataactatcggccatgacagattagccatgtctgcagcacgcacctgcggccactcagtagtagcaccccacggcaggtgcttaataatgtatagagattgaatgaatacgtgaacatgctaatggataatacatctcctgaaggccaatcctgagttttcacttgctttctggatacctctaactagatgttataccacctctcagccgccttaccctgaaccccagctttttctcccaccaatccccttgctgactcagcctgtcagtaatccactggtatccatccacctcgaaacctggcctcctcctctctacatcccatcagtcatcaaagtccaccagttctttctgtccaatgccctcttgaaggtcaactgttttatgtagacggctcaatgagagagatactgttaccccgaagactttctcaaaacagctgggaagtgccagactctgggtctaaactcaggtgtctgcatcaccaaatcactctccaggacactactcagatgcccttcaccctttgtctcctcccacccacccatctctcactttacaacttggagaatgctctgtctctagatgaatgggtcagttccctgttctctataccttcagaaagggggatgatgttcattcagggggcaccacaaggcaggggacactgatgtgagccgcatcatggaagttccaaaattgtgaagtagatgggggtcagctcatctgactgattttgagggttctgagcatttgagtagaaagtaatgtaaaagaatctgtaatagtatttattctgtggtctgccagggccagtttgagtgtgaaggcagtagggagcctggaaatgttttgagcaggggagggagctgactagagcattgtctgaataagataaatgtggccggcagggcatgatggctcacacctgtaatcccagcactttgaaaggctgagacgagaggagcacttgagtccaggaattccagactagcctgggcaacatggtgaaaacgcatctgtatacaatttaataaaaaaataaatagaaagaaaaagatgaacgtggccatgacccatgatgtccttccccaacctcccctggccagaacccaagtgagtgcagggtgattgagacttggggttcaacctgtgatatcacgtaaggggggcagaatcccaaaagatctcttccttctactcttttcagtgactcccaaatcctttgggtcacctggatccctggggaagctgctttgtgaggtgactccagtatctggacaagaacgctttgtgtggagctctctggacaccccatcccagaggagtttctcaggaccttggctggaggcacaggaggcccagctcctttcccagccttggcaatgccagctgtaccagggggagaggcttcttggagcagcagtgtacttcacagagctgtctagcccaggtccgaggccccagaatgccaggacccaaacgccacagcaataatctttatcctccttccagaacagcccctgccacccccatcccagcgcttttctttccagtcagggacctgatctctggcttttgcctagggttgacccgtttccgccactgatcagctgaatgaccctgggacaagtcccttaaactctctggatctcattgcatctgtaaagtctgagagaatgacaaagtgtcctttctagtcctgaccctatgcctcatcctgtactttctccataggtgcccaacgctctgggagagccccaggtgccctcccagcaggccacctcctgctgtttctcatccttggtgtcctttctctgctccttttggtgactggagcctttggctttcacctttggagaagacaggtgagccagggacatggcaaccccgccccccagcagctcccgctcttccatcctcagagtgctgatggcaccccttcctcaggaaggtgaccaaatgggaccctgaacttgccctcagagccccccttcttcataagcctctcactccagggatggcttgtgcctgggtaggctggaaggggggttgggagaaagccaggaccagatggggagggcaggggcgctgagaaaaaatagagggactcagtgtccctcctcatccgcttcccttcatccttctcctccttccgccctccgtctctctctccatctcttctcacagtggcgaccaagacgattttctgccttagagcaagggattcaccctccgcaggctcagagcaagatagaggagctggagcaagaaccggagccggagccggagccggaaccggagcccgagcccgagcccgagccggagcagctctgacctggagctgaggcagccagcagatctcagcagcccagtccaaataaactccctgtcagcagcaa

SEQ ID NO: 71 - DNA, 9028 bp, Homo sapiens
acagtttcccttccgctcacctccgcctgagcagtggagaaggcggcactctggtggggctgctccaggcatgcagatcccacaggcgccctggccagtcgtctgggcggtgctacaactgggctggcggccaggatggttcttaggtaggtggggtcggcggtcaggtgtcccagagccaggggtctggagggaccttccaccctcagtccctggcaggtcggggggtgctgaggcgggcctggccctggcagcccaggggtcccggagcgaggggtctggagggacctttcactctcagtccctggcaggtcggggggtgctgtggcaggcccagccttggcccccagctctgccccttaccctgagctgtgtggctttgggcagctcgaactcctgggttcctctctgggccccaactcctcccctggcccaagtcccctctttgctcctgggcaggcaggacctctgtcccctctcagccggtccttggggctgcgtgtttctgtagaatgacgggtcaggctggccagaaccccaaaccttggccgtggggagtctgcgtggcggctctgccttgcccaggcatccttggtcctcactcgagttttcctaaggatgggatgagccccatgtgggactaaccttggctttacgacgtcaaagtttagatgagctggtgatatttttctcattatatccaaagtgtacctgttcgagtgaggacagttcttctgtctccaggatccctcctgggtggggattgtgcccgcctgggtctctgcccagattccagggctctccccgagccctgttcagaccatccgtgggggaggccttggcctcactctcccggatcgaggagagagggagcctcttcctgggctgcccgtgaccctgggccctctgtgtacactgtgaccacagcccgctcctggaccctctgtgcccggctggccctctgtgcccagccagcctgcacctggggatgccaaggcctggggagggtggtttcacccaggccaagcctaagacagtccctctgggccctgctgggtaccggggtgtgacaccactgggaggacaagatgaggggcacccctggggccgccctgacaccccctcgaggctcctgccccgggggtcctggtgccccttcactgtggcaggcgactgggggttccccacctcggcccctctcccggggcctgctccccggcacctgaggcagcatccttgtcagggccgtgccttcctgcctcagcgccacctcttaaggttggcccgtgggtcactcaggactcagaactggagattctgggcaaaaggcaaagagcaaagggccaaaaggcatcccagggagacgactgcgggggaaccagagggcagaggggcgctcgtcacaggggagggggagctgagcgaggcaggaggggagccgagcctctccccccgtgtcccggctcttcaggcacgccctcgggacgccaccctccccgacccaggcgggaaagataagagcaaggtgtccgcagcctgacactcgtgcctcaggtgcccgcgcttgtgccggacaagactctcacaggtggcatgcctcggtttccccactggtaacagcacagggcactcagcaaggcgcagtgggcatgactggggtcctgtgggtcctgacccagatgtggccaccccggccgcagtggtcttcattccaggatgcctcttttccctcctgatctattcactgcgttcgccattcggtcattcccggggccaccactcccacctcaggtgtgtgcttcccttgtgttttatgagatatccccaacccggctgcttattggccccgtccgagggcaggagcataaataagagcctctgctttggcgtgggaccactgtgagctccagtcagcgctgccactgctgagctctgggccttcgacaggacttggccccttactgacttctccgtgtgctttgggtcatgggtgaggacgcctcctggcaaggctgcgtcctgaggattaaatcgggtcatctgtgaaaactacccagcccagcccctgacacttttttgtttgtttcttttagtgacagggtcttgctctgtcacccaggctggagtgcagtggtgtgatctcggctcactcgacctccggggctcaagcaattctcccacctctgcctccagagtagctgggactataggcacgtgccaccctgccaggctaatttcttccattttttttagagacagggtctcgctatgttccccaggctgggctcaaatggtcctcccacctcagcctccccaagtactgggattacaggcataagccactgcatctggcctccatgacacatatttttaaagtctgatttttaaagtcaaacttttgaagtcagattttaaacggactattttgaaaaatatacaaaaacgtttaaaaacaatgaatatccctcacctagaatcaataactaagaatattgacacatttgctttggggactgggcggctggagctgccatgacaaagctccgccgaccgagtggcttttaaacagagcctgccctctcgccgactgagggctggacgtgcaggatggagctccgcagggtcggctcccctgtgctctgaggggctctgctcagcctctcccggctgtggcttaaaaacagagcctgtcctcccgccgtggggggctggacatgcaggaccgaggggccacagggtcggctccctgtgctccgagagggctctgctcagcttctcctggctggggggttttgtggccaccctctgtgttcctgggttcagaagcatcccccaggctctgccttcatctctgcacgggtgactctgtacaggaagccaggcctgctggtcaatggccacccagccctgtgccctcatcttacctagtcccagctgccgtcaccctattcctaataaggccgccttctgaggtcatggggttaggacttccacataggaatctgtggggacacggttcggcccacagcccttcccacctccacacacacacacgactgtgaggagttggaagacctcactcctcacccctgccaggtcctctagggacaagctcgctgtcctcatcccagcacagcccgtgggacggtttccttgtccctaatgggaccacggtcagagatgccgggtctggtctgggccagcaggttcctccgcccggggcaggcagccttcttctgtgcgcttctggaaagcaatgtcctgtaatgcggtctctctgcgggagcacccccaccgccacctcacaggcctgttccacagccccgggatgggctctgtctccctcctgaccctgcatagggcacagccctctctcatcaacccacgatcctacgtggatccgagagggagcacctggggaaacaatggaatcccatagaaacaccccaaatctaacttgatccaggaccagccagtggtcacttctgaatattcaccttcctagtagacactaccagccaagggaggccaggaagccttcctggaggaggtggcctgaggactggggtgaggcaggccctgcgtgggggtcgccacccagcacccccacactgggtgggagccagtctctgagactggctgggggaggtgggagagggggctgcttgaactgcagacaccgaggtctagcccccaccccacccagccagttggtggaggcaggggaggccgaggggcccagctggacctgctccccggggtggattccaaaataggggggttggggggggcggaacaggagcccagggtcctggcttgaggcccagtggctgagggctggtgcaagccagacaggaaaagggttgagcctgtcagcgccagcacagatcaagtcaggagcaggtccctccaccaatgtgtgcaaataaatagcagctaagtttccagttacaagaacaatgcacagatggtcccagggacattgcggtgtggacacacagcggccattgtcctgtcgccagcacctcgccctacagctggggggtcccttagcacttcctagccatgcagggtccctgctcacagtacccgtgatgacttctgttcctcacctgcctgtctgtcccgacagctgcatggcagccctggcctgggagatggagaccccgaggggctgcctgcggtggtggggcccctgggtccccactgcattcccagaaacccagagggcagggcatttcccctgctctgtgccgagtccacccagccccagcctaggcccagtaagggctgcagcccaccctgtcccaggctgcctcccaggagccctcttggccctgatgccagaagcccatcttcctccattcaggcaggtctctgagtgccctggcctggctgcctgctggccctgagagtcacactaccccacagccctccttggtcaaaatccactctggagtggctggaagattccccgggcccacgccgcacacgcctatgcagggagcttcccctggccggccggcagacaagggcggtctcagagagggggctcacctcagcagccccttgtgtagctggccctcgcccctgccacctctgggaacaccaccaggaagctgggggacaggcacgcaggtgaaggaggcgagcgcttgtcagccgggaggccatgggcacagagggaacagggacaccctgggtggcctcaaggtcacttcaaacccctcactcgtcccctgggagggtgcccagtgaggttggcactaggagttggtcctggtcacatgacagacccacccacctctggtgtccagccagcacgccgtgggccagcctggctgcagggacacgagggcagcagccccctcctcctctgagctggttgctccttgagtcatcaccaccgcctgccacggaggccgcctgtcccaggaagcagagggaccgcagctgtggcaaccagggcctggtctctgtgtcacctcgctggggggccgtgcccaggcctgagacggaactgagtgacagtgcactgggtctgacagtgtggggctggcgccatgtttggggaaccctgtggcatgggacctgtgggtgagccgggaaaatcaccccgttgcatggcatctcgggcctggatcttaagcgcctgtgttggtgcctccgcctggcggaagagccgcgacccccacgttgccatgcgggtatcccaagccctgaccctggcaggcatatgtttcaggaggtccttgtcttgggagcccagggtcgggggccccgtgtctgtccacatccgagtcaatggcccatctcgtctctgaagcatctttgctgtgagctctagtccccactgtcttgctggaaaatgtggaggccccactgcccactgcccagggcagcaatgcccataccacgtggtcccagctccgagcttgtcctgaaaagggggcaaagactggaccctgagcctgccaaggggccacactcctcccagggctggggtctccatgggcagccccccacccacccagaccagttacactcccctgtgccagagcagtgcagacaggaccaggccaggatgcccaagggtcaggggctggggatgggtagcccccaaacagccctttctgggggaactggcctcaacggggaagggggtgaaggctcttagtaggaaatcagggagacccaagtcagagccaggtgctgtgcagaagctgcagcctcacgtagaaggaagaggctctgcagtggaggccagtgcccatccccgggtggcagaggccccagcagagacttctcaatgacattccagctggggtggcccttccagagcccttgctgcccgagggatgtgagcaggtggccggggaggctttgtggggccacccagccccttcctcacctctctccatctctcagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacaggtgcggcctcggaggccccggggcaggggtgagctgagccggtcctggggtgggtgtcccctcctgcacaggatcaggagctccagggtcgtagggcagggaccccccagctccagtccagggctctgtcctgcacctggggaatggtgaccggcatctctgtcctctagctctggaagcaccccagcccctctagtctgccctcacccctgaccctgaccctccaccctgaccccgtcctaacccctgacctttgtgcccttccagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgaggtaacgtcatcccagcccctcggcctgccctgccctaaccctgctggcggccctcactcccgcctccccttcctccacccttccctcaccccaccccacctccccccatctccccgccaggctaagtccctgatgaaggcccctggactaagaccccccacctaggagcacggctcagggtcggcctggtgaccccaagtgtgtttctctgcagggacaataggagccaggcgcaccggccagcccctggtgagtctcactcttttcctgcatgatccactgtgccttccttcctgggtgggcagaggtggaaggacaggctgggaccacacggcctgcaggactcacattctattatagccaggaccccacctccccagcccccaggcagcaacctcaatccctaaagccatgatctggggccccagcccacctgcggtctccgggggtgcccggcccatgtgtgtgcctgcctgcggtctccaggggtgcctggcccacgcgtgtgcccgcctgcggtctctgggggtgcccggcccacatatgtgcctgcctgcggtctccaggtgtgcccggcccatgcgtgtgcccacctgcgagggcgtggggtgggcttggtcatttcttatcttacattggagacaggagagcttgaaaagtcacattttggaatcctaaatctgcaagaatgccagggacatttcagagggggacattgagccagagaggaggggtggtgtccccagatcacacagagggcagtggtgggacagctcagggtaagcagctcatagtggggggcccaggttcggtgccggtactgcagccaggctgtggagccgcgggcctccttcctgcggtgggccgtggggctgactccctctccctttctcctcaaagaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctccacctttacacatgcccaggcagcacctcaggccctttgtggggcagggaagctgaggcagtaagcgggcaggcagagctggaggcctttcaggcccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgccgtggcctatccactcctcacatccacacactgcacccccactcctggggcagggccaccagcatccaggcggccagcaggcacctgagtggctgggacaagggatcccccttccctgtggttctattatattataattataattaaatatgagagcatgctaagga

SEQ ID NO: 72 - DNA, 23406 bp, Homo sapiens
agaacacttacaggatgtgtgtagtgtggcatgacagagaactttggtttcctttaatgtgactgtagacctggcagtgttactataagaatcactggcaatcagacacccgggtgtgctgagctagcactcagtgggggcggctactgctcatgtgattgtggagtagacagttggaagaagtacccagtccatttggagagttaaaactgtgcctaacagaggtgtcctctgacttttcttctgcaagctccatgttttcacatcttccctttgactgtgtcctgctgctgctgctgctactacttacaagtaagtctcggcatggatatttacaatgacataatggtgctgtacagaggacaagggagagatacaaggatggccattgtaatgttgtttgtaatagcaaaagcttggaagcaacctaaatgtccgtcgatgagggagtgggtaaataaatgtgatataatcatgatacaaacagtgagtctgacaaaacatactggtatagaatgtctcaaaattataatgttattaaagaaaaaaagttgcagaataatgcatatattaggcttctatttgtgtgtgtgcattgtcggggagcaggaatatgtggacatttcttaatgtataagctctaggaaaaggaaccagggaatggtaaagagttgggagagtaaggcatatttttcttttcttttctttcctttttttctttttcttttctttctttttctttttttcaattgagatggagtctcactctattgcccaggctggagtgcagtggtggcaccattttggctcactgcaatctccgcctcccaggttcaagtgattctcctgccttaggcaccggagtagctgggatcacaggcgtgcaccaccacacccagctaatgtttttaatttttagtagagacagggttttaccatgttggtcaggctggtctcaaactcatggcctcaagtaatctgcccatctcagcctcccaaagtgctgggattacaggcgtgacccaccgtgtgcccggccactttttcatacacctttgatagtgtttgaatgtttttactgtagttgagtcatatgaaaacaaaggggacataaaaaatcaaaagaaaatatataatgaatgttttatcatatataaaatatatatagtttttttttaatggaattaactttgtcatttgaggaaaatgaggagacaagtctcaatcattttaggagatttgtttgccaaagttaaggaggcacctgagagacaggtctatgactttctcagaagatgattttgagggctccagatttaaaggggacaaggtgggatattgagaagcactcagttttcacataaaaaaggggggggggcagaggaaaaatatggggaatctgcattttacattagataacacagacaaaatggggtagggaaacaatcagataacgcatttgtgtctggccagggtgaccgcaccggtaaagatgagctatcaatctgcattgcacagctgaccaggaatttccttgtgggcaaaatatgggggaggtatgcagcctttcatcctgtagccatcttattcaggaatcaaaaagaggaggcaggtttctgtgacccagttcccagcttgacttttccctttgactgaatgagtttggggtcccaaaatttaatttcttttcacaactttaaaccttaaaacaactccatgagtagtttcaaatacacaagatccttatttaaccaagggtttgtatttactgtgcacttgctgcttaaaaagagaagtatgttaggagagcctccctttgttgatgaacaagcaagtagcccagatgggcgggccgtttcctggctgaccatgactaattttctgattgtctgtttccatcagccctgttctcccgtgttcacagaattgggccacaattctctcctagggcagtgtttctgaaagtgaggttctgagaccagccacttcagcaacacttgagaacttgttagaaataaaagttctcaggctctaccacaggccaactgagtcaggaactctagcagttgagcccagcaatctgtgttttcgcaaggcttcccagtgattctgatggccttcacatctgagaagcattgtcacagcgaatcatcctccaaacaggactgcagcagtagcttcctctttattctgtaagacatggcttgcagttttcctgaaatggagtaacctcactcaccgcttgagtcttggctctccttctctctctatgcagggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccaggtgagtggacatttgcatgccatctttatgaataagatttatctgtggatcatattaaaggtactgattgttctcatctctgacttccctaattatagccctggaggagggccactaagacctaaagtttaacaggccccattggtgatgctcagtgatatttaacaccttctctctgttttaaaactcatgggtgtgcctgggcgtggtggctcacacctctaatcccagcactttgggaggctgaggccggtggatcatgaggtcaggaattcgagaccagcctggccaacatagtaaaaccttgtctccactaaaaatacaaaaaattagccaggcatggttacgggagcctgtaattctagctacttggggggctgaagcaggagaatcacttgaacctgggagtcggaggttgtggtaagccaagatctcgccattgtactccagcctggctgacaagggtgaaactctgtctcaaaaaaaaaaaaagaaaagaaaagaaaagccaaaactcatgggtggaatgtatagatgggatgaaaggcctagatcagtggttagagaccctgactctcattagaatcacatagagagtttttaaacaactatagatgccaggtacagtggctcatgcctataatcccaatactttgagaggctgaagcaggaggatcacttgaggtcaggagtttgagaccagcctggctgatatactgtggctacccctatctcttaaaaagcagaagaaaaaaccccactaccaaaaaccagagaaatcagcatctctggaggtagatgctaagcattagctttttacagagtctacctcaggtgattttaccccaggtgcagccagcatggtgaactgctgggttatgcatgtatgctgggaggtgaacagacttaagatttctataacatgtactttgtgcccagatagagctgagtttacatctaactctgcctcttactagctatataatcctgagcaagttattgaaacgctgtgagctcctcttctataaaatatgacaataataccgatcatgtgggccattagaaggattttatgtgataatattttattaaaagcctttataggttgggcatcccaaatctgaaaatctaaaacctaaaatgcaccaaaatctgaaatgctctaaaatccaaaactttttggacactgacatgacattcaaaggaaaagctcattggaacataagtataggcagatactaaaaaataaaaaaataaaaacatggctgggcgtggtggctcatgcctataatcccagcactttgggaggctgaggtgggtggatcacctgaggtcgggagttcgagaccagtctgaccaacatggagaaaccctgtctctactaaaaatacaaaattagccaggtgtggttgcacatgcctgtagtcccagctactcaggagtctgaggcaggagaattgcttgaacccaggaggcggaggttgcagtgagccgagattatgccattgcactccagcctgggcaacaagagcaaaactccgtttcaaaaaaaaaaaaaaaattcaaaatctaaaacatttctgatctcaagcatttcagataaggagtcttcaacctgtaattatggccatttgtgtggctgttagttccgctattaataatcagaatgtaacaatgatgactgcatcttacctttgtcaaacatttgaagtgtgtgatacactctcaacgtaggtatccaggcaggtttggaagctgagggtgtatttctctttcttaattgtctttcgcatttttttcttgctgcccctttgattccctgaaataagctttctgctctcagataattttcatccttatgttgtttctgacattagccaaggtcacccctgcaccgactcggcagagagacttcactgcagcctttccaaggatgcttaccaccaggggacatggcccaggtaactatgcatggggcagaggagggaatctttagctggctctgaattcagaggattttgaatgtgggaaaaaaagatgagaaaacagtgtgagagtggaggcatggatatctccgtgcacctgaaatagtgtttgaaaagagggaagtggtggagacacacctgtgctgggaaaaagatggtctggcttaggattattttacttaaattttaactggaaaaaagttaataaactttatagtctttaattttacttaaatattaactaaattgaatgaaatgctcattactttgtccacattttctgactgaccctggactggtgatgtttggtcatgaactggtgtcagtctgtgtttgggaactgacacattggattaggtgatttctaggatgccttctagctagaataaagcccatcaccttccctggattccagccacagaaagaatagttaaattcttcatgtaattcagcaaggacgtactcagggtgctccagaagagaacactgggcataaagcagaagtcaagtcacattgatcatgaaggttaattttaaggtatttcttgtcagtgtcctggtctcttctaaactctctggagctccattttttttttcttctgtaaaatgaggttaataggtgagtcccacctcataatgtcataaatctcataaatcacaccttatgggctttaaataagaaaatgtctaaaacgtttatcccaatgtctgaccacaatttgtacatgttagctgttgtcgttaatattataagatcaggaggcacagtgagattgtggttaaagtacttcagtgacaggtggaatgggttctaatttcagctgttcttgatagctctgtgacctcagtcaagttgctcaaattctctgaagctcagtttgctcatctctacaatgaggataattccagtgcccatgtcatgaggtggttgtaatgtataaacatgataatgtatgtaaaatgctcagcatagtacctggcccataaaaagcactcaactgtttattattactatagttactggttttagctctccaaagtttcagtctttggttagtctttagtgattggtagccaacatcttttatgcaattagagaggaaactaaatatggtggggacagaaaataataaagttataccagatacttattgtatgccattgttatattttaaagaatcttacaaccatagtgctagaagggacttcaagggtcatttagtctcactttcccatcctgtgcttcagtacttttttttttttttttaattgagacggagtcttgctctgtcacccagactagagtgcagtggcgcaatctcggctcactgcaagttccgcctcctgggttcacgccattctcctgcctcagcctcccaagtagctgggactacaggcgcccaccatcaagcccagctaatttttttcttttttgtatttttagtagagacagagtttcaccgtgttagccaggatggtctccatctcctgaccttgtgatcctcccgcctcggcctcccaaagtgctgggattacacgcgtgagccaccgcgcccggccagtactttttactacatcaccactgaatgggcatttgctgtagacggagttcactccctgtcgaggtggtgcatttccttatacttgtctctaccacagacagaagtcttctttcctttagtttttctttcctttttttttttttttgagacggagtctcactctctcacccaggctggagtgcaatgacacgatcttggctcactgcaaactctgcctcccaggttcatgccattctcctgcctcagcctcccaagtagctgggattacagacgcgcgccaccacgccccgctaatttttgtatttttattagagacggggtttcaccatggtggccatgctggtctcgaactcctaacctcaggtgatccctctgcctcggcctcccaaagcgctgggattacaggtgtaagccaccacgcccagccttccctttagtttttgtttgttagttccttccctctagggcaacaaaaatgggaatataggaataatacctcgaacctctgagcttctcaagggcctgactgagaaaaaatattgaaacaaccaaaaataggtcagtagctcctaaataggaaaataaaataaaaaattgaaatgaatgaatatttaatggtttgtctataatatgtaacattatgtaaattggctgctggcaaaccaactctaaatgtgggatgtgggagcatttaatataaaaatggggctgggcacagtggctcacatgtgtaatcccagcactatgggaggccaaggcaggcagatcactggagctcaggagttcaagaccagcctgggcaacatggcaaaaccccatctctactaagaatacaaaaaattaggctgagtgcagtggctcacacctgtaatcccagcactttgggaggccaaggcagatggatcacctgaggtcaggagtttaagccagcctggccaagatggtgaaacccctgtctctactaaaaatacaaaaattagctggtcatggtggtgcatgcctataattccagctactcaggaggctgaggcaggagaattgtctgagcctgggaggagtgaaccgagatctcaccactgtcctgaagcctggaaaacagagcgagattccatcccaaaaaaaaaaaaaaaaaaaaaaatagccgggcatggtggcatgtgcctgtagtcccagctacttggcagggctgaggcaggaagattgcttgaactcaggaggttgaggattcactgagccgagttggtgccactgtactccaaacctgggcaacagagcgagaccctttctcagaaaaaaaaaaaaaaaaaatggagtagagcctttaaaagtaagagatccaagggcctggaatttgaacacagaacaaatgcaacttgtcttctacctgaaggagtaaggactgggtcacaggtgagtcctcagctctagagtagatctgctttaaatcctagctttcccaattaatagctgtgtgatcttgggcaaagtggctctctcagactcagtatcttcatctgaaaaatggggaaaatagtagtacctacttattgtggttgaggattaaatgagattgtatgtatatggtgctaagcaccatgtctggcacctaataagtaccaaatagatggtaactactaaatttatacactgttaaggccatcacatctcacctccgctgctacctgccccaccaggcaaatcttggtttctccagaaagaacattgccactcccttcaactgtcccatccatcttggttggtggccaaatctgtgtgaaaaaaagctgtaatgacacaacagtgcttgattttactgatcattttcatagcaaaatgaagtttttaaaaagttagttttaccatttttatcaagaaaaataattataaggagtctgaaactggatttacatttaaaatcttatgtgcacttaagattcatgtttacttagcagttgtactgatgagggtcttttttttatttttttgatatggagtcttgctctgtcaccaggctggagtgcaatggtgtgatctcggctcactgcaacctccacctcctgggttcaagcgattccactgcctcagcctcctgagtagctgggactacaggcgtacaccaccacgcccggctaattttttgtattttagtagagatggggtttcaccatattggccaggatggtctcgatctcctgacctcgtgatctgcctgccctcggcctcccaaagtgctgggattacaggtgtgagccactgcaccaggcctgtggtttttatattttaaatttttttctggtaattagggcaaaagtaattggaacataatctttttttcttcaataattttaggctgaggctatgcctttataatatttaaactatagtttgctaaaccagcatttagtcaaaccctttatacacattaaggcttccagaaggtgacagtgacatttaagaagtttcaacatctctgactcagccataaaaatgagtaagcatgcttagttttccaaaagctggcaatgtacttatttttagaattcagtgttcatgaggtcagggcctgtgcccctcttgtttcctgctctgtcccctgtgcctagagtaagggcatagtgcatattcatggaatggatcagcagatgaagaaataaacaaatgaacaggaaggaaagatggtgagtgggtggctgggcaacgtgaccctcttcataatgacagcactgaggtaagggctggtgaaggcagtataattaagaatgtgcatttaaggctatgcagacctaaattggaaggccattttgtcatttgctaagtcatgtgaccttgggttagtcacttcacttccctaattttcagtttcttcatctgtgcaatgggactaacagtctctactttagaagcgtagttctaaagtaagtgcttctaagtatctctaaaatgagcttcttcactgaaagagtttatttagcacaaggcctggctcctattacattgtgaccacagtgattattttcatttgttggcaaccctgtctcccttctcatgagtaaatgcaaaacttatttaagaaaatggaggctgggcacggcacggtggctcacgcctgtaatcccagcactttgggaggccgaggcgggtggatcacttgaggtcaggagttcgagactagcctggccaacatggcgaaaccccgtctctactaaaaatacaaaaattagctgtgtgtggtggtgtgcccctgtagtcccagctaccagggaggctgaggcaggagaatcgcttgaactcaggagatggaggttgcagtgagcagagatcatgctactgcactccagcctgggtgatagagtgagattctgtctcgcaaaaagaaaaaaaagaaaaagaacatggaggttgcagtgagttgagattgtgccactgcactccagcctgggcaacagagtgagactgtctcaaaaaaacaaaaaagaaggaaatgaatttttgttgtcttttaaaatctaattagaatataatgcctgaggccaagcctggtcgttcacacctgtaatcccagcattttgggaggctgaggtgggcagatcacctgaggtcaggagttcacaaccagcctggtcaacatggcctcgtctctactaaaaatacaaaaattagctgggcgtggtggtgcatgcatgtagtcccagctacttgggaggatgagggatgagaattgcttgaaccagggaggccgaggttgcggtgagctgagattatgccactgcactccagcctgggtgacagagtgaaattctgtgtctaaataaataaataaataaataatgcctgagtcttatcaatattgctagatgtttgtagaactcattagggtcctgtgaaaaaaacaaagcacatatttaatgtaggacttcctggcagaagtctctatttcataaaacagtacggttcattatctagatgaaaaaatgtggccatcctaaagttgattcctgggtgttcagtaaattttgtctgtctctccattaattattgtgacaagtacggagtagaattcatttcaaataggattataggcatcattaagattttttaaaaacttagataaaagaaaacgttcttaactatactattggctatttttcctctctctctctctctctctctttttatagcagagacacagacactggggagcctccctgatataaatctaacagtaagtaactttttttgtgagctatgttgtactcaacttggaggggaaatcatggctttagacttccttcatgcccaccttgtccttggggtaaaaagccttaagttcccttagcttcagattcctgggctgtaacatgttgatgatgacagttctaacctcataggcctgctgtaatgaaggactgacatgatgtgtgtaaagtgcctggcatatagtaagagcttgaaaaccacaaagaagaaacattagcattttgtccctcttattcttcaatttcacaactgtctaccctgtggaaggttcaaagattcttcatctccctagaataccattcttcttgcttccattgcaatcctaatgggaaagagtatttaaatttatctctttaaatatggcaagacaccagtcaggaatattcaaagtgaagaggttttttttttttttttttagacagaatttcgctcttgttgcccaggctggagtgcaagggtgtgatcctggctcacctcaacctccgcctcccgggttcaagcgattctcctgcctcagccttccgagtagctgggattacaggcatgagccaccacacccggctaatttttttatttttagtagagacggagtttcaccacattggccaggctgatcttgaactcctgacctcaggtgatccacctgcctcggcctcccaaagtgctgagattgcaggcgtgagccatggcacctggcctaattttgtatttttagtagagacagggtttctccatgttggtcaggctggtcttgaactcctgacctcaggtgatccgcccaacttggcctcccaaagtgctgggattacaggcatgagccatggtgcccagccagttttatgtatttaactataaataaagccataccttaataaacctcaattttactgtccctgctaccttctcagaataaaagaaaaactggctgggcgcagtgactcacgtctgtaatcccagcactttgggaggctaagtagggtggatcacctgtcaggggtttgagaccagcctggtcaacatggtgaaaccccatctctactaaaaatacaaaaaattagccaggtatggtggtgtgtgcctgtgtagtctcagctactcaggaggctgagacaggagaatcgcttgaatccaggaggtggaggttgcagtgagctgaggtcgcgccactgcacaccagcctgggcaacaagagcgaaattccctcataaaagaaaaaccactagaaggcaagcttgcagcaatgacttaaaaattctttgaggaggccgggcacagtgtctcatgcctgtaatcccagcactttaggaggccaaggtggaaggaatgcttgagaccaggagtttgagactagcctgggccacatagtgacaccctgtctctacaaaaaatattttttaaaatttggccaggcatggtgctgcaaacctgtagttccagctacttgggaggctgaggcaggaggatcacttgagcccagtaggttgaggctgcattgagctgtgatcatgcccctgcactccatcctaggtgacagggcaaggccttgtctcaaaaaaaaaaaaaaaaaaaaaattacttgagggcatatccaggagcccacatttatttgactcagtttcttgcttgtgtattcacaactgatgctcagcatcttgtatttgctccttctctctttgcaatcaaacagtgctttttaaggacctgtatgtgcccacaatgcttaatgcacaatatcttgcatataggactcctgttattgcaggagtaatgtgtattgaatcaatttgtaaatgtatattgaataaatggaagatttaacttccttaaattcattgttttaaaaatgcttataattatatgtgtgtgtgtgtgtgtgtgtgtgtgtgtgtgtgtgttttgtataaatggggtctcaatattattaggctggtccctaactcctggtctcaagtgatcctcccatctcagcttcccaaagtgctgggattataggtgtgagcctggcctataattattatttatttattaatttattatttatttttgagatggagttttgctcttgtcgcccaggctggagtacaatggcacaaccttggctcactgcaacctctgcctcctgggttcaagcgattgtcctgcctcagcctcccaaatagctgggactataggtgcccgccaccacacctggctaatttttgtatttttagtagagatggggtttcaccatgttggccaggctggtcttgaactcctgacctcgtgatctgcctgccttggcctcccaaagtgctgggactacaggcgtgagccaccgcacctggcctaatcattgtttttaaagagagaaaaagagagaacccatagactgaaattttagaaacaggatttattttgtgtggctctcagttatcagaaaatcaagttaactagagcaatagcaataatagctacgattgattgaacatttattatgtaccaggccctgtactaagcattttatattttctctcacttagttttcctgataactctacaggattactcagcccttagtggcagagctgggaattttttttttttttttttttttgagatggagtctcgctctgttgcccaggttggcgtgcagtggcatgatctcaactcgagtactccagtctttgcctcctgggtttaagtgattctcctgcctcagcctccccactagctaggattacaggcatgtgttaccacgcctggctaagttttgtatttttagtagagacggggtttcaccatgttgtccaggctggtctcaaactcctgatgtcaggtgatccgcctgcctaggcctcccaaagtgctgggattacaggcattagccaccgcgcccggcctcagagctgggatttgaatccacgaccgtctggctgtaaagtcttggctattgaatcactgtctttttgtgaaaaatagacgtttcatagcaagacactaaatgtaaactactctaaaactctctggggaatcttaggggatcttgaaccaacaagactccactctaaagccaatttttgcaggggcagggaaagggtcttaagagctccttctctctttttttttttttttttttaagagctccttctctacccacaacacagaagggcacattttgtttccttgctaactccaaaggttaagggagaccctttcttgggttggcttgagtgttggctacaaggtgacagatcaaaggtgatttgaaggactcagccatcctgtgatgttgtaaaagggatggtccaattcacaaatcttgaagctgattacacaagcgatttctagctgttttctgcttaaatcctgtttgtgtttccatagcaaatatccacattggccaatgagttacgggactctagattggccaatgacttacgggactctggagcaaccatcagaataggcatctacatcggagcagggatctgtgctgggctggctctggctcttatcttcggcgctttaattttcaaatgtaagtgtttttgtttctctctccctctgataacaaattcttcagtgagaaccagtaaaaacctagatagaaatgcaaattcatgtttatacccaaagatgattagactaaatacccttttgtccatccaaatcctaacaataatggctaatttttatttaatatttattgtgtgtcaggcagccactgcgttaaatgttttacatacattttatcatcattactgtcttatgagataaggaatagtaccatccccattttacagtgaagggaagtcaagcttagagtaagctgccttcccgaggtttcaacatcagtacctggcagaaccggaaatcaaatccaggcaggctgattccagtaaactaatttctttaattcatgaatatgtctaggtttgttacgaaacacaacaacaaaaaacacttccttctgtgcacttttctgttattggtttctcaggcatacctctctggcagtagactgcaagtccctttaacactgggtcgtgactggggttagagaatgttttcctccatcatggtacttagcacatagctttttctaagttacttatcccttttttttttttaaactagcaaacaaacaaaaacaaaaaaacaggcccggcgcagtggctcacgcctgtaatcccagcactttgggaggctgaggggggtggatcatttgaggtcaggagttcgagaccagcttggccaacatggtgagaccccatctctactaaaaatacaaaattagccgggtgtggtggcgcatgcctgtaatcccagctactcaggaggctgaggcagaggaatcactcaaacctggtaggtggaggttacagtgagctcagatcatgccactgcactccagcctgggtgacagagtgagactgtcttaaaaaaaaaagtaataaaatataaataaataagcaaataaataaataaataaatacaatggccaggtgcagtggctcatgcctgtattttcaacactttcggaagctgaggtgagaggatcagttgagcccaggagtttgagaccaagatcagcctgggcagcaaagcaggatcctgcctctacaacgtaataataataataatgagctgggcatggtggcacacacctgtagtcccatctactcaggaggctgaggtgggaggatcacttgagctcaggaggctgcagtgagcggtgattgcatcattgcactccaccctgggcaacagaataagacagtctccaaaaaaaaaaaaaaaaagaagtgtgttgaagttgatgaattttgatggagaattacagtaggaagccatcatcacaatcaagatctaaatacttccagtacccccaaaacctcgcacacttttgtttttttggagatggacgctggagtgcagtggcacgatctcagctcactgtaacctctgcctcccgggttcaagtgtttctcctgactcagcttccagagtagctgggactacaggcatgtaccaccacgcctggctaatttttatatttttagtagagacagggtttcaccatgttgggcaagatgttcttgatctcctgaccttgtgatccgtccacctcgacctcccaatgttttgggattacaggcgtgagccactgtgcctggccactcacacacttttataattgtgtctattttattttcttttagggcagaaaccaagtccttatgccccagagcgtaatatgacatagcagcctttcttactaatacacaaacagggactgtgtgtgtagagtgagcaatcacctcagattagctcaagactaaagggtgttcctaagatatatgggacttctagggctaaaactggaacagtccaagaaaaacatgagttggtccccccactaactgtggactgaagctgccaagtgctttacgtgcattaaattctcgtaactaccctatgagataggtactaatatgtttctaatggagaatcagcatgctaaaaggttaggtcacttgcctgcatttacacagttaattgatagatactggatttgaaaccaggactgtcctgctcctcatctttatggtttctgcgattatggttaaatggattattcagaaaaagaaactaccccacccacacttacctgggtttattcagagatagccatggaatttttgaattgatcacatgaatatatatatatgtatatatatgtatacacatatatatatatatttattattattgggacagagtcttactctgtcacctgggagctggactacagtggtgtgatcttggctcacttcaacctctgcctcctgggttcaagcaattcttgtgcctcagcctcccaagtagctgagattacaggcatatgccaccacacctggctagttttttttttttttttttttttttttttttttttttttttggtagagacagggttttgccatgttgcccagaaaattggtctcaatctcctgagctcaggtgatcctcctacttcagcctcccaaagtgctgggattacaggcgtgatgaatatatacatatttaaaaatagaggctgagcacggtggcttacgcctgtaatcctagcactttgggaggccgaggtgagtggataacctgaggctgggagtttgagaccagcctgaccaacgtggagaaacctcatctctactaaaaatacaaaattagccgggcatgggggcacatgcctataattccagctactcgggaagctgaggtgggagaatcacttgagcccaggaggcggaggttgcagtgagctgagatcgtgccattgcactccagcctgggcaacaagagtgaaactccatctcaaaaaataaataaaataaaataaaataaaaatagaaatgagatcttgctatgttgctcaagctggtctcaaactcctgggcttaaataatcctcccacctcagcctcccaaaatgttgggattataggcatgagtcattgcacttagcctcacttgagtatttccaaaacagactagggattgttaaggagcactgataacactcactacttttttgacttctgccatggctcaaagtaaaactttgagctttactattatatatattagagaccactttatatatatatgtgtgtgtgtatatatatatatatatatatatataatatgaccataatttatacatattagcacttattctagtttgtataaagagtgatgggatctagaggaaatctgatgctttgtacacacacatatatgccactccaaaaaaacatggctactgagaagtacagataagaaaggcctgtttcatttccaatcttttccctggaagttgctggagaaaatattaaaatcaaggtgacagctttttaagtcatgacctcacaaaaacaaactgacactcaataatgccccacaatcttccatctttctagtgtactctctgagatgaccatccatacctcactgctgctcaaaacttctttgcccctctcctaactgatgaaatatgaaagggctttttaatctccattgcctaggccaagacttcatccttctttttatccctttcttctgagtcatctctctccttttctgtttatgctattttcattagcagaatatatgttctagtccatgcattcctctccagctagtcccatttctcaactcgttctcacagccatatttttcaaaggagttgtctctacttttcacccatctacactccttgacccaccatcatctagtttctgctccaaagcacaacggaaatggtcaagctcaccactgaccttcagttttctaaattaaatattaacagatacctttatctttttttttttttttgagacagagtttcactcttgttgcttaggctggagtgcaatggtgcaatcttggctcactgcaacctctgcctccccgggttcaagtgattctcccccctcagcctcctgagtagctgggatttcatgcatgtgccgccatgcctggctaattttgtatttttagtagagacgggggtttcaccatgttggccaggctggtctcaaactcttgacctcagatgatctgcccgccttggcctcccaaagtgctgggattataggcgtgagccaccgttcccagcctgatacctttatctttattatagtcaaccttttaaattgatcactcattctagaaagtcctccttctcttggcttctgaaatgacattcttctctttgatccattgcttttcagatcttcttctgcctgatccttagatgttgagattccttagggctgggtatggtggtgcacgcctatcgtcccagctactcaggagaatgaagcaggaagatcacttgagcccaggagtttgaggctatgaactatgatcttgctgctgcattctagcctgggtgacacagcacagggagaccctgtctcagagaaaaacaacaacagaagattcctgcagtcttcctccaacatacatctaaagtgttttcattattctgcatctcttttggccattccttactccaagacaccattatttctacttaatttatcttctcatttctttattcctccttcgaatccaatattaaaacccaaatcaatgtctgagcacaatggctcatgcctataatcctaacacttcgggaggccaagacaggagagtcacttgaggccaggagtttgagactagcctgggcaacatattgagattcacccaggctggagtgcagtggtgtgatcatggctcactgcaacctctacctcccgagttcaagcaactctcctgcctcagcctccaagtagctaggaccacgggcatgtgccagcatacctggctagtttttgtatttttagtagagatgaggttttaccatgttgcccaggctggtctcgaactcccaagctcaagaaatccacctgccttgcctcccaaagtgctaggattacaggcgtgagccactgcatccagcccaaaaacattaaaaaaaattatccagctgtggtagtgtgcacctatagttctagctactcagaagctgagatgggtagatcccttgagcccaggagttcaaagttgcaatcagatatgatcttactactgcattccagcctggccaacagagcaagaccctgtctcaaaaaaaaaaaaaaaaaaaaaaaaagaaaagaaaagaaaggaaaattttaagtttcaaatttttgaaactgcatccccagaagacaccttgaaagaccttgatccagaggtacccagtaagccacacctggattcctgacccacaacacagaaatgatgagataacgtagttgttttcagcgggtaaaagaaacccaaaacaaataaggatcacatctctgcccttcaaggaaatctaaggtttcctacaggtcttagaataaaatccagactcctgattatggctggaaaggtcttattggacctagccccagcctacctttcagaccttatcttgggccgctcccttaatccagccacgttttcagtttcaggtactcagcaagatctttacaaggggctccctcatcctggaatgctccttctggctctttacttggctgactcatttcagaaacgagcttaaagttcatctctgagggtccttccctgaccaccctctctattatctgtttcactatgatgttggtttcctttataatacatcataatttgaaattattttgttttcctatttactatttcctttttgttgttgtttttttttttttgagacggagtttcgctctcgttgcccaggctggagtgcaatggcgcaatcttggctcaccgcaacctccgtctcccgggttcatgtgattctcctgcctcagcctcccgagtagctgggattacaggcatgggccaccacatccagctaattttgtatttttagtagagacggggtttctccatgttggtcaggctggtcttgggtctggggtactgttttcttttatttctttggtctcccacaggagagcgtgagcttcgtgaaattagggctcacaattcacttttatgttcctgtgttccttgtgccaggcaaactgccagacacatagtagaggtctcataatatttgttaaataagaaaaatgcatctttattattattttctaacacagtccatataactatctaaggcacacgttgagagtttcatttaactcaatctgagatgagaccagatttccctaaactatgcgtgcttccagtgaacctatttgatttcttgtctcatttattttatgaatgcatttttattggcttttgtttcccccttactagggtattctcatagcaaagagaagatacagaatttaaggtaagaataatggaatggggttgggaaaaggtgagaatcttggaagtccctactctaacatgtctgatcttttctctgagaaatcctgtcctggggctttgagatctgagtttatacttccttctttctctaggtctagttatgaagtgaaaatgtaacatgctactgtgtgtacttcctgacacctctagcttctttagttctaaagttaaggtatagaatttatcaccctaataatacaacatgcttattcatctcgatattaatggtttttccactgaactgaaacatcaacggattgagctcctattatatccagggtctgggctgcacttaggcgttacagaagtgagcaagaaacccagtatctgttctcagcatttctgtaaacagcccaggcattttcaactttagtttcctattagaatcacccaggcactgaagtgtactaatgcagggccaaccccagagcaactgaatcagaatctctggggatgaagcctaagcatagaaattgttctaaaagctctccaggtgattctagtgaacagtcagggctgagaactgctagtctgttatagactcctgtcttgaccttcgttcctgattatacacacccacacatccatttcaaataggtatggcttacataacttactagattttagacttttagtgatgtttggcacatgaatggaatacaatatatttggattacaaaaatgattctgggctaggtgctgtggcttacgcctataagcccagcactttgggaggctgaggtgggaggatcacatgagcccaggagttcaagaccagcctgggcaacatgatgagacctcttctctacaaaaaaatggaaacattaggtggaaggattgctggagcacaggagatgaaggctgcaatgagccatgattgtgccactgcattcccacctgggtgacagagaaagacccagcatcaaacaaaacaaaacaaaaacctctgtccattgaatgctatctaaagcattaataattttttttttttttttttgagacggagtctggctctgtcacccaggctggagtgcagtggcacaacctcggctcactataacctctgcttctcgggttcaagcgattctctgcattagcctcccaagtagctgggattacaggtgcatgccaccacgctggctaattttttgtatgtttagtagagacggggtttcactatgttggccaggctggtctcgaactcctgacctcgtgatctgccaggctcagcctcccaaagtgctgggattacaggcgtgagccacggcgcccggcccattttttgaaaatctaaatgtgtacataattgcagacatcttgatacttcacctaaacttcagcctgcacctccgagaaataaaaatattctcttagctatcacaatgctgttgttatacctaagaaaattaaaattaatggacattttctcaattgtttccccatagtattttattgctatttcttggcttttccacttgttcagcatctgatcaaagatcatgcactatatttagttgctgtctctttgggaaagcctattctcttaactctattccgtgttacctgggaaatgcttaactcaaccgcaacactttatttccacagcctcatctctttggccaacctccctccctcaggattggcaaatgcagtagcagagggaattcgctcagaagaaaacatctataccattgaagagaacgtatatgaagtggaggagcccaatgagtattattgctatgtcagcagcaggcagcaaccctcacaacctttgggttgtcgctttgcaatgccatagatccaaccaccttatttttgagcttggtgttttgtctttttcagaaactatgagctgtgtcacctgactggttttggaggttctgtccactgctatggagcagagttttcccattttcagaagataatgactcacatgggaattgaactgggacctgcactgaacttaaacaggcatgtcattgcctctgtatttaagccaacagagttacccaacccagagactgttaatcatggatgttagagctcaaacgggcttttatatacactaggaattcttgacgtggggtctctggagctccaggaaattcgggcacatcatatgtccatgaaacttcagataaactagggaaaactgggtgctgaggtgaaagcataacttttttggcacagaaagtctaaaggggccactgattttcaaagagatctgtgatccctttttgttttttgtttttgagatggagtcttgctctgttgcccaggctggagtgcaatggcacaatctcggctcactgcaagctccgcctcctgggttcaagcgattctcctgcctcagcctcctgagtggctgggattacaggcatgcaccaccatgcccagctaatttgttgtatttttagtagagacagggtttcaccatgttggccagtgtggtctcaaactcctgacctcatgatttgcctgcctcggcctcccaaagcactgggattacaggcgtgagccaccacatccagccagtgatccttaaaagattaagagatgactggaccaggtctaccttgatcttgaagattcccttggaatgttgagatttaggcttatttgagcactgcctgcccaactgtcagtgccagtgcatagcccttcttttgtctcccttatgaagactgccctgcagggctgagatgtggcaggagctcccagggaaaaacgaagtgcatttgattggtgtgtattggccaagttttgcttgttgtgtgcttgaaagaaaatatctctgaccaacttctgtattcgtggaccaaactgaagctatatttttcacagaagaagaagcagtgacggggacacaaattctgttgcctggtggaaagaaggcaaaggccttcagcaatctatattaccagcgctggatcctttgacagagagtggtccctaaacttaaatttcaagacggtataggcttgatctgtcttgcttattgttgccccctgcgcctagcacaattctgacacacaattggaacttactaaaaatttttttttactgtt

SEQ ID NO: 73 - DNA, 26025 bp, Homo sapiens
gggggcgggtgcctggagcacggcgctggggccgcccgcagcgctcactcgctcgcactcagtcgcgggaggcttccccgcgccggccgcgtcccgcccgctccccggcaccagaagttcctctgcgcgtccgacggcgacatgggcgtccccacggccctggaggccggcagctggcgctggggatccctgctcttcgctctcttcctggctgcgtccctaggtaaggtcgggggaggcggggcgctgggaaaaagctgggagaagacagcagactggagtgggaactgtgggatgggggcgtcctgggggccctctcagcctgtgtgaccgtgcaccccactccacccaccgcccagaggctgctgggacccctaggcagggtgcagtggcaactgtgccaagtgccccagctaggcatcgggcacatctgcatgctctgacagctgcccaagtggcaggcagggctgtcccctgagggctgcctgtccagcccttccctgcccagagaacccagggcacaggtagcttctgcaaagaaggagaggcacagggtgggggcggtcagtgtgttctggtggatatcactggcttttgacagctggcatctttctgcccctctagtctcagggctctagtgttgcagaggacacagagggcgtggtatgctcagccagtgccccatgccctggtgaaacccctggctgagccttggtgggcactgggcactggtcacggtgggtccactttcagacacagaggcagcactgcccacctggtccctattctaagggtctgatggcccaggaataagtggtcagctgattcctgccatcctagcaaggctgccactcagggaccagtgtggagtactggggaggatgtgggacactcttcagctcagctatgagccccttctgggtccctggataaattacggcatctctctggcctcagtttcctcagctcaaacacagaagcccacacagggaagcaccattttccccttccaaagtccagactgtcagcatgttcagatagtatcctggccccaacacaggggctcccgggctgggggcagaggccctggtacccatggcctggttgcctagttcttgcctgcccagagctgaagaggctggatctcttcaaagagcctgtggaaccaaactttatagggagggcccagggaaagtatgagtcatgcagggactcggagggaggcaggagggaggtggagggcttggcacagggacccagtgggcaggatggaatagaaggagagggtgataggataagagggagaggaggaggctgaacctggaagataccttagcaacctgggtgcccacaggcagctggctatctcagcacttggaggctggcctgggcctctgaggaggaggagggctccacatgtcacagacacagctgccctaagccccagggtggatgcttctcaaggtgacagtcagagggaggaggagaatgggaggtggaatggacagtctcagcaccaaggccatggctcatggcagggcatggcttccagaaggaacagaggatggtggcaggcaggcaagccagcatcccacctgtcatgggccacctgccctgcactgccctccctggtggccctgtgagacccttcctgctttcttgcccacttcctgccctcacttggctgggctgccctctgttcagcagccccaatttgagaaacatttctagagatccagggcacagggacccagcttgcagagcacccagtagcagagaggccccaagaggagctcaggacgccttcccctatattgcttatatggccaggggcctttactcccagaggtcttggctactcaaacaacatggtatactaaagggtcatctcttcctgggcccagcacagggagatgatttaggctggctgcagctttccactgaaaggagccagaagcatttgaattgctctgggacctcaggattctgaactgtgacatggacacactataatagatattcacccaactccctaggacagtgtgcactgagggagatagcagatgggaggcctggttgcaggcatggtcagcaggatctgtaagttgagaagattgatcaccagcctgccgaggtgctgggttgccctgggtatgttgcccaaggtcaaagcctttatgccagggaaagtgagatagagtggccggggccagcctgttctccagctcttggggttgggccagcactgaggagaatggtagtgatgaatgtggtgttcagaagcccaggaaacaccaaagatacccctttcctgggcctgactcagggtgagatgggtggagaggtacacttagggaccaggacccagcagatctcaagggtagcagagcctcttcttccccacagacattcccaggacccgaggcagttactgtccttgccctgtcctcacaggctgactcaggactcccaacctctgggactagcacatttaagtgcactggggctagggacgagagaccccatcttctccttcatagcaaaccaggctgcagggccttgttgagtaacccagtgctgcaagcctctgacgcagcaatggtcagctcttaggaaatccacaacccactgcccagaggctctggagtagagaggaacagccttgaggccagtccctggcatgaggggtcatctacccaatgccagggacacccaagggccagcaatactgggagtcccttgctgagctgtactagttgttcatgcttccacccaagcagggcaaaggttccgctggggtctgaccttcctgggagagggtggtccaggcaggagtgtgctgctgagacgctaaaggggtcacctccctatccgcacacagtgtatggggtgttaggcctgagcagatgaaaggaagaaagggatcctcaaggagaacccgttggcagtgagcgagccccacataccaaacttgaggccccaggctttagccaaccaatgacccagggtcagtctggtctcccaggggagggtgggccagggatcagcactgtggcttccagtggccccacagatgcccttagctgcagtcccagcatgcctgtatatggcaaagccagggacatgcatgccagggcttccgtacagccccttgcttaactcttgggctttgtgagtcactcagacctaggcttaaatcccaagatggccatttactgctctgtgatattggacaagttattcagtctccctgagcaagttcccctccctctaaagtgggaagatgataccacctcccttggagggcaactgtgaagagccaatgaacgaacacttaacacagcacccggctcctcgtgaatactgtgtaatattatggtatttcttggcttctgcaggccacatgccattggctttctatctaagctgcttgctctctacagggcctaatggagtgcccagggcctgggaaggcattggtgagcttcactgggactagattctccaaagcctggagtatgaagggtgcatgggctgcgtccagctacctgtgagcccctgtaggccctcacagtctgaaatgcccatggaggtgcctacaggttctcttcttaaagttgtcaggagatggggacattgcaacttgaaggcaagcctggccctgggtttgcttatcttggtggatctttcttacatctgatctttttacattcggtccattcactttggctggccatcaccaaagacaaagacagtggccaccatctttctcatcagtaatccaataatgaggttgctctgctacttaccaagccaagcaagcccattcctttagcctttctgcgtaggatcttatttcccatggggacctggggtcaaaccctgcctctgctgttcactcatcatgggaacacaaacacacacttcccctttgtctgtgcaatggacaggttgggtgacgtggtctcagtgaggctgaccaccctcctctgaaggttaattccatgatggtgtttccctagcttcagtcatttgcttatcacctttgtgatctctgcagtgtctgcctttcataatatttacttatttttttctttaaatctactcattcttttatttgagtatgtagatctttaaaaggaaactttttatcgctgtcattagtggaaagccagtatcacttgtcataaatagaacaaaaccataaaagaacgtaacaggaaaaccatataagggtattgaattctagttggaaactttagcctgggaaggctcggagtctgaaaactgctgctttcccttgcaaaaaattaaaataaaataaaatttaaaaagaaaaggagattagcaaatgttttagagacatattagcatcaaactgagactttctctttgatgtaatcaggactgaaataattgtaaagggaataacctcttctatatatgattcaatgttatttaatgtaaaaccaaaagtaaaactatgtggtagacgtggccaggcaagctgggctttcattggtcatgacatttgtccgtcttcaagaaggaggtggggcctccagtcagtccccagctacctctattctctagagagtagtcagatggcaccagacctccagaggctgactacctgggttcagatcctgacaccatcacttattagttgtgaggctgtgggcaagatactaatctctctgtgcttccgttttctcatctgtaaaatggagatgatactagtacctacctcatagggtggaaggattacataaactaatctatgtaaaagtgtttagaatgaggccgagcacagtggctcatgcctgtaatcccagcactttgggaggctgaggtgggaggatctcttgaagccaggagtttcaagccaggggaccagcctggacaacataacgagaccccatcactatgaaaaatttaaaaattagctgggcatagtggcatgtgtctgtagtcctagttgggaggcaggggtgggaggataacttgagcccatgagttcgaggttacagtgggctatgatctcattgtcactgcattccagcctgagtgaagagcaagaccctagctcactaaagaaaaccaaccaaacggccaggcacagtggctcactcctgtaatcccagcacttggggaggacgaggcgggtggatcacatgaggtcaggagttcaagaccagcctggccaacgtggtgaaaccccgtctctactaaaaatacaaaaattagccaggcgtggtggcgggtgcctgtagtcccagctactcgggaggctgaggcaggagagttgcttcaacctgggaggcggaggttgcagtgagctgagattgcaccactgaactccagcctgggcaacagagcgagactccatctcaaacaacaacaacaacaacaacagcaacaaagccaaccaaacaaacaagcacttagaatgatgcctggcacagagtagtagggggcaaaaagacttgagctggaccctgaggacgtcttcacagcatagaagcgtgagggtggctggctggagccgggagcctgagctgcacacagtcctcctccaaaagggcctggggagtctgggaggggttcatccacagaagcatccacgggccgggacctctggccagctgcctaggccctccctggggaggcatgctagcctccagctccagccccggatgcacggaggctttcccaaggtgctggaagtgccgcttccttcaatagagcctggcttccccttcccagcccccttggtctgatgtgaatggacacttcctgcgggggcaggtatcaataaacacatctgagatgccctttgtcctcactggccagaaagccccagggcagacttgctggcttcaggccctgagcctatgccttgtgacgcttcctttcttagccttggcagccccagtcctgattgatccatgcctctgtttccctctgcatcttgataaagacagaacatagtcttttcctacagccccagccccagcctgtggaccatcctgggggatggggcctggcggggagctggaaccaggtcccattctctttgggatgtcctgtgagaccaaggacgggaccttttgcatctagtgcagggccagccacagcaggcaattaataactgtttacttgacaacctctagcagctggtcagagttcagctgtttgggtggggcttcctaggcccgactaaccaagcttgggtcccacctccaaaggctagggcgttgccttggcgactgtgggctaagctcacgccctgtcatgaaaaatacacaggcctgtccacacccacacacacccatcccgtgcacactcacaggggtcacccggggcctgctgggtggagagaggtgaaggtcacaaaaactggcattctgagaagatgccaacaagagctcctttcccttgtactgggacagaaacatctgagggtgccacagctagaaatctcaggcacaggtccaggcccaagttctgagcagatgcccctgatggaactctgcatccccacagcctccctgcctgggcctggcccatgttaggaccttggtaaatatttgtggaatgaaagaatgatgttttcagcttgggtctgaggcagagcaggaatgttgcacggagggcgtggaggtcaatgcacggtcagttcattttttctaaatagctgaaggatgaggcatcagccccgcctgcccactggagggttctggagaggtgggtggctcttcctgtctgcagtgctggcctgtccaaggtgtgaatctcagctcagtcacacagcactgtgtggccttgggcaagtcacttctctgagtctgtttcctcatctttaaaatagggatgataccacccatgttgggggtgttatgagaactaaatgtgacaggtataagatgctcagcaagagcctagcacataatacatggtcataagacagctcttccctcctgcccacaggattttagagctggcagccctcaggttaagatgaagaaacggaggctcagagaagggtgggatctgcccaagggcacacaatgagggcacaactaagtggacactgaggccccaggacgttgcaatccaagcgagagttttactcctgagactcaggctttcccaggttcacggcactcttcctctaggtggccctgcctccttacctggtggcaggtggcgggtggcgggcggggggcctgggtcttgacagcagcacggcaactggacggttcccgcctggcacatgctcaggcccaggccccgggtcattttcctgtcccacatgcttttggccaccctggagccaggggctttcctccccacccacttttcccggtctccgacaatgacccaggtgtccaaaaggatctgctcctgacaataagcaacatcctctcgccaaagaattgtaattttagccgggctgcacagcttccctgacaacacacaggcatgtgcacagatgtggagtccgcggggcacgtgcaggcccctctgcgtgctgtgcgctgcccctctcccccatgccatgccttcgagtgtcctcctaacgacaggctgctgtgggccttgtcccagctggagtctcagacacagtaaatggggtgttttctggccttccctccctccccaggacaaacccctgtggacccttggtttgtcctgtccctctggcttgtcctggaccctctcctgtctggccctcttgcttgaaaactgaacatcctcccctgctccccaaacttgaatcctaagacagcttttttctaaaaggggaacaactcctttgggacctgtgggatgggtggccagtgtgtgaggggtggggaggtgtgggggattgagcaatgccccctctcccgtactccctgaactctgctttctctctgatgcacccacccgccgtgcatctcaaggaagttgcctccaggggagaacatcccttccctactgctgcgggtgctatgggtacaatcctggggtcattaaccccattgcttagaccctgagggctcccagcctggtgccctgccccaccttgttcacagggacactcaggccaacaaccacgctagccccacttgtccacacctctgtccacttgagggcccccaaccccacccagctcagctttgcgcatcttgctttggctgccagctctactctgcctgccctgccataccctcctctggcctgcagccccgtgtctgctgagccagccctttggccagcccccaaggtatgtgtgctggtggtaaatactaccgtagctgaagctggagctgaattcagctcccagccctggggtggctctggggtaggaggtgatgtcaggcaaagggagaaaggggcagaagctgggagaggtgctggtgggacctgccacatggcctgctggggaagggggcagcacagggcccccttggggcaggttttgtttcttcctgggagtacgtgggagagccctttccctaggtcctcctcacttctgtttcccggcagagccatagttttgcagctacacccaccccactcaggtgtgaaggggaagtccaggccagcacggacaaaaccaggggcacagccaagcttcctggggctccttttccactgagcctgctgcaggggtaagggcagtgggttagcagaggagagttggctagtccctgcactgccaggctttccctggggaccctgggtggatcatctcctctcttgagtctgtgggtcagatttgtagcataatgggtttgggcagtagagtcccatgccagctagcccaagaagccacactcattcatcacaaactcaaatgtccacaggaccaagaaaccacggtgagagagtgaagcaggccaggtggaattattagggagtagtacggacggactctggcgaactggagtgccggtgccccccaaaagctgctactgagccccagctgacagttgccctgtgggaaagctggtttagcattatcttctgattttctaaggagagctggaagtcagaattttcatgtcaaattcctggtttttaaatgttgccatctcaagaaaattaaaaagattttgaggatccaatgaaatatgtgtgaaggctggatgtggcctgtgggctcccagtttctggccttttttttcatcagtatagtgtctatgtgtctgagtttaattctagctctagcacttgcttgctgtgtgatcatcagtgagttacgtaagttctctgtgccttagtttcttcatcagtgcaatgggaataaaaacaataccttatggcattgttagatatgcccatgaaacccttagcgtagtgcacaacacatgctgtgtcttcttattacggttctgcctagatcctgcgttacctgaagtcccccatgctccaggctttgagatcataccctctggaactttggaacttcagtccaaccactttccctttctgggtctctgtgtttctgcctgaaaaggagacctgtatcttgccaaagaagttctgaaatctctgctcaccctgacaatgactccaaaaatctggggctcccagacttggctctctgcctaaaactccactcttgcagacatgccgtttggggctttggtgcctttggagactctcctttaaacacaagcgccccaggatcggatcacaagttgttatcagtcattcacaccttagcaggaaagactttaaagctggcttctccatcccactgtgcttctcactcctaggaggcacttcttgacttgctgaatgaattagagacctgtctagctcccaagtaccaagcgccgactactcgcatggcacttacagaacacttcatgtgaattattactaaccgttgcctcaactctgccagggagatgttttcatttctgggaaaaacatctgtgagtgaggagtcggggctcagcgtctaagtggctcacagctactggtccagtacaggctggccagctccagaagccccaccaggctgcctccctcctggctgggcaaggctttcagctcttccagtgggtcccagcctgccgccgagggtcctgggctctaagggcagggaaggggcatctgaaggaggatgtggcattatattggttctgggcaatgcccctggctggggcaatgaaaaggatgtatcagtttggattctgtacatagttctaaccctccttccctctctgctagacccacaacagcctgacatgccatttaaaataaaaataccactggccgggcgtagtgggtcacacttgtaatcccaagactttgagaggccaaggcaggagaattgcttgaagccaggagttcaaggtcagcctgggcaacagagggagactccgtctcaaaaacaaataaataaataaaaataacaccaacgcataataattatagctatccctcagatgtctgcagagggcattagagctcacatcttgtgttctcatctttccctcatctagtccttttgcaaccctgcattgtagccaatagttttctcactgcacagaggaggaaactgaggctcatacagttagatagaaacgcggcctctatccaatattctgttttcaaaagctcatggttttgagggtcaacccaattaaatgctggaggattgggataaggcaaagtggaccagggaattgcttcatttgcttggtgaaaaaaaccaaacagaactagacagttttctaagtttggctggaaggacgtgcatggatgagatgacctttcatatactctctgtcccggtccctcagacactgggttttcccattttcacactatcttgcctaggacaccctttctactggctgaaatcctatctatgcaccaagtccaaagactctccctccttcaggaagtccctgactgtccccagaaggctgtttcctccctcctccaagtgccctgagggctggcattggattgcctttgccatggggttctgctgtcgggaatgcaggcctcgtctgctcaaggggaggccatgcattcagcatgcaggtgagatgcagcacctggcccaggccttgcacacgcaggtgctctcttagtgctccctggcaaggatgggaaggcatgttcagtcctaggagtaggaaggggcagaggtgttgatggcccctacagagcggccaaggacaaggagctgctgttcgaaacagccttcctgctccccaacctgcctcccacccaacaggttttgcatatactctactgggaagagggacacacccgactgcatcactgccctccaagtctctccctgccctgtccagcatccaggagcacccctagttggggaagcttctgtgactccccctacaacagcctaggatggagtggggtttgtgaacaaatgcagaaggcagtcttagggaggtcagctgacatgcccctggcctgtggctgggaagtagcagaggctaaggttcttccccgctctggggttgccaggagtagcactggatcagtcaggtgacagggctctcctctctctgagcaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggtgagggcatcctgcacgtgacagcctggcgtgtgtggagggctgcctgtctgatggtgtgaccattcatgacactgtgctgggcagagtgtgaggctgcatgggtaacactggcactccagggagtgtgtgggtgagatggggtggtcaagggtgtgtggagtgtgggtttgtagttagctggagtgatggagagggagggtgtacctggctccatttgtgacagtgagactttttaatgtgtgaggctgtaggtacctgggctgggagtgtgactgctcatgatgacatcatggctgctgtgggtataggcatcagtgggactgattggtgccctggggcatgactcagtggatggctgaatggctgttggagaatatatgcgtgtgtgtgtctgtctgttcaggtgagagtgcaagggcccatggttcggatagaggtgtgggcaccagcgggtattcacatgcccctgggagtggcatgaaaatgggcagggtgagaacatgccagggtgtgtgtgggtgcacacgtgtgcaggctgccactgggccaacactgccgagtaggcactagcgtgagaacctggggcaggagggggacactggcctggacaagcctccctggcctcctgggcctgacacccacctaatggcccttctgtttgttcccacaggcaaagatgcaccatccaactgtgtggtgtacccatcctcctcccaggatagtgaaagtaagggaccaacctcttgccccttttgggttctctgttttcttctgtcctcatcctgcacccagaccctgtttggaactctggcctcatcaccccaagccctcagaaccccccggtcctcctccttttctgctgctgcacatcccttctgcttcctccttggtgcaatccccagaagcccactctccttccatctgctctggagtctctgctcctcttgactctctggagtggctgtgccttggcagtgacctttggccagggcaagtgcctcatgacaggtactgggtgccccaggcagctaagtgccgccctgcccaccagccccctatggcttgggaaggctgggggtcctcttggcctagaattaaactacttcagatttctgtgttctgtgtttctatgttcttcagatgttctctgttgcaggggagggaggaggaagaggttcaggaaggggaacagaactacctttcctgagttcccactgtgctgggcactggactaagtctttttaagtattattatctcagggatatatatatatatatatgtgtgtgtatatacatatatatacacatatatacatacatatatatgtatatacatatatatacatacatatatatgtatatacatatatatacacatatatacacacatatatatgtatatacatatatatacacacatatatatgtatatacatatatatacacacatatatatgtatatacatatatatacacacatatatgtatgtatgtgtgtgtgtatatgtgtgtgtatatatatgtgtgtgtgtatatatatgtgtgtgtgtatatatgtgtgtgtgtgtatatatgtgtgtgtgtatatatatgtatgtgtgtgtgtatatatatgtgtgtgtgtatatatatgtgtgtgtatatatatgtgtgtgtgtatatatgtgtgtgtgtatatatgtgtgtgtgtatatatgtgtgtgtgtatatgtgtgtgtgtgtatatatatgtgtgtgtgtgtgtatatgtgtgtgtgtgtgtgtgtgtgtgtgtatattttctgaaacacggtttcactctgttacccaggctggagtgcagtggcgcgatctgggctcactgcaacctccgcctcccggattcaagcgattcttctgcctcagcctcccgagtagctaggatgagattacaggcgtgcaccacaatgcctggctaatttttgtatttttagtggagctggggtttcaccatgttggccaggctggtctcaaactactgacaaatgatctaactgcctcggcctcccaaagtgctgggattacaggtgtgagtcaccacgcctggcctcaggaattttttttttttttgagaaagactctctctctgtcactcaggctggaatgcagtggtgcaatcacagctcactgaagcctcaaacttccagatgcaagtgatcttcctgcttcattctcccaagtagctgggactacaggcacgcatcaccatgtctggtgaatttttaaaaattatttttggggttaggtgcggtggctcacgcctgtaatcccagcactttaggaggtcaaggcaggcagatcgcttgaggccaggagttcgagaccagcctggccaacagggtgaaaccccatctctactaaaaacacaaaaattagccaggcatggtggtgcacgcctgtagtcccagctactcaagaggctgaggcaagagaatcgcttgaacccgggagtcagaggttacagtgagccgagatcgcgccactgcactccagcctgctgatagagcaagactccatctcaaaaaaaaaacaacccaaaatttgcctggcatggtggcaggcatctgtaatcccagctactcgggaggctgagacatgagagctgcttgaacctgggaggcagaagttgcagtgagccgagatcacaccactgcactccagcctgggtgacagagcgagactctgtcccaaaaaatcaaaaaaatcacttttggtagagatgcactctcgctatgttgcccaggctggtcttgaactcctgggctcaattgatcttcccaccttgacctccaaagtgctgggattacaggtgtgagccaccatgcctagcctcagggaattcttataagaactctatgaagtaggcatcaccatcttctctgtatccatggaaagagaggcctagagatgtatgctaacttgcccaagctcacatagcccagggtagcatagctgggatctggctgcaggcctgcttagctctgcatactcaccttcttcccagcttggggcagtgcagtgggtagcagttagccccccggtgcttgccagagaggtgccctacagggtaagagggcactgccctaagggtgcctggcgctgagaggttgggtgagaatacccagcagcttggagacaaaatgcaagggcacctccctcttctgagaagaggtcttggcttccacacccctctataccctgtatgtgtcagacatccagtggggaccagcccctgctaggccctggagatacaaaggcatccaggaggacatgcacgaggacctaagccggaatggggatcagctaaaccacggacccaacaaaacccaactcaaaggctacagtgactttttactcagctacccttttttcaaaccaacaaacaggccaagagcaaaattagaacatgcattttggtcagagccatgttggtcaggctggtctcgaactcctgggctcaagtgatctacccgccttggctccccaaagtgctgggattacaggattgagccactatgcccagccccagtgccagcctcttaatgttatccttgggaagtaagagtgtagcttgactatgaaataacatgaaagtacaagttaacctgaggtaggggaatgagactagagaagttggtgcccaaggagctcctgcattgctgaggggctgtggtttctcagtgagctcagagaaggggtctaggcagctcatctccctttgaacttcttcccaccccccagcgcagcagaatgtgctgtctgctttcacccagcttcctccctgggaaaccaggcagcccaaccctcagcagccgaactccctcctccatatatccccgtgggctaccaggcaggccctggacaaaggccgcctgagcaggccaggcccctcccatcccaccctgctgtgtcagggcctggcacactccttagtgcggtgtcggcagctacctctgccagcgcctgatcaccttcccaggataagcctggctctggatggtgagtgagtatgcctgccttcccctgtgagtgccagcccaggcactggccacgcttgggggaaggggtggggaactgtggcgaggctgagctctgcagagatgcctacggcttcagaaagcagctggatccacagacttgtccccaaacctctgcgcccctctgccccagcctcaactcagcccagatcgtaaggaagcctcaggctctcaaagtgaaattaagtcctgatctgatagagggtccacataggggaaatctctacctggggatagaagttaggcagggatatctggccaagctcaccctccaaaggcagatagggaacaggtatcaatgagcacctggcaaagctcacaaaatgttgcttactagccgtccagaggagacctgctttgatcactagaagagagtgctttgcaactggcttctcaaatattgcccacaataaggtcctttgatgggggttttgaaatactgaggtgtctgggttatagaatgtctttactttcaatattccacgtcaaaatgcagccttgctaagatctgcagggaacctgctgtaatgtggagcggaacttgctttgtaattagcatagcaactgttcctgtaccagtgggtacttctaaagtgactgaaaacagtttgttctcatttgcagtatgaacaaacctcctgaaagcttgtttacgctgtcggattgtagagcaaaacaaaaacagcctttattcccaaacaaatagcggaaaggcaacatttagaccacagccatttacctctcagagctctttggggcgaagttgacactgtgacaaggtatcccagcccatcttttggccctgggaaaggctaaaattgggaaggaaatgcgtttatgttggttgtggttctgagggcacgtctgttcccagctaaactcctgcagtcagcagatgccctgaaataaatcaaacctcctcatgctgttgggacagcgaagcttcgtgtacacctttttggagggcaatttagcaatagcctaaaagaaaatgcacatactctttggctcagcactttgaccgctaggaatttactacagatttccttgctgagtgagccaggctgcgtgcacaagttcattgctacattattagttatgctgaaaatggaaacaacatgtctaccaacaggggactgcttcaataaatttagtgggagccatgtgataaaactctaagcagaatgaggcaggggagacagagagatgtccaagctgtgctcagtgggaaaagcattgtcatatgatgctgcgtctgctgtatttgcagggaatataactaggaccataacacaaaaaccggcacacagggatgatctcttcagagggggtcttggtacaaggggaggaggagattcgaatattttttaaacttgtactttttttggtagtttaataagtttaaaattgaaaaacattgtacaaggattcacgtttttctagttctcaccccgggtgtttctcctgtgacttgtgtggtgagatcaaggggttctagaggccccatcccagagctaaggagtctctgggatgagttggggctttttatctattatgataaaacatatataatgtaaaatttgccatttcaaccattttaagcctacagtttggtggcattaattacattcacaatgtgcaaccgtcaccactgtctattttcaaaactttcatcacttaggcttcttttgaccttgagctctgtggcatggggtctgcgaaggccctgctctcccttttcagagaacaacctgtagccaagggtgttccagctgtaccttgtgggctgggatgaggactctgttccctctcttgcctggagctgcctgagctgtaggtgacaggtcttgtttctgagtgctccaggggcatagggcggcaggcacagggctctctttgaaaggagaaccgccttatcttccatgcctctgtaggttgctgggggtctagctgtgggactctggggaaaggcgggtctcctgcttcctggccttccctctctgagcctcagtttatgctcaggaggagcaatgggaatggggcttcaccttggctacctctctgccctttcagacatcacggctgcagccctggctacgggtgcctgcatcgtaggaatcctctgcctccccctcatcctgctcctggtctacaagcaaaggcaggcagcctccaaccgccgtgagtattcctccctgcctggggtgggtggacggtgcgagtgacctgctccagcccccagttcagcccctgggattcgcaaaggcacgatgcaggcacaattccttttcatttgagagttgggagcagctgcacttcccgccaggagctgggcgaaatggccgagagaaaggaggcatgccatttccgggggccaagtgcccaccagcccctttggctcccaggcagtgctggctcggcactcaatacatgtcttctgaatgaatgatcatatgcagtagctcaagttgctttataaaagcaagttgctgccactcagagatccttgggggacctgtttaaggtatgggcgtgcttgttttgtaattagtagcaattgttgggacaaaaaatgatctttggaatatcagaagtggaaggggtcttacagacaacttagctcaaccctttctttttccagatgagaaggctaagatcagtggggttacataactgactgaatgttacgtaacttagtaagtggcagagctaggactcaatctcagagctttcaacgcatgctctttccagggaatagaagtccaccatataataaaaatgctctcacttactcctcattgcaagtccaagaatttggtcctaccattgtccccattttactgatgggcaaacggaggcacagaggggttaagtaacttgcctaaggaaccacacagcaaataagtggtggggctgggctttaagtcatgggcacaaacatctttcacctcccaccctggccaggtgacagtgccccttgcctagttcctgaccctgcccttgagtcttggttagtctgagtcctccaagaaggggctagggagttttttacccttgcctcccctccctggcctcttcccgtctgcctggctacagaggtaactgagaaaggattgctctggtgccaggtggcttttggctcgcaacttatttcctgtggccggcccttaacaacttgtcatccctccctcccctcattcccgggggcccccacgtgaagccccatagtgggtcactcgggggctgtggccacctcacccttgctttcagaactcccctattcctctcctagaacacaccacaacctacctgcaggaatacccatggctgggggtgggtgggggcaggtaaagggcttggaacagaagagcaacgctgggcagcagggcagggggagcaggtgttgctgtgccctccctggtggaaggctggcccagagagcctgctcaggaatgaggcactctcaggaaaaaaagaaaaggaaagggctgggagccttgaggacggcagtttgctggagaggccaacaggtgtggatttccatcctgctttggactgagcctcagtttccccagctctaaaatgggaccaacaaccctcaccccaaagggtggcacagaggatgagatgagggaatacccgtgtgcacctgcacgaagcctgacccatgagtcggctgtaagcaatagccatggtttgaatagatttcaggaacttttgggtaacttccctgtgtttgttctgttgttgtgcccctcccccaccatctgtttccccatcgtaatcagcagtaaatctccttaaaacgagaagcatctgtgggaggacatggggtgctgcatgaaagagggaagttggggtcactgcatctaattggtggccagtttggggggtggggtgtcccaaggctgaggcaagcggcagcaacttggatgagaagcagaaagtgagtgaagtggctgggaagtgatcggggacttgcaccttgtaaggtttccctgagagatgtcccctagaatgccaccctattaggcaatgtaggggataggacagagaggaccaggagccctctaattaggaactgaccttaaacactcccacccagtaagtcatggctaaagaccagaacctggcaaatgttcaaacaagagacaccagttagcaaattcaagagttgacctttgctcgatacttaaatcctgaaggtctgacactgtgtaagtcaagccataggagaaagcgctggctgcctttggtctcctgatggcagatagcgttcttacactcctggaaaatgcagatagagtttcatttatcagtcgtcaaaatgggcccctcatggaggccccatctgctggacagacacgcagatcgcttgctggacagcacccatgtgaaaagaaatggagtccggagctgtgcagggccctcctgggctcgctcctgttccctgcagggcatctgccagcaggggcagggatgttgtatggggaagccttcccttccatgaccagcttctctgtctgtctgtccctaggtgcccaggagctggtgcggatggacaggtaaggcccatggagaccttcttgagaaaacttcctgggccggctatccaggaagagatacttctgtgcagtaggggccctgtttagctgcctagagcagctggtcagaagagcctctgccatctgctgctgaagcctgcacatctgtgcagattggctgttctcctgccaccccgactcagcaggctgagctctgattctgctcagatgtgtcatgcacccaccttcgggtctcagtggtcagcctgggccaggatggggacagggaggaagcactgtctggggcagacagtgagacatgcaaaggaggccagcgggcccagccccagccacagcccttgagctgtgcctcctgcccgcagagaactccaaggagaaagctgttaggccgctgcaggccacaagggcagaggctgaggggtcccagagtggtgcagtgggctgggtctaggggcagaggggatggggactgtgtattggtgtgctctgggcaggaagctgccatgcagcctggcctggagggtgtgttcagggaacccaagttcctgccccggtacctgcaacaccaaacacaaagctcctctaggtgtttgaaagggatgatcttcaagacaggttgaaggaagtcctgcttgcaactcatctagaatctaagagttgcaggggtcttcagaagttatcccactcccaactgggaagagaagagaacccctcccctcagctcaagacaggctttggggatgttcgatcctaatgccatcaactctattgaccaaagagaaacttgtccccaaattcctgaggctgaagttctagaagtgtctgtgatttttggcttcctggctgtgcccggggttgatggtcagaccacagggaggagctggggtctgttctggtgggccctgatgccctcagctcaggacaggtgggcaggtgcagcccatggcctttgctctgtgggcctggctcctgccttcttgcttggagatgctgctgaggcttggggatggggatgtaggtgagagaaagggaggagagaaaaactgggggcagggagggcagagttcacgctccggacagcacagatgaccttccattctggttctgtggcagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctgggtaagtgtttcctgaccttcacagcacgatgacctgtaaggtcatgacctcatggcctgcagggcatcggcctcactccctgccctccctgaagagttccacggcctcacggggtggggttgagggtgagggacagaggggcccccattcacctccctgaagagttccacggcctcacggggtggggttgagggtgagggacagaggggcccccattcacctccctgaagagttccacggcctcacggggtggggttgagggtgagggacagaggggcccccattcacctccctgaagagttccacggcctcacggggtggggttgagggtgaggggcagaggggccccgttcactttgcttctccttttcttgcagaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggccgccttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgtcttgtccaccctgggacacttctgagtatgaagcgggatgctattaaaaactacatggggaaacaggtgcaaaccctggagatggattgtaagagccagtttaaatctgcactctgctgctcctcccccacccccaccttccactccatacaatctgggcctggtggagtcttcgcttcagagccattcggccaggtgcgggtgatgttcccatctcctgcttgtgggcatgccctggctttgtttttatacacataggcaaggtgagtcctctgtggaattgtgattgaaggattttaaagcaggggaggagagtagggggcatctctgtacactctgggggtaaaacagggaaggcagtgcctgagcatggggacaggtgaggtggggctgggcagaccccctgtagcgtttagcaggatgggggccccaggtactgtggagagcatagtccagcctgggcatttgtctcctagcagcctacactggctctgctgagctgggcctgggtgctgaaagccaggatttggggctaggcgggaagatgttcgcccaattgcttggggggttggggggatggaaaaggggagcacctctaggctgcctggcagcagtgagccctgggcctgtggctacagccagggaaccccacctggacacatggccctgcttctaagccccccagttaggcccaaaggaatggtccactgagggcctcctgctctgcctgggctgggccaggggctttgaggagagggtaaacataggcccggagatggggctgacacctcgagtggccagaatatgcccaaaccccggcttctcccttgtccctaggcagaggggggtcccttcttttgttccctctggtcaccacaatgcttgatgccagctgccataggaagagggtgctggctggccatggtggcacacacctgtcctcccagcactttgcagggctgaggtggaaggaccgcttaagcccaggtgttcaaggctgctgtgagctgtgttcgagccactacactccagcctggggacggagcaaaactttgcctcaaaacaaattttaaaaagaaagaaagaaggaaagagggtatgtttttcacaattcatgggggcctgcatggcaggagtggggacaggacacctgctgttcctggagtcgaaggacaagcccacagcccagattccggttctcccaactcaggaagagcatgccctgccctctggggaggctggcctggccccagccctcagctgctgaccttgaggcagagacaacttctaagaatttggctgccagaccccaggcctggctgctgctgtgtggagagggaggcggcccgcagcagaacagccaccgcacttcctcctcagcttcctctggtgcggccctgccctctcttctctggacccttttacaactgaacgcatctgggcttcgtggtttcctgttttcagcgaaatttactctgagctcccagttccatcttcatccatggccacaggccctgcctacaacgcactagggacgtccctccctgctgctgctggggaggggcaggctgctggagccgccctctgagttgcccgggatggtagtgcctctgatgccagccctggtggctgtgggctggggtgcatgggagagctgggtgcgagaacatggcgcctccagggggcgggaggagcactaggggctggggcaggaggctcctggagcgctggattcgtggcacagtctgaggccctgagagggaaatccatgcttttaagaactaattcattgttaggagatcaatcaggaattaggggccatcttacctatctcctgacattcacagtttaatagagacttcctgcctttattccctcccagggagaggctgaaggaatggaattgaaagcaccatttggagggttttgctgacacagcggggactgctcagcactccctaaaaacacaccatggaggccactggtgactgctggtgggcaggctggccctgcctgggggagtccgtggcgatgggcgctggggtggaggtgcaggagccccaggacctgcttttcaaaagacttctgcctgaccagagctcccactacatgcagtggcccagggcagaggggctgatacatggcctttttcagggggtgctcctcgcggggtggacttgggagtgtgcagtgggacagggggctgcaggggtcctgccaccaccgagcaccaacttggcccctggggtcctgcctcatgaatgaggccttccccagggctggcctgactgtgctgggggctgggttaacgttttctcagggaaccacaatgcacgaaagaggaactggggttgctaaccaggatgctgggaacaaaggcctcttgaagcccagccacagcccagctgagcatgaggcccagcccatagacggcacaggccacctggcccattccctgggcattccctgctttgcattgctgcttctcttcaccccatggaggctatgtcaccctaactatcctggaatgtgttgagagggattctgaatgatcaatatagcttggtgagacagtgccgagatagatagccatgtctgccttgggcacgggagagggaagtggcagcatgcatgctgtttcttggccttttctgttagaatacttggtgctttccaacacactttcacatgtgttgtaacttgtttgatccacccccttccctgaaaatcctgggaggttttattgctgccatttaacacagagggcaatagaggttctgaaaggtctgtgtcttgtcaaaacaagtaaacggtggaactacgactaaa

SEQ ID NO: 74 - DNA, 32743 bp, Homo sapiens
cttgtgggaactgtcagaccagctccaggcgctggggctttctcagtggccttgtcagctcacagcaggcgttaacagcctctaattgaggaaactgtggctggacaggttgcaaggcagttctgctccccatcgtcctcttgctgactggggactgctgagcccgtgcacggcagagagtctggtggggtggaggggctggcctggcccctctgtcctgtggaaatgctggggcaagtggtcaccctcatactcctcctgctcctcaaggtgtatcagggcaaaggtaaggaggtcctacctggcgtggggcgagggagggactaggagctgtgcccctcagggagatcagagccagagcctctgcttgtgccacatacacagtcatctggaacttgactccgagcagctcctgacagctctgacagtctaaatcagacaggacaggctggcagtgcactgggaggtctgtgagaggggtatctggccctgccaccagcaatccaggaagtcttgggtgaggagattccttcccactggcttcaatttacccttccgtgtagtggagagagaagcctccttccagccgcctgtaaagatgatgaaaattgcatcctccaattgtggcatgagagaagagaagcagtcccaaggaagtgggtggttctcgagctcagagacagatggatggacccctgaggcaggaaagctgagcccagggaggggagggcgaggccagcagccaggaagaagctggaaggcatggtccctcatctccccggcttcttcagccatccagatgccacaggagcctggaaattattagggacatgcagggttggggcagaagaaggagacaatatgaggaagctccacagcaaacctaaagctgtcagccaggcatggagccatctaacatttactcctggggatcccagctgagggctgctcccctctttctccagttctggggtccaggatgctctgaaacctggatcccgcatttaatttaattgaattaatttatttatttcatttttaatttttatttatttatttattttttgagacagagtctccttctgtcacccaggctggagtgcagtggcgtgatcttggctcactacaaactctgcctcccgggttcaagtgattctcatgcctcagcctcccgagtaggtgaaattacagacgtgcgccaccatgcttggctaatttttgtatttttagtagagaccaggtttcaccatgttggccaggctggtcttgaactcctgacctcaggtgatctgcccaccttggtctcccccatccaaagtgctgggattacaggtgtgagccaccatgcccagccagggttctgcattttagatcagtgactctgcaggggcttcacggaggtggagagcgtggaattagaggagggtacactctgggcacaaagaggggaaactgaggcatagtgttgtgtgggttcagggccaggtagaagccccatatgcaataaagtcccatgcccaggtactcaattcagttaccgagtccctgagcattcttgtgtccttcaggaagacacagtcaaggctcaggtggactcaacatttgtaaggatgcaggcagcctagggcagagcatgatgaggaacagggagcagggagggaggagtggagcctgcagctcttgtgggtgggttggggggcctagtggcccaggattctaggcaggagagctaggttggaacctggtctaaggatccttgaatgcagctcagacagccgaaggaggactgatgggattggtgcctggctgtggggatgagagtaacagagaagctgaggttatgaccctgaggtcatgagcctgtgtgacagagggcaatgctccctccacccccattcccagggcttcagcaccatagctgggcttggctatgccggcccttgcacggtgaagctggtgagtgacttgttaggcacagggagggatggacttgggtcttcctgagctgcttcctcctccatcctgtgtctatagggcaggcctggcataagttgactgaagctgctctatttctttaatttttaagctttttagtttgaaataattgtgaagttccagggaagctgcaagaatagttcaaacgattcttgaatttctttcatctagattcaccaattaacattttatcacatttactttatttctctttctctagctgtatgtatatgtgtgtataaatgtacaataatttttgctgaaccacttgagaacaagttgtgacattatgtccccttactcctaaatattttagcacttatatcctatgaacaaagacattctcatgttactacagcacaattgtcaaattcagtaaatttaacattaataccatcaaatatgctttccatattcacatattaccaattgtcccaagaatatgctttattttttttttttgctgacccaagatgcaatcaagatcatgtattacattcagttgttatgtttctcatgttcagtctatgaccatactttaacctttcttcatctttcatgatattgcattcttgaagaagacaagccagttgttttgtagagggttccttaatctgggtttgtctgatgttccctcatatgattcaggttatcatatgcatttttatttattttatatcatcattattattattttttagagatggagtctcgctctgtggcctgggctggagtacagtggtccaatctcggctcactgcaacttctgctcccccgggttcaagtgattgtcctgcctcagcctcccgagtagctgggactacagatgcatgccaccaagcctggctaatttttgtatttttggtggagacagggtttcaccatgttggccaggctggtcttaaactcctgacctcaagtgatccacccacctccgcctctcaaaagtgctgggataccaggtgtgagccactgtgcccggcctattattatttttcaagagaggatctggttctttcacccagactggagtgcagtggcatgctcacggctcactgtagcctcgacctcgcaggctcaagccatcctcccacctcagcctccctggtagctggaactagaggtctgtgccaccatgcctggctaatttttttttttttttttgtagatacagggtttccccatgttgcccagggtggtcttgaactcccgggctcaggcgatccacctgcctcagtctcccaaagtggtgggactacaagtgtgagccatcatgcctagccatcatatgcatttttaaaattattttttctttaaaaaaatttttttctgtgcccattgacagcagatattatatgcatttttgacaggaataccacaaaagtgatactgtgtctttttcagcgcatcccatcaggagtcatatgatgacagtgaaatttaaaaaaccactttgtttactgaataatttaacaggagtactatttatgtaagatgtgcatataactcttgagcattgcgaaattcttccaaagacttcttctttcatgcagagtaaaagccatgcattttacaatggtgcgtgacctggcgtccaagacccactcctctttgtctctcctcttgctcacagcatttcagccatgttgcctgctggtcctggacctcgctctctgttgtatccacagttttctctgcctgggatgctgctcctttgctggctacatggcctcttccctcaacccctcagagttttgctcaaatacctccttttcagtgatgccttccccactgaaaatgtcagcctgccattctgcaaactcttagctctctctccacttaatttttctccatagtcctcatctccatttatgttccatcctgtttacttatgtttttcattttctgtctcccagtctcctcttcagccccctagactgtaagatccttgaggccagggcttttgtctgttttgctcaccgttgtctcctcaacatctagagcagtacctgccacaagtcaaccctcagtagatacttattttcacaatagcagccccctctctgttcccattctttctctggatatattttgaatagctctgaaccagggctattgaggattcagtggcaagtaagtccagggcccgtttgttcagagagcttgcgctagattgcctgagtcactgttactacagttgtgattagtgcctggtgcagtgccaatgcagtaggtgttcaaaacatgtttgttgagtgaataagtgaattattttcaggcatcttaacgggcagcctgggatgttttttgggttagacatattgggaaggagggatcttcaaatcattgcccagggaataggcctgggccctaaaattcattttagacccaaaattcaggtttcagttgtccgttctgaggaaaccccaaaggacacacaggctggaggctatgaatccccagatgctttacagcctgagttgagatctgctggacaataaaagggcacaggtgacaccttatagattagctccaagggttgccagctgtttgcgtagattgtgttggaactgtcacttctcagggagtggtgtctaactgcgactgctttggctgggatccaggcaagctgtagaagggctggagtcgtttttgctcttctcttcctcattgcacctcccctccaacaaagggtgaatggcaaagtagctggacacagaaaagagattggaattcaatgtaccctgggctacagcaccatccagaaaggaatccactgaaatcacttcaaggagagacagggcatgtcttgtttttttttttaattttttatttttatttatttatttttatttttttgtgagacagggtcttgctctatcacccaggctggagtgcagtgatgtgatcacagctcactgtagccttgacctcctgggctcaagcaatccttctgcctcagcctccttagtagctgggactacaggcatgtatcaccacacttggcttatttttaatttttgtgtagagatggggttttgctatgctgcctgggctggtcttgacctcctgggctcaagcaatcctcttgccttggcctcccaaattactgggattacagatgtgggccactgtgcccagccaggccattgtcttcacagacaaacctctcttattgaagtgcaacatacagaaaagtacacaaaattacaaatgtacatctcaatgagctattgttaaatgaacacactcttgtgtctaccacatgttctctcccattcattacttcctctgtcttccataaatatagccacaattctgacttctaacatcacagatttgttttgtccgtatatatggaatcaaacggtatgcactcttgtgtctgactacttttgctcaacatcttatgagatttatgtatgttattatttgtagcagatcattttcatggctgtatagtattttatcgcatgactatatcatagtttattcaccttttctattattgatgaacctttgggttgctttcaattttgtttttgctattataataatgctgtgatgagccttttgtgcatgcatgtctgttgggtatatctctaggggcagaaccatggagtatgtgtacgtaactctagcagatgctgtcaaactgttttccaaagtggttgaaccaaatagtgcatgagagttccatgctgctttggggccactggcttttggttctgaaggtctgcagatggaaaattaaattgtggaaatgtggagcttggcaagaggccaaaggcaagggaattacagctctgtgatttctctggtatcctgcatgaaattctgacaatagagtcatttttaggagttatgtgagatgcattgttgaattaattaatttaaacggattcatgaagcccttgcttgggttgttcattttgctgttgtgacgtttgaatttcttgtctattctgcatattagttgcctgtaggattcatagtttgcaattttttttcctattctattggttgccttttcactctgtgaattgtttcctttactgtacatgatttttttttagtttgctgtaataccatttgtttattttgcttctgttgcctgtgcttttgaggtcttattcataaactctttccccagcccttattatgctccaagaactatgcaaggttttgtgggggaaacaaagatgaaacagatgtctattctacccttaagaatctttcagacagaggaaaatgggtatgtataattacaactataagggaagatggaaatgctatgtgtcattaacaggcaagatacatttagaataaaaaaggagctaagaagatgaagattccttctaggtaggaacactggggaactggccttgaagaataaataagagtttaggaggtaggtacaaagtagaaggacaattgaagcagaggaaacagctcagaaaagccagggttgcatggggtttggatgggaaacaggaaagggagatgcacttgttatcatggagaaacaatatcacatatgagatgatttggttaactgatgcaaagagtgggacttgggctaggtgagttttgacagaggtaagggagttgcattgcctgaggaagagagttaatatggtcagtatgaagctaaatagagaggaagaaagaaatgggatgtgggccctataggatactttatctatcttatgattttgccctgactagagctggattgccccagtacttttggaatctcactggactctgttcacttagtccccagcaggtacatcttttgatgccttcaccccaagcctggtagcacaagccctagctgagaaaaccttaacatctatttgttggctggtggaaattccacttgctctgagaccctcccgtgctccttctcccaggtgctcaggccccacaccttcctccgactggcaggtccaggttggaggaagctgagctgactcagagctctgcacatgggctcagggctgagcgggactcactgctggatcagattgtctccttcaccatcctctgtacttgtctccttgaccatcctctgttcttcctgaggctgcagtggagttaatcatctgccctctgccctccctttcagagttactagttcacctcatccgttcttaaccacaggaaggtggcccccaaagctgctgagcagtagcaacagcagtggcaggggcccgggggccttcctggactgtggcctctttcctctaaacaattttcacttgttgggtcctcctctatgcctcactaaatgtgtgagaacttgtgttgaagttatgttttcgtagtagcatttcatctcccctatctggtgtgtgtacccctctgggacagaaactgaggtctttctgtatcagtcacaataccctggacatagtgacttgtctacttgccttttcaccgtatctgctttgcacccctgccctggcacccaccccttccaggccgtccatggaaactcattccaaccatcttcctccttcccacactggactgttgggggctgcaggagaaaattcagcaacaaagagcagctacagattcgtaatctccaaccccagctggactctcagtgtcctgggaatcctcatttctggcccacagcttctcctgttccccaaaaggtgggagaattccacaccttcgtcatctctttcaaggccctgttccactatctcagcctccacaaaccaacaacctccttctttaagaaaacagaagcacaagttagggattccaccaaccttgccaacaagtctccagtgtcaatgtacttcatctactcctgtaaatggccacatttgcctctgctgagggcaagagtgttcttgccctgtccttgaccaatactcccctgtgtgctcagggcaccagagcttctttcagaagtcacctgggacctgctgtctgtgaagacatccctcatctttcttcagctgctccttttctgtgggcttcctacctttagtacagtttccttccagttgaaaaatcaaaacaacacctggtgttctctctagctcctttttatttgcagacaaaccagtcttaaatgtataaactaatataatattacataaaaataaaatataacggcctaatttttaaaaagaccccaaaggcagtatagcatgaggactgtagatcacacatttcattctttaagtatttagaagtctatggctgggagtggtggctcacgccagaactttgggaggctgagacgggtggattacttgaggtcaggagttcaagaccagcctggccaatatggcgaaaccctgtctctactaaaaatacaaaaaaaaaaaaaagaatagctgggggtggtggcaggcacctgtagtcccagttactcatgaggctgagacaggagaatcacttgaacctgggaggcagagattgcagtgagccgagatcatgccactgcacaccagtctgggtgacagagcgagactctgtcttaaaacaaacaaacaaacaaagaagtctagacaataacttaaccattttcctgtgtgattcctattcagttttataatagcagagaacaaccttcttctacatagcgctctacattctgatctactggtggattatatgggagtttacgttatttttcattacaccgtatatttatatttaagtaccttttaatacttgtgctacctctcacaattttataaaagataaaaataaagtgaaaccaccactaaacacctgaaaattaaactcatgttccatcaccccattctccaaacctgctccatctttaccagacccataagccacacgtgtgttttgtgttcccttaaccatgctactgctgggtccataatacccaccttccctgttcctttctgcatacaccaggcaggccttggctttttctttcaatggcagctcccacccaccgcctctgggcagccactcctaactctgcagggcagaggaaaacatgctttccttatgcttgcctcacaccctgggcacacctccatagcacattccatattgcatttcagttggctgttttaggtctatcttcctttttcacttttttttttttttttttttttttttaggcagggtcttgctctgtcacccaggctggggtgcagtggtgcagtcatggctcactgcaacccctgcctcccaggcttttctgatatttagctaagagttgggtttagctgagatgagtgaggaaatctacaaattcacttgctatggtaatgtttccacaatgggcaagtcatattttgcttttatcaaagtacatcttagttaatagtcagaacagttgagtgagaggtagtcattactctttttctgcttttttaccaagatacaactcacagctgtgtgcacaaaatttaaatcaacagcttgatgaacttttatatgtgtaagtacatatcaaaactacccacatcaagatgtaacacatttctagcacccagtcattcctttttggcccttcaagttgataacccccctcctgcaagggtaatcacattctaacctctctcaccatatattagtttttccagattttaaactttatatcagtgaaataattcactatgtactttttggagtctagcttcattaatactcatcattgtggtgagatccatccacattattgccaggaaaagtagcttttctttttcattgctgtgtaatattccttataagactataacacgatttatttgctcatctaatcgtgatagacatttgggttttttctcattttgagttattatgactaaagccattattaacactcttgtacatatttttagtggatataaacaccagattttctttttttttgagacggagtttcactcttgttgcccaggctggagtgcaatggcatgatcttggctcactgcaacctccgcctctcagatttaagtgattctcctgcttcagtcttccaagtagctgggattacaggtgtgcactgccacgcccagctaattttttttcttttttttgagatggggtttcaccatgttggccaggctggtctcaaactcctgacctcaggtgatccgcctgcctcgacctcccaaagtgctgggattacaggcatgagccaccatgcctggcccagattttcttgtgtacaaattcttctggatcaaagggtatatgtaagtttagttttagaagataccgtaaaatagttttccaaagtgctggtaccaatttacactctcactagcaataaatgagaatctcagttgctcccatctctgtcaacccttggaattttcacatttatttatttacatttattttcgagaccaagtctcagtctgtcacccaggctggagtacagtggcgtgatcttggctcactgcaacctctgcctcctgggttcaagcaattctcctgcctcagactcccaagaagctggtattacaggcgccaccaccgtgctctgctaatttttgcatttttagtagagatggggtttcaccatgttggccaggctggcctcgaactcctggcctcaagcgatccacccgcctcggcctcccaaagtgctgggattacaggcttgagccgcttcgcccagccttcagacctttaaatgttagctattttggtgggaatgtgaaatctcattattctctgataactaatgttgttgggcacccttatgcatgcctattggctattggatattctctttcctaaagtgcctgcccaagtctgttgctttttttgtcattattgtcatcagtgtattattgatttccagtctattattgtcatcagtctattattgatggaattctttatatactctggatatgagccctttttcaaatgtatgtattgcaaacattttctcccagtctttggcttgctttttcactctctcaatgttgtctttcaccaaacagaagttctaagttttagtgaagtccaatttatcaatattcttttatggttagtgatttatttttgtgtgtgtgtgtcctgttaaagaaacatttgttgtctgggtgcagtggctcatgcctgtaatctcagcgctttgggaggccaaggcgggtggatcacttgagcccaggagttcaagacaagccttggcaacatggtgaaactctatctctaccaaaaatgcaaaaattagccagtctcataatctggtctcaaaataaacataaaaatagattaaaatgtaaaaataaaaaaggaaacatttgtctatctcaagatgtagaagatattctcttgtgctttttcctggaagctttataggtttagctttcatatttaaatttatgatttgttttaaattaatttttgtatatgatatgagggagatatcaaggttttttttccttatagatatcaatttgaccaagcaccatttattgaaaagatcaagtatgtgttggtttgtgtgatattgtgaaatatatatttggttttcaacctcctttcctggcatacaattcctaaaatttttagaaattccgaagtgatgtctttttgtaggctaatgaggtgaccgatggctggcagcctgtaggcagcttcgggataggggccggtcaccagaaagaccaaggcagggttggaatattggactctgagcccgtccccaaccttcaggaaaaggagagggattgaaggttaagttgatcaccgatggccagtggtcaatcattcccatttattgaggcctccataaaaacccaaagaacaaggttcagagagctaaacatgcggaggttcctggagggtggcacgccctgggaaggcatggaaactctgtatcccttcccctacaccttgtcctatgcatctcttcataggtaccctttgtaataacctttataataatccagtgaatgtgtttccctgagttctgtgagccatctagcaaattaattgaacccaaggagggaataacgggaaacccagtttatagctagttggtcagaagcgcaggtaaaacaatctggagcttgcagttggcatctggtggatatctacaggtagatagtgtcagaattgaactgaattagaggacatccagttggtgtccactgaagagctgattgcttgcttggcacgtgggaaactccccacacgttggtcacagaagtcttctgtgttgattgttgtggtgtgaaaccagaggaaaaacagttagtgtttttcccacacacagggtctatttctagactattatattccatcgactacttttcaatccttgcaatactggaatgctatcttaatttctgaagttttacaatatatcttgatattaggtagtgaaaaccttctagctttgttcttcatcaagattgccttggctattctatgtcttttacattttcatataagttttagaatcaacttgttaatttctataaaaataacctgcaataatttttattggaattctattgaatctataaattaatttaggaagaattgacatcttagcaatattaagtcttccaataaaaaccatggtatagtctcctgtttatttagctctttaattttttctcagcaatcttttgttgcaataggtgtataggtcttaaatatttcttcttgaaattatttctatatattttatcttttttgtgctgctgtaaatagtattgttttcaaaatttcatttttatctgtttgtactaatatatagaaataaaaatgatttttgtatattgaccttatatctagcaattttgcaaaactgacttctacactcaaataatttttcatatagtcctcttggtttcctatatacacaggtatatagtttgtgaataatgacagtttcacatattcattttttttttgagatggagttttgctcttgttgcccaggctggagtgcaatggtgccatcttggctcactgcagcctccgcttcccgggttcaagtgattctcctgcctcagcctcccgagtagctgggatttcaggtgactgccacccgcctggctaatttttgtatttttagtagagatggagtttcactgtgttggccaggctggtctcgaactcctgacctcaggtgagctgcccaaagtgctgggattacaggcgtgagccactgcgcccagcctcacatattcatttctaatttttattccctttgactattttccttgttttgttgaactagccatgacctccagtacaatgttgattaaaagaggtaattatggaatcctttttctgttcctgagtttgcagggacatggatgaagctggaagccatcgttctcagcaaactaacacaggaacagaaaaccaaacaccacgtgttctcactcaaagtgggagttgaacaatgagaacatatgggcacagggacgggaatatcacacaccagggcctgttagtgggtgaggggcaaggggagggaggcattaggacaaatacctaatgcatgtggggcttaaaacctagatgatgggttgataggtgcagcaaaccaccatggcacacgtatacctacgtaacaaatctgcatgttctgcatacgtatcccagaacttaaagtaaaacaaaaaaaaaaaaaagaaagagatgggtacaaatgtgaatgtttgttgttttgaacaaacctctccaaccatgtttttcctctgctcccacatcaaaataataacaatcatcaacatagaagacttctgtgaccaaatgcagggaggtggatttctcctcacagcaaactgaataatgtattctgcagtggacaccagctgggtgttctccaattcagttcagacactaactggagagagtgtcagaccacagaggctgggggctcagtccccaacaccacccctccaccacaccagttctaagtctgggcctccagaacttcggaccaaccagcttccagttggggttctcacaaccccctccttgggttcaattaatttgctggagtggctcacataaaccagggaaacatttatgtttgctggtctattataagagatattacaaaggatacagatgaagagatggcatagggcaaggtatgggggaagggacacgaagcttccatgccttccctgggcacactgcatgccaggaatctccagctatctggaggctctccaagcccagtcctcttgggtttttatggagacttcacttcataggcatgaccaacaaccttgtagaaatgtgactggatgaaaagggtatgattccatactaacaggctgagtggagaaacccagcaaggcctgtctgttcagattcttcttggtctctctgtgtagcatttctttctctagaatctgaggcaggaacttctctgaaatgagggtcttttgatttatatcagattagagttgtctacactcagcaatggtgatcttcttgctggtcttgccattcctggacccaaagggctccatgctgtctgcaatattcatgccccctttcaacttgccaaataccacacgcttgccatccatccattcagtctcggcaatgtagatgaaaaactgggaactatttgtgttgggtccagcatttgccatggacaagatgccaagacctgtatgcttcaggatgaagttctcaccatcaaatttcaccccatagatgaacttgccaccagtgccattatggtgtgtgatgtcaacatcctggcacataaattctgcaataatcctgtgagagcaggagctcttgtaaccaaatcatttctctctagtgctcagaacacaaatgttttctgctgtctttggaactttatgtgcaaacagctccaaggagacacggtccaagggttcatggtcaactgctatattaatgaacatggtggggttgactacggttgatagcaagagactctaggtggtgaaggcacctccaaagcaccaggtatatacattttaacacttttatttaatgaatttacttttggctttgctaattttctctattgtgtatttgctttttattttattgaagttagctcttacatttactttctcctttctcctttctctggattatcatcatcatcatcattatttgaattactatttctttttctttggtttcttgagattgaatcttgcattattgacttgcaaactttctttcttttccaatatacaaatttaaagctataaatttccctctaaacactgccttagctatattgcacatttgatactcattatcactttgctctaaatatttcccaaatttcatttgatttattctttgactcatgggtttttagaaatatgtttcttatgttttaaacattcagagattttctggttatttttctgttattgattttttgtttaattctactgtgcttagagggcataattggtatgatttcaatactttgaactttgttgacacttgttttaatgcacagcatatgataatactttggtaactattgcatgtgcacttgaaaagaatatgtattctgcaattgttaggagaattgttttatatataatttatatatatattggtttaatgatcttcaaattcttatagccttattgatttttttgtgtgcttcttgtagcagctagagagacagatgtaataaaactctccaactatagttgtggatttacttctccttttagttctatcaaattttattttatatattttaaacttgttatatgcatagaaactgaagatgattgtttattcctacttaattggttcttttataatgatgacatttccttctatttctgtatattttttatacatcttatgtctttttttgttcattttctccgttattgccttcttttgtatttaattgatatttttgtgctgcatctttttgattcccttctcatttctttttctgtacattttgttattttctcaatggttaccacaggtattacaatgaatacctccaacaatatagtttgaattgatgccaattcagcctcaatactatagaaaactcctatacagctctatccccccacttttattgtcacaaattacatctgtttctattgtttttcacttcttgtgcctgagtttccattttctttatatctaaagaacatcctttggtatttcctttactgcaggcctttttgtgacaaattctttccgtttttaattttttctaaaaatgtctttatttcagcttcatttaaaaaattattactattttttgagacagtctcactttgtcacccaggcaggaggggagtggcaccatcttggctcgctgcagccttgacttcctgggttcaagtgattctcgtgcctcagcctcctgagtagccgggattatgggcgcgtgccaccacgctcagctaacttttgtatttttagtcgagatggggtttgccatgttggccagcctggtctccaactcccgacctcaactgattcacctgcttcagcctcccaaagtgcggggattacaggcatgagccactgcatctgctttcatctttgaagtaccgaaattctagataggcagttattttctttcagcactttaaatatatcattccttggaaaaccaaacaacgtatgttctcactgatacgtgggagttaagctacgaggatgcaaaggcataagaatgatacagtggactttggtgacttgggaggaaaagtgggaggggagtgagggataaaagactataaatagagtgcagtgtatactgctcgggtgatgggtgcaccgactcacaaatcacctctaatgaactttctcttgtaaccaaacaccacctgtaccccaataacctatggaaaaataaaaaaaaaagataccattccatcatctgctttttattatttttgctgaaatgtcagctaagttgtttgttttgtgaagggaatttagttttcccccactctggctattttacgatttttctatttatctttggtttccataatttttttgatgtattgagaggttgtcttttgttcattggtttgttttttttctttttttttttttgagacagagtttcactcttgttgcccaggttggagtgcagtggcgtgatctcggctcactgcaacctccacctcctggattcaagtgattctcctgcctcagcctcccaagtagctgggattacaggtgtgcaccaccatacttggctaatttttgcatttttagcagagatgggattttgtcatattggccaggctggtctcaaactcctgacgtcaggtgatccatccacctgggcctcccaaagtgctgggattacaggcgtgagccaccgtgcccagcttgtcggtttgttttgatcttgcttggggtttgtaacacattttacaaatctatcttgatggcttttgtcagttttgggaaattcttatcttttatctcttttgcttagttcctctttcctctctcgtctccttgctttccaattacacttagtttaggggttttgttttgtttttgctatatctcaaatatcttttacactccttcttgtgtatttttatccttttgtttttctttacttcactctggatattttataacagttttctaattctcttttcaatggcatctaaatggcctttttaacctttcaattgagtttgttttacagttattttacattttatttctgtaattttcattgaattctttaaaaaaaatccaatttcaggtaactattgctgcataatgacctactccaaaatccagtagtttaaaacaactacctatttagttagtgattctgctagttggcaatttgggctgggctcagctaggtggttcttttggtttcctcttgcatcagtcatgcatgtgtggtcagctgccagactggccacgggtggctgattcatttatttattttttattgttttttgagattaggtcttgctctgtcatgcaggctagagtgcagtggcatgatatctcggctcactgcaagctccatctcccgggttcaagcagttctcgtgcctcagactcccaagtagctggggttacaagtgtgtgccaccatgtctggctaatttttgtatcgttagtagagacgaggttttaccatgttggccagggtggtctcgaactcccgaccttgagtgatctgccggccttggcctcccaaagtgctggaattacgggcatgagccaccgcaccaggccagggctagctgatttagaatggccttagctgtgttggcttatctctgtatcatgtgatatcttattctccagcaggctattttaggcttgttcacaggtcagccagatgaggttccaagagaacaagtagaaatgtgcaatgccttttcagatctaggcttagaactagcagaacatcatttttgctgcgtttcatcatgaagaccagcccagttccaagagacagggaaatgaaccccatttcttgataacagaaggagctgtaaagtcacattgcaaggacatggtatttttgcattctatcacgctagttctctgctgaaattcttaaacttatgttttatttccttgaacatattagacatgattactttaaagtttatgactgacaactctattatgtagatgccctgtttgttggtttctgttgtctctattcttctgttggtttttggagatgtttccttttcttatacttcactttggatattgtgtatgaaacattctaggaataatttaatgctctggttgatgttattttcctctagtcataacttatatttgcctctagttggcagccaggttagggctaccagagattccagatcattagttcaatccagggttgtgatgattcaaaattgagcttcagttcctgtgagggctgttcatttctcgttcactcttactctttgggtatagccctctgtggtaccaacctcaacactgatggattttatgtatacccgctttctaataggagggacgtgaacttcatgttctcttagttccttgagttttattgtgagctctgctcagcttctcagccttttagctgccatttatggaatcagaagatgcctccagggaacaacagtcagaaatgctgatctcacctctctgaatttccttcttccagatattggccccataatttttcactgctttataaactctctgataactttaacaatgtgcttttacatgttgttcatttttcttctagctatttttagtgggaggattggttagcatgtcttaacctggattttcattacataattagaattccttcgatgattttttatctcaacaattaaggggatgctgtagaatgaaagtgttctgtttccagatcacaaactctctggagtcaggaatcatgccttatacatgaagaggccctgcctcttcaggggctggattgcagtgggactcagtaaggactgaataattgatgaagacagtatatgtcctccttgtaggtttagtaatgattttttccattcacctttgttctcagggtctttgtgcaatatttggtaggttgacttgttcttataaatagtgctaggatcgtaggagacagagacacagagatgcacagcacagtctctgcttttgagaagcttttggtttgctaatgggcagagccagtacaagtcatataaatataaatgggaacctatgtgttttagtcttaggagcatcaagatcaaagaaacatatttcatcaaacaaatagtattacaagtcctttaattatttacttagtctcttgagaaaatgccagggtgaagctgtggcttggagagactgcattcataatgcactggacatataaaaacccctctgtctcaattgctctcttcttaatagcctccattttaacggagccacttgtaaaactctccccatctcttattttctcttccaaatcctccctgagcctccccaactcacccagagagactttttaatttcctgcacctgctgggccatgccacatagctttattactaaaaatggctgtaggaacttccagttttgtacactgactgcacagaattgctctaggttgtcacacccccatattcattaggtttcatcttgattctttgagaggcaagtgctgggatctgcctgggaagtgtagttttatttttaaaattgttttctagggagaaatttttgtggagactttctgatcactgaaaaactggcaaacatcaataagtaatgaccaaaatccaatgaaccaagtgccacgagagaggattatgtattcagctctgtgagaggatggttgaggggccatgagttcagcttggacggttagtcttcctgggcctgaccattcagaatttccaacagtcactacttgccattagtagttgcctcagcactgcttggagggagtcaccttagatgtggtatttatagcatcatggttaagaatttatcctctcaagccaaactgctgtctttacaaagagtaaacaaataagctccctagcacctgtgctcccagctactagggaggttgagatgggaggatcacctcaagcccaggagttcaaggctgcagtgagctgtgattgcgccactgcactccagcctgggtgacagagtgagaccctgtctctagaaaacaaaacaaaagaaaacaaaaacataacaccaaactgactaggtttcaggctcatcattcttttaactcatcataccttttaacttaaatagttaaaatgtataaagtgtgaaacctgcctgtcacatagtaagtactcaagattttagctattggtctatgggatccctcagactagggacacagagcttggggacaaggggaggcagatggaggggatatgctttaaggtgctcctaggttctgggctcctcatactcatccccacccaattggcttaagggaagtcacatccagctgcccacattgctcaggcctgacactcttcccgctactttcagcttgggttctctttcctaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttggtaagtctccaggactgttcatactgccctctctgattcctataggcctctaagttctgtatttccaatgcctttctgatcagaatctctgcttccagataaagttgagaaaccccgcctacaggggcaggggaagatcctggacagagggagatgccaagtggctctgtcttgcttggtctccagggatggcaatgtgtcctatgcttggtacagagggagcaagctgatccagacagcagggaacctcacctacctggacgaggaggttgacattaatggcactcacacatatacctgcaatgtcagcaatcctgttagctgggaaagccacaccctgaatctcactcaggactgtcagaatgcccatcagggtaagtggaacacactgggctataacaagcgctgaaggtttggaccccgcaaccaggctcatgtgcaagacagatgtggtatgagataaaatcccttggcctcctctcccagtgccttgtagcccttcccagggtagccctggcctccaggcacacagttcctgtaaagctaggcctatcctactctggaaaaaaatgttatccctatttccttctgggagatgcaagcttttcttctgcagagggagggcatagttgtttggtgagtgacagtcctgaaatggctcctgaacattattttcttcctgggagaggctgatggagaactgtcctctcctcttgagtgataactttctccaagccacatagttcaagaggtaactacactgtgcagcagtagcctggagcaggagcatcaggatgaccccagggatacctagatgagttcttgggctgttgcttatgctcatcctaagagttacctgagttaccgttccacaactttttattacataaacagggacttaatgtaccagcagcatgggcattataggaaaaaaaaaccatacagctctcattcataaggaacttatagccaaatggggcaacaaaaataactacttgtggacaaaaaagaaacaagactgaggcaggccgggcgcagtggctccctgtaatcccagcactttgggaggctgaggtgggtggatcacaaggtcaggagtttgagaccagcctggccaacatggtgaaaccctgtctctactaaaaatacaaaaaattagctgggcgtgttggcgggcacctgtaatctcagctactcaggaggctgaggcaggagaattgcttgaacccaggaggcggaggttgcagtgagtcaagatcatgccactgaactaggacactggcttcatcattcagaagctctgtgatctcttagaggtcaggtgtggtggctcacacatgtaatcctagcactttgggaggctgaggcaggtggatcacttgagtccaggtgtttgagaccagcctggacaatatggtgtaatcccatctctatttaaaaaaaaaaaaaaaagaagctctgtgatctctggcagattcattaacctctctgagcctcaattttcttccccccttgagtaaaatgggggtgataataagtacctcacaggattgctgttaagagtaaatgagataatgtttgcaaagagccttgtcagcccttggaacacttaattccttttccttcctcttgttggctggattatatatcaggctacatgtgtgacacaaatcttttaagtagaagttcaaatgaggaagagccatgaaggaaggaatagtggaaaagtgagacggaaaacttgcctgtacaatgagtattttttgagttaaaaacaaaggaatggataaatgtaacatttgttgtgctacatgtccctcagtatccatgacgaattagttccaggacccacctcgcaaccacagatgccaagatccacgaatgtttaagtccctggcataaacaggtgcagtttttgcatataacctatgcacacatccttctgtataccttacttaagtcacctctaaattagttataatgcctgatacaatgtaaatgctatttaaatagttgttatactgtattgtttagggaataatgacaaggaaaaaggcctctacatattcaatacacatgcattttttttccctgaatattctggatccacaattcattgaatccacattgtggaactcaaaactttggagggcaactgtattagatcatgtaattaacccctataggtagataacgttatccccttttacaggtgagaaaatctaagaggctctgaggcatcttccaaaaataagatgacttgagaggcccagagaggttaaataaatagtgcagagctcacagggttagaatttgagccaggcctgtctgatatatctatgctcttggcatcactcagaggaggttaaccaaatgagcaaagagaaaaccttgaccgtgagttctcagagcacgaggcaatcagccacaacacagagaaaagtgggttttgaggcagcccctgcagcaggcaggtgggaaggaagaagagagcgagctgacagctcagttctcacgccttctgtattcctcagaattcagattttggccgtttttggtgatcatcgtgattctaagcgcactgttccttggcacccttgcctgcttctgtgtgtggaggagaaagaggaaggagaagcagtcaggtgagtggaaggtccttagggtggtgctcctgcctgaggccttggatcctgtgactttgtcctgcgtccagtgggatgtgtctgggagcacagcatctccttttcctcaacgagctttggtatgtttgtgtgcgtggtggcggggggcaagcaggttgctaggctctctctcccagttcatgccttctgatcccaatgcgcagatttccctgtagacagctggtttgggaggaggtgtgggaggggcagttcggttgctgcctctgtgctctttggggttcctgggaagagcattaacttgcctcctttctagaaccttttttaaggtttggccatttggggtagaggtgggacctgttagaagcaaaagcccttctggaggtttctgcagctctgctctttgttttcttcctccctcagagaccagtcccaaggaatttttgacaatttacgaagatgtcaaggatctgaaaaccaggagaaatcacgtatgtcatcccggaggctggggtctctctcagctggcttggaaaatgctctttcaatgatggttattcagagcagagggacaaaaaggactgaacgactgtccttttgatgtgaccctcagcccttccccatctatcttttctccacctgcttcctagttctggtgatggaggaaaagaggaaacaaaaggagcagaggagatgaaagggaggctgaaggggcatcttggtgcagaattgcacctgctgagaagggatggagcacaacagaaatcaatgacagaggcagagtgctgctgtggtatttgttgtctgaccacaaattctttttcctaatgagtcagggcttacattcatgagtcccttaatggtgacacaggctgggaagtgtgaccagccaaagcataatagttttgtagctggctcaataggctgcattcacagccttttggaagaagaggcctgagtgtggctgaggtactagagagagtaaccagcctggcacaaagcccaccagcctgagtaggctcctccaggagcctctcgcctgctcttcgcagcaggcaggggccaactctgcctgtcatccaagaattagaagaggaggaaattgcagagggcctgcagatgcccccactgctgtgtctcgcttagggcagatgtggtgacaggcccaggggaaaagctctgatggagcctaccaaactgctggcaggaagtggggcagggtgggtgaagtggggcggaagtgccttctttccactgccccctggcgctttgctgtggagacccagcagcacgcaggaagcacatgtggtggggctcttccgtgctggccacatacgtgaggccctgtgcagcctcgcagagcaggcaagcatcctctcccagatgcctctgggttcagaggctgttagagcagctccccatgcctgtttttttatttttatctttatttatttatttatttttgccccagcagtggctatgggaatgtgaaaaataaagcagtggctattggaatgtgaataataaaaggggactttgtttctctcactgctaccagactctggtacaaattcctgaaagcatgtgaatctacccacagccagtgatgcccgggtgcttgctaaaaataatctatttttccaaaaagaagatgacttgagattaggagaccacaggaggaaaaacaacttagagcaaaggaaacctctttgggattcaggcctattagcttacttcttccgactcaagagctcctccctgcctggcctcagccctctctggcctctccctattgtctcagggctccaatttgaaggcctaaatctcaagtttcatgtggtctcactttgagacccagctctaatctttctagaaacacttcacacgggtctggacgggagagaaaagcaacaaactcctgcagtattttaaaacacaaatgaagttattgacattgtcagatgcccatgactccccagcctctaaggacagctgacagttctctgcttctcttagcttcttcttgcttccaggaattttgcttgcaccttgcctaatgaaccctgctgcctccactggctcccagtagaacccaaactggcaatatgctttcagtggccggcagcatgaaatacctccaccaccgatttcctaaggggtaggaacaagaaaagggaagcaggaagctctgcttcctgctttggcccttgggttcagggctgcacccagcactatagctgcccagggcgctgacttgaggtcaagggcaaggtggcctcaaagatgatctagagagggcttaactgtgtttggtctttgaaatgtttaaactttctgaatttcagtgctctgaggtaaggctcagataacagccctactcagagctctgcaaggaagggtttctaagttactaaaggaaagaaagtgacagcattctctttgagcagggttgctggaacccctcacacctaggtggttccttgctcctgatactaatggttccactccaaactgctcttcttcctgtctcttcccatcttgggaggatcaatgactctccccagtcctgccacctccctcccagtctcctgaaaagccctcttctttgtgctgtttttccccactcaatctaaatctggacagaccgaactgtcgctcatgttaccccatctccatttcttgtgcaggagcaggagcagacttttcctggaggggggagcaccatctactctatgatccagtcccaggtacctctccagtttctctagtccattccatacctatctctggggtttcctaatgcccccctgaaactcacaccattgaatggcagaataagatcttggtgcttctagaatccagaagatagcttggcttcagttgcattaacacattatttgaaaagatccgtgtgatactagagcatcttaacacagctgggaagcctgatgtggacattccttcttcttccgtgtctggcagaaggtctggcccagataaagtctataggagcagaaacctggttaggggactcaacttctgctttcttgccctgctgctgcttctaatacttggggcccttgcactttttatccctattccctattatattcgttttcaggaaagaatgaatctgcattgatctcttttattttattatgacttagcaataatgtccattttcttttcttttaaaacaattttattgtttagagacagggtctctttatttattttttatttccataggtttttttgggaacaggtggcatttggtgtcatgagtcagttctttagtggtgatttgtgagatttttggtatacccgttatgagacaggatctcattctgtctaccaggctgagtgcaatggtagaatcatagcttactgaagccttgaattcccggcctcaagtgatcctcccacctcagcctcctgggtagctaggtctgcaggtgtgtaccactgcacccagctgtattttcttactaaatctcacataacagcctcatgaaaatagttctaatactttagatgtggtctacattccatatcacaatgaggaaaccgagactcaggtcaactgatatctcaaggctacatagctaggtagtggcagagctgagccaaagggtttctgagtctccattgcacctcctcatactccacctcttatattctgggattacagaaattcactcataaactggagaagcatcctttaatactgatggctaaaatgacattgataacccaggctgggacatctctcccaagggaaacactgcctcctggtggccagtaataaaagactttctgataaaaatggctttaaaaaaaagaaaaaaaaaattgagcaccatcttcagtttggtggctgagctgtggggcaaagaaaatctgattataagagcggttgatatctgccagttctctagtttcagccacattgaactccaatgagaggaatttctatcagtgcaagaaagaggtcccctcaaactatggtgttgggtgagaatgacagtcctcctctggagcatcttaaaaggagaatgtttacctgatttagaggacacctggttccagtccagggaagggaggcaagttgccaaagggaggcattgaggtgttgaggaaagagccctggagagtcttgggtttgaattctgcttctactgtgtacgcactgcctgacttgggctatttatccttttggagcctcatttgtggcatggggcaaattatgatcattcttattttataggagtgttaaaagagttagagaagaggccaggcgcggtggctcatgcctgtaatcccaacactttgggaggccgaggcgggcggatcacgaggtcaggggtttgagaccagcctggcccacatggtgaaaccctgtctctaaaaatacaaaaattagctgggcatgatggcaggcacctgtaatcccagctactcaggaggctggggcaggagaattgcctgaacccaggaggcagaggttgcggtgagccaagatcgagacattgcactccagcccaggcaatagagcgaaactcttgtctcaaaaacaaataaacaaaaaaacagttagaggagaatacatgtataagataaatgctcaacaaatagaagctttcattaatgacagagcgagactagcactcaggttgtctgacctcctggctagtccagggctcttttcactaacacttgaagcttccatctgggcagggttgaggaggagaaacggaagagataacctttgtaagattgtgctggatctgtgcttctgaaatgattttatttctcttctcattagtcttctgctcccacgtcacaagaacctgcatatacattatattcattaattcagccttccaggaaggtgagcctcttcccgtggtggtggtggggtgttgttgatgtagatgtgtattttgcatgtgtttgcagtgagagtgtgtgtgcacatcctggcaagttgttctttattgtgtgtatctgagtagcttctgttaaatgactgtatttaaatgtcaatgggccaatgagaaatgccttactggttctgtctggagaaaaataacagcttctagactaagagaacagtagactagatgagtttttgggagtttctgtgggaggtaaaggacagtcagagacagaaaggaggtgctttgcacagagagactacggggtacttagtaggtcagctgaggctatggtgagagatactggaggggtttgcaaggcagggcatattgcctggagctggaggagtagactggatctagagagacacaatcttgaccttcagagaccagagaaaggtcctggccagtcagtcacctgctggtggaggcctctggactgaggcaacccatccttttgcactgaaatccttctccaagctgagttcgtagctctcttgtgtacttggaaacagagttgggtatcctggtacacatggtcattgtttttctcttgtatggaaggggatgggaagagtggtgttcccaaggctggagccacagtgtgaagccagaaagccttaacatggtagtatgggaatttgggagtccacacaactgtggaagtccatgcaggtcagggaccacaggtttgaaggggtttaggacagattttcagacttttcattcaacctccttccaataagccattcaacctacttggatcccatcgtgagagagatttgtttttaattatatgctacaatataaggccatatagatgttcacaggcaccatgttcacctgctttggtgtatgtaaactctatatgctactgaatgtgcctctgaattctagtgtccttgggttggcaattatttatatgcctggattgtttacattaagggtgtgtgtatgcatgcgttgaagagatacatggtttggggcagtatttgcattaggattgcctgagggatatgtgtgtatgtgtatgtgtatgtgtatgtgtatgtgtgtgtgctctgggaatgtgtgtgtgtatatatatacacaaatatgtatatatatgtgtgtgtgtatatatatatatatatacacacacacacacatatgtgtatgggttttaggtgtatgtgggtatggaacagcaaattctgattttggttcagaaatatcatattataggcaaatactgtatatattgtgtcttccctggagaccataaacaccattgttttgctcctagggtgacagattctattcattttctggctgagagtgcctcagaatttttctgggccctgagtctcttttgggacctctcacatcacttaggagtgggagagcacttatctcgaagttaagtattctttaccttctgaatttctagtctggatccaggaagaggaaccacagcccttccttcaatagcactatctatgaagtggtaagattctggaactcctcaatgggtttactgtctgttgcatagccctgaaatctagccatgaaagggtacacttaggaaaagatcattcacacagtctcagagttgtagggaatttagagatcttctaatgcaagtctttgttttagagatgaagacactgaagcccaaggagagtgagggtctgacccaagatcatattgcgtgtttagatatgatacttactgggcagcttgggttttaaattagggccgtccccgagctagttcccaggctgtgggccacaaactggacatctctcctttccaagagtgttcggaggaggggtcagagaggggaagataaaggactctaaatgattttctaaaattagcaagtctttgggagccattccaggacataggtgagcttaatcttcttcaggggtcaacactgttcagagatgaccactgagcctggtggttgaattgattcccatcagagcatttagggactggaaaggagggactcaacatttcttgggggtttattatggataaggtagcctgccagtgtcttcacatggattattttatttagtcctcacagaatgctacaagataggtataattatactttccatttatactcagagaaattaaggcatggagagcatcccccaacctcccccactacccattagcctcatactacacctgagcctccccacctgtggtccaataaagatgctgccattggtcagaagggagggatgggtggctgcctgctggaattcctggcacttcagctatcacccaacattaaagccaactggacaacccagggtcatagagggcactgtgtagacccaggtagcttgtgaggtcatgaaaaagcatatgtggttaagagagtactggaattggagccagaagaactagattcaagtccctcctgcacttcacactagtcgtggatcctgagtaatttgttttgtcactctgagcttcattttttaaatctgtaaaatggggatggcaagtcatacctcacaggattgtgataaggacctcccagtgcaagggtctgaagtttctccttttcttttgcagattggaaagagtcaacctaaagcccagaaccctgctcgattgagccgcaaagagctggagaactttgatgtttattcctagttgctgcagcaattctcacctttcttgcacatcagcatctgctttgggaattggcacagtggatgacggcacaggagtctctatagaacagttcctagtctggagaggatatggaaatttgttcttgttctatattttgttttgaaaatgatgtctaacaaccatgataagagcaaggctgttaaataatatcttccaatttacagatcagacatgaatgggtggaggggttaggttgttcacaaaaggccacattccaagtatttgtaatctagaaagtgttatgtaagtgatgttattagcatcgagattccctccacctgattttcaagctgtcacttgtttccttttctcccctctctgggttgactgcatttctagactctcgccggcccaggcccatcttccaaagcaagaggaaggaatgataatggtgactcaggggaagaagaaacagccctcctctgaaagcctggactgtccggctgtgaactggctggcaggttctgcacgtgggtgggggccagggcctgggctttactcaattgcagagaaaaaactttctccctgcatctcatacctttacctctggccagttggccaccagggggagtgggctgaagggagagtagatggtgcaaagcaagcccatctctaagtagaaaaatcacccagagcacatgctgacctgataactggggtgttgagaccagctttgtccatggtatgatgtttgatttatgaagacgcattgttagaaatccatttggcttcttcatagaagtggcttcccagaggaagaggcctctcagaaaccatgttctatttaagttctgagtcctgatgagtgttccccaggatgcacattgaagggagggctcaggcagctgagggctgagaatgaggcagttggaatctagacactatgctgggttccctgagtcgtcaggccagacatttcaacaaggctgtggggagcagggctgtgactctggctgagcccaggaaagcgacaagggtgaactgggagaggacttactcagagaccccaacaggtgatactgcacaaagcctggttcttcaattttcctaccctgtatctaacataggagtttcatataaaacggtgatatcatgcagatgcagtctgaattccttgcctgaattaaatttatgtatcctctcca

SEQ ID NO: 75 - DNA, 5378 bp, Homo sapiens
cccgctcgtctggcccgcccccctcgccctcgcaggcggtccgcgccactgcctctcagtccctgtcctgcgcccgcgcgccccgggagcctacccagcacgcgctccgcgcccactggttccctccagccgccgccgtccagccgagtccccactccggagtcgccgctgccgcggggacatggtcctctgcgttcaggggtaagcgcggctctctgcccccttcccggccaccacgaggggcgcacgggagaacaggggcttcgtgctagctgccgggcattgggagggcttgacgggccagaggtgactgagcgcagacggacctcaggagcaaggctctgtgtggggctgtgacactcccactccccgcccccacacacttacctcaattcccactgtggattgggaaaccgggggctggccggctaaaggaggaactcacagggtgggctcagcctgggttctcattggagcagatggatgctaacggcacggcgtcccccaagatgtggccaacaatcccagatattcttctgggcccagagcactctacgctagcctgcctgctgccctgcctgctagtaaccttggaccagcccctggccccctctgtcctggtgtcccctctcctgccccaggctagcaagtaggctcttcttgggaagccagccgcagatccttgcctttcctcaggctggcacctgatggtctgcaactctcgggaggccctgggtttggcctggtcctgcttggggtacccccacaatcgtctcacaaccctgtctcagcccagtctgggatcccaatgtgagaaggaccttggctcctgcctctcatcttcaaatttcccagacttgaggtaagggacagtggagaggggatgctgataagacagagtcttgacctgagctgagcattcctggccatccactctgtcctgaacctcagcaaccccttcaaccaaagggtctgatgctggccatggtgatgtgacaggagctcaggaagctccaaggagagaggaagaaggtataaatgggtgttctgcactcagggaggactgggtggctgtgcttatcgcaactggcctggtgccaagtgagggagggtggaaggtgaggccaaggaagaggacatggaggtgctgggaagactacttctcccttgctgtctccagcaagttccttcctcctgtctgcattctgggactcctgaatacctgccccaccactgccttccaccccaggagcctccccctgcattccggggtcccatagcctctttcactttttaccctaggtgagcacccccttgtaagctcagggctactgttgggtgtcagggaacaaagttttagactgctgcgctccaaagcgggcacacacatgtacctagaacacaccagccactgtccccaccatgatgatgacacagccatggacacacccctgcccaggtacacactcaccaggagcttgtggtgatcaacacagctattcatacacccagctaccacatcagccccaaaggtgcccacacctacatgtgggatctgaggaccggctaagctatctggacgtggccacccacagaggttccagcctgactggctagccaccaaccatgctcctgggaaggtagctctgggccccagcaagcaggtcatctcaaaatttggcctccagctctccaagagggatttccaagatcccacagtacagccagggtaggtgtggaaaagtttttgtcaggctgtggtgtgccagagttgtgtggccctttctcactgtgagtggtcatagggccatgatttgttagaacctagagggtcacctataacctacacaggagtcaggtctggctcctgccaccagctcctgcctgcgccttcctgcctcacaagcaatactggcgctgtttgcccatgctgtcctctctacctggggtcccttcccccagctccttcctttggcctggaagacacagctcaggagcaagcagaccctgactcccccgtgacacctgcagttttatgactttgcattataattactcttagtgtcatcttccccagccagtctggttctccttgagggcaaggccatggtttcattatggcggtgtcctgaggcccagccagggactagacccagaactaaggcttggagatgtattttgcaaggagtgagggaggagcagctgtcttcctggggaagtagagccagtccctgctgccctcccaaggaggaagccctagtatcaccctgctgggtgggcttcccctaggagaaagctgctactcagattttggtcggctcagttcccccaaccccagccatccaagaatatggtgttactgaacctctcagtgcatgggttggtgggaccctttattgcggaaaagggaaactgaagcccagtgaagagcaagctttgtacaagatcgtagagcctggtagggctggcttgccagggtgggaactggagtgtggattaggtccctgcccttggtgggagctcatactgacaggaggtgagacttgccagtgcctttagaggccactgtccaccccagaccctccactgggagaagcagaggccaggataggctgacttgtatgggtaggggattatttcagtctctaagtcctggccagtgtggacctaggtccctctgagagacactcctatccatggggaggtagcgtgtgacctcaggcagcctaccataatcctggggcttctctggaggaccccacacagatctatcataggataaatctacttgtctgtcgtagatctatctcaactaggaccattcatcagtgggccatttaatcagcccacttcagccaggagggcacaaacatgaagctactttgcactgaatcctatcagtgtggtgagaacattagacatgcctatagggaatgatctgtgtttttggttgatataaaatagagagcaattaattactgtttagtaaatgcagggcagtggaaaagaatctttcaaaagaggatccccacatggaaacaatcaaggtggcttttgtgatgacaagtggggaacgagatactggactaactgagcccatggctgggtagaggggaagctgaggctcatagtgagatgggccagccagaggtcatgaaactagtctggggcataggggggtctctggagatgggggaagcatgggtcctccactcactgctcatccactgccttctagacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggtgagtctgaggggggaggcaggccttttcctgagtagtctggtgggagaagcttagttctgcctttgagtctgatttgggaggcatagcccggcccaggagagtctgatgggagaggcacagccctctctagggaagcgtgaagctggaggcactgccttgacttgcactggattggttaccccagctaatttccactatgtcccttggccccctctgcacttgcctaggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccgccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctttcatgtacagagccctcaatggggccgattttcagttgtgta

SEQ ID NO: 76 - DNA, 40524 bp, Homo sapiens
ggcggggcctgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtggtgagcagctcggcctgccggccctggccggttcaggcccacgcggcaggtggcggccgggccctgaggcgcgggatccgcagtgcgggctcgggcggccgggcccagggaaccccgcaggcgggggcggccagtttcccgggttcggctttacgtcacgcgagggcggcagggaggacggaatggcggggtttggggtgggtccctcctcgggggagccctgggaaaagaggactgcgtgtgggaagagaaggtggaaatggcgttttggttgacatgtgccgcctgcgagcgtgctgcggggaggggccgagggcagattcgggaatgatggcgcggggtgggggcgtgggggctttctcgggagaggcccttccctggaagtttggggtgcgatggtgaggttctcggggcacctctggaggggcctcggcacggaaagcgaccacctgggagggcgtgtggggaccaggttttgcctttagttttgcacacactgtagttcatctttatggagatgctcatggcctcattgaagccccactacagctctggtagcggtaaccatgcgtatttgacacacgaaggaactagggaaaaggcattaggtcatttcaagccgaaattcacatgtgctagaatccagattccatgctgaccgatgccccaggatatagaaaatgagaatctggtccttaccttcaagaacattcttaaccgtaatcagcctctggtatcttagctccaccctcactggttttttcttgtttgttgaaccggccaagctgctggcctccctcctcaaccgttctgatcatgcttgctaaaatagtcaaaaccccggccagttaaatatgctttagcctgctttattatgattatttttgttgttttggcaatgacctggttacctgttgtttctcccactaaaactttttaagggcaggaatcaccgccgtaactctagcacttagcacagtacttggcttgtaagaggtcctcgatgatggtttgttgaatgaatacattaaataattaaccacttgaaccctaagaaagaagcgattctatttcatattaggcattgtaatgacttaaggtaaagagcagtgctattaacggagtctaactgggaatccagcttgtttgggctatttactagttgtgtggctgtgggcaacttacttcacctctctgggcttaagtcattttatgtatatctgaggtgctggctacctcttggagttattgagaggattataagacagtctatgtgaatcagcaacccttgcatggcccctggcggggaacagtaataatagccatcatcatgtttacttacatagtcctaattagtcttcaaaacagccctgtagcaatggtatgattattaccattttacagatgaggaacctttgaagcctcagagaggctaacagacataccctaggtcatacagttattaagagaaggagctctgtctcgaacctagctctctctctctcgagtaataccagttaaaaaataggctacaaataggtactcaaaaaaatggtagtggctgttgtttttattcagttgctgaggaaaaaatgttgatttttcatctctaaacatcaacttacttaattctgccaatttcttttttttgagacagggtctcactctgtcacctaggatggagtgcagtggcacaatcactgctcactgcagcctcgacttcccgggctcgggtgattctccccaggctcaggggattctcccacttcagcctcccaagtagctgggactacaggtgcgcaccaccatccctggctaatatttgtactttattttatttatttatttatttattttttgagatggagtttcgctcttgttgcccgggctggagtacagtggcatgatctcggctcagtgcaacctctgcctcccgggttcaagcgattctcctacctcatccccctgagtagctgggattacaggcgcctgccaccatgcctggctaattttttgtatttttaatagagacgaggtttcaccatgttggccaggctactctcgaactcctgatctcaggtgatccacccgccttggcctcccaaagtgctgggattacaggcgtgagccactgcgcccggcctaatatttgtattttttgtagagatggtgttttgccatgttgtccaggctggtcttgaactcctgagctcaagcgatctgcccgcctctgcttcccaaagtgctgggattacaggcatgagccaccgtgcctggcctaggtagacgcttttagctttggggtgtgatgcctgccccagtatatagtgaatttaattattgctagagctggctgtttgttagttttctttgaacataagatactcattgtttttagtttgcaaatccctcttcctttttaaaaaatttctttcccttaaattgtttgcatgttagcaataacaaatgcttaaatggtgctatgtgctagatactcttctaagccctgttatgtatattaactaattttttaaattacacaaatcagagaggttaagtaacttgcccaagattacccaacaatactaggatttgaacctaagtttgtctcaccccagattctgctcttaatctctaaacttttaagttagtagtgacaatagtaggtatttattgaatacttaactatgttttaggcgttgaagtaaatattttgcaggcattatctaatgtaaacaccctaaagttacataacaggtaccctttaggtaaataaacactagtatgaccttggaggcacagatagttgaagtaacttgcccaatatcacttacatgaaattggccctcaaatgtgtctgatacaacccatgctgcttgtaactatcgttttaaactgccagggtaaacttggacacacttgagctaagaaaaagcttttagatttttgcaaattaatgtgaaagatatgctttatgtggatataatatcttctaaatttcggggatggtagtcctagaaatgtaatcctgccctagccgagcttaccctgccaataattttttacagaattggtaaaacggagcaccttttttttgtccttggccacactgttatcaacagggtgtagattgacatcaatctgtaggtgtaaaccagaattactctttgtgaccaccaggaaatagagcagttcagttcaggggtttctttctgtgaatttagcactgtgacctgcatactacaagtctactttgttttctatccattgtttgtatctgggtattgcaaaaggtaggaaaaggaccaaccagatcagcagagaagagttgccttggagttttcttttagttttctgcagttcattagatagtaactaggccatgtcattttactcccttgtagtgaagatatgttgaagttgtactggtatactcttctacctttctgtaattttatattgtgtagacttgataaaatttatgtgtcaatcaccaccattaatatcaatattgagcctcaattcttatttttctgcccagtggctgccaaattactaacatttacaataattcactactactaagataatctactagttcgatcacatacttcaaattgttatggaactactgtcttcagcattgtgcttctgataactgataagtataattttttttttgtccagagtgaacatgtctattcttccactgtacacactaataaaaggaaaaattgtaatattgggtaaattcatgtccttacacatgtagtagttatgagcccatgtccctagaatgagtaataatttatccctcccttggttgaatagtcaagaatgctgattttaattcttctaacagctttatccctcagaagggaaggcaagcaagttatatatgtagtttatttgtaagactgatatgaaattggaagatgaatctactattagctttaattatttttacatttaggaatattgcatcagtaactcataattttggttttctgttatcctgagttaacacaaattatccaaggagatggcggatcatctgctttgaggtgtttttttttgagaattttaatgtatctgaatataaaaggtaaaaatatgccaactagcaatttctgcccattccagaagtttggaaatattactcattactaggaattaaataaaatatggtttatctattgttatacctcttttaattcacatagctcatttttatcttttatttttgtttgttttttttgagatggagtcttgctctgtcaccaggcaggagtgcagtgatgcaatctcggctcactctagccaccgactccctggttcaagcgattctcctgcctgagccttctgagtagctgggattacaggcaggcaccaccacgcccagctaatttttgtagagacaggatttcaccgtgttggccaggatggtctccatctcctgacctcatgatctgcctgcttcggcctcccaaagtgctgggattacaggtgggagccactacgcctggcccacatagctcatttttagactcacttccattaagtcttgtttggacccacgaacattgtctttttttttttaagatggagtttcacttttgttgcccagactgtagtgcaatggtgcaatctcagctcactgcaatctctgcctcctgggttctagcaattctcctgcctcagcctcccgagtagctggaattacaggcgcccgccaccacgcccagctaatttttgtgtttttagtagagacggggtttcaccatgttgggcaggccaggggtgatccgcccacctcagcctcccaaagtgctgggattacaggtgtgagccaccgcatctggccaacatgtcttttttttttttttcctttttaaccacaaagagacttaagcagtccttgtcacagatgatgaattgatgttgcaagtattgtcttagcttggattaattttcttgcttactgtaattttagataatatagctttgtaattagagattttatgtgtaaaccacaaaaatgtttacatgaaggccattattacagatgtgacgtgcataattattagtaatttgtatgtttacatgggtcagtctggcaaaaaattatgaagttttaaaaattaaaaaaaattataatgccagttttactggaaagtaaaattatttcagtaatcgattatagcaaaagtattgattttcattccagacaaaagtcagaatgaaaggtaatttctcaatactctttcagattaataaaagtacctgtagcgatttttatcattcacaagtatatcacaagtaagttagaatttgagaactgtgttctagatctctgaggagatgcagtcagatttctgaactgtctcagcaaatggtaagtaacttagagctagtaattaataacctgtcctttgatttctgattcagccaagaatggccatatttgggaaaggcagatctggagagtaaccacgttttcattcatttaccacttctaggcccctccagagctctcagatattttggggttgagcccttccccaaagccatacaggaccttttttttgtgatctgttctagccatttttatgttgggtgcttgttatggactgagcatttatgtcctcccacaccccccccataccttttttgaagtcctaacccccagtgtgatggtatttggagacagggcctttggaaggtaattacagttagaagaagtcgggagggttgggcccaggtctgattggattagtgcccttatatgaaaagacaccaggacgggcgcagtggctcacacctgtaatcccagcactttgggaggccaaggtgggtggatcacgaggtcaggagtttgagaccagcctggccaatgtagtgaaacaccatctctactaaaaatacaaaaattagctgggtgtggtagcgggctcctgtcatccaagctactcgggagggtgaggcatgagaatcacttgaacccgggagttggaggttgcagtgagcccagattgtgccactgtactccagcctgggtgacagagtgagactctgtctcaaaaaagaaaaaaaaaaaaaaagagacaccagagagcttgttagaagaggtcatgtgagcacacagttagaagaccttcaagccaaagaagaggcctgagattgaaacctaccttgcaggtaccttaattttggacttcccagcctccaaaactgtgagaaataagtttctgttaagtcactcagtctgtggtattttgttatggcagcctgagcaggtagttgttctttcagaaggtgttgataataaccacatgcaacaccaagtcacaaataataaaacagatgtaacttatattcatacagaaagttgggcactgccattgccttgttggtttacacggctgtgctagttcagtagcagaaaggtgctggtctcctttactcagtttacaatctaggcagtagaatgtaatcactgctttaaacttgatactgcttagggagagaatcattggtgctgggtaactttgggttctaggtttactttttgtgtatatataactgtttttggtaaatcacaagtttctgggcttgtcgaattagattttgttacagattatgagctttattatgctatacagttagttgtatgtatatatgcctttcccactagattttaagctttttttttttttttttttttgtgacggagtcttgctcttgtcgcccaggctgaagtggagtgcagtggcacaatctcggctcactgcagcctccacctcctaggttcaagcgattctcctgcctcggcctcccaagtaactgggactacaggcacgtgccaccacacccggctaatttttgtattttttgtagagacagggtttcgccatgttggctaggctggtcttgaacttctggcctcaggtgatccacccgcctcagcctcccaaagtgctgggatttacaggcatgagccaccacgcccagctataagctctttaagggttgtaaatttataatcattcttttactctcctgcaaattctgttgcacactgccttaatcaaggtagatgctgaatgcatttttgtataattgaatatgttgcaatccccaactctctccaactgttcctgtcaaagcagccactggattgttaactaatccatattagatggggttaattaatatcagatgggacaagtaagggctaataagattataggccaccaagtagatttctgtctagctcttatagagattgagtttattggacctgtttgataggaagttttggtgtttgggatgattaaaactgaagttcctatttattgaattatacctatttatattatttcatatcagtggtccacatgcaagtgaggcttctgagacagagtttgagttctctcttcaactaccataacacttaacctgtatctttttttttttttttttttttagacggagtctcgctctgtcactcaggctggagtgtagtggtatgatctcggctcactgtaacctctgcctcctggattcaagcagttctccatgtctcagcctccctagtagctgggattacaggcctgtgccaccatgcctggctaattttttttttgtatttttagtagagacggggttttaccacgttggccaggctggtctcgaactcttgacctcgagcgatcaacttgccttggcctcccaaagtgctgggattacaggcatgagccacagcgcccagccgtctttttttttaaatagcaatttaacactgttcacagttactcatgtacatgtcatgccatctattacactgtaagttctgtgagggtagctgtatcaaatttatctaactctctctagtatgcatgacatagtaagtattcaataaatatttgcatattagtgataaggatacaggttctgaatagtgggtccttaccatttaagaattagtatttgatggccgggcggggtggctcacgcctgtaatcccagcactttgggaggctgaggcgggcggatcatgagatcaggagatcgagaccatcctggctaacatggtgaaatcccgtctttacaaaaaaaatacaaaagaattaaccaagtgtggtggtgggtgcctgtagtcccagctactgctttgtgaggctgaggcaggcagatcacctgaggtgggaaattcaagaccagcctgaccaacatggagaaaccccatctctactaaaaatacaaaattagccgggcgtggtggcgcatgtctgtaatcccagctactcgggaggctgaggcaggagaatggcgtgaacccgggaggcggagcttgcagtgagccaggatcgcgccactgcactccagcctgggcgacagagcgagactccgtctcaaaaaaaaaaaaaaaaaaaaaattagtatttgatatttgatcattaaatatgaattaagaggacttagactttttgttaaatgtcaagctgggaaaagttgtcatttaaatgaattgcctcttatttaatttcgtctgatgatacattttgtttttattttgtaaaaaattattttttttctttttggagacagggtcttgctctgttgcccaggctggtcacaaactcctgacctcaagcaatcctcctgccttagcctcccaaaatgctgggattacaggcgtgagccacctcgcccggccttgtattatgatacattttgaacaactacaagtagacttggtataatgaacctgcacgtacccattgccaagttctgacaactgtctgtctatagccaattatgcatttcttaaattagaacccccccaatatacccaaatatatatatatgtgtgcatatatatagtaagttgtaacaaagttgtgaattcatacctgaagtatctcaagtgatgcaagttttatgaatttttgtttatgccttttgggaagagttgtattgacaaattttttatgcttaaagtaaaccataaatcaaaaaaataaaatctaggatgcaataaaacaaaacaacttcttgacataagtatggtatgtaaatctgttttgattggaaatcaatttgttatattgccagaattcctgttttagaatacatctctgctgatctgtctgtattcttagactgcatatctgggatgaactctgggcagaattcacatgggcttcctttgaaataaacaagacttttcaaattcttagtcgatctgcagaacctgtagccaggcactgaaccattttgatagatgcagtaatcgttgcaagtgtatatttcaaggagttctggctgggtcctagtttatgcttgtggcagaagcagtgagtaactgggaggaagttggtgagtaagcttcaaggaagaagtcatttttagtactctggatcttcctgattttaaagcactacaaaatggtgcattttcattcttgtcaagtgataacagatatattctgatgagcctgaaatgaatatatattgtatcatttttataatatctagcaaggtttgtattttcctagaacttgaactaaatttcagttcataaaatttataaaatacttagttgttgtaaaatatttttggaatgttcacataggtgacacacaaatgtcccattttcattctttctatagtaaatatgttctgatatgtgaaggtttagcagatgcatcagcatttaatcctagaggatctggcataatcttttcccccaagaatagaaattttttctgcttatgaaagtagtacatgtttctttaaaaacaaatcaatattgacttctgcctgctgtatagcactatgcctccacctggccatgaccaggggcatgtcctggtccacctacctgaaaatgtttgcaaccagcctcctggccatgtgcacaggggctgaagttgtcccacaggtattacgggccaacctgacaatacatgaagttccaccaaagtctgagaactcagaactgagctttggggactgaaagacagcacaaacctcaaatttctcagcactggaaacctcaaaatataactgaattccataaataagattttaagtcttaaatatgtatttttaaatgtattaaaagtcaagctgcttgtatttaagcacctaatacaatgcttaggttgtaaaaggagatgctcaataggtactaactgatatattgagatttaattatggtttgaccaatatttattggaaaccgccaaagcttaaatcatcagcttcttgaatgtgatttgaaaggtaatttagtattgaatagcatgtgagctagagtatttcattctttctggtttatttcttcaaatagactttgaatataatggtgaatgggtattataaattaactaataaaaatgacattgaaaatgaaaaaatatatatattaaagtgtagaaagtgaccaggcgtggtggctcacacctgtaatccaagcaccttgggaggctgaggcaggaggatctcttgatcccaggagttcaagaccagcctgggcaacatagcgagacttcgtctctaaaaaaaaaaaagagagagaaaaaaattttttttatttaaaaaaagtgtagaaagtgtcaagaccccacttcttaccattatttggtatatttctctatacccacccacccttcctccttactccctccctcccttcccaatctttttatctttttgtattctgattttttgtttgtatattttgctttaatttaatgtatcctttaaaaatttcccatacattttatatgtatatataaaaacgcatgctgccaaagataatttataagaaagaccattgaatttttttaaaagtgatatatattcattgaaaaaaatttagaatatatagcaaagcaataaagaactaaataaaattgctgtaactcctctttcaaagataagtgcttttatgattttgttgtatttttttctgtatataggtacatatatagtatttataaagctgtactcatagtacattttcacatcacaggtaccatatcagtgttattaaatattttgtatgccaggggctagacataccaagacaaccaatatgtggttctacttaaataatattagagtatcttttatgatgacacttcatgagttgactataataatcttagacttctaagagtttgggttttcaaaagatcacttagcttttttgggtgatttttcccccttactgtgagatgagagaggctgtttggatttgggattggggtagcggggacagcaacttttcttttctttttcttttttattttgaggtagggtattgctgtgtcacccaggctggagtgcagtggtgtgatctcggctcactgcaacctccacctcccgggctcaggtgatcctcctgcttcagcctccccagtaactgggactacaggcgcgtgccacatgcctggctaattttgtatttttagtagagatggggtttcaccatgttggccaggctggtctctaactcctgacctcaggtgatacgcccacctgggcctcccaaaatactgggattacaggcatgagccgctgcatcagccagcagtttttcttgtggttttttttgtttgttttgttttgttttgtttttgagatagggtcttactctgttgtccacgctggagtgctgtggtatgatcgtagctcactgcagcctcaaactcctgggctcaagtgattccttctgcctccgcctcccgagtagctgggactacaggtatgcaccaccatacctggcaaatttttacaaagttttttgtagggacggggtcttgctacattccccatgtcggtcttgaactcctggcctcaagcaactctcctgtctcagcctcccaaagcactgggattacaagtgtgagccaccacaccatgccagtttttcctgttcagtgtgatattttatcttgttagactacagtgtgttaaaacttgttttactaaattttcaaacatactcaaaagtggagagaatagtataatgaatacccgtatgttcatcacccatgtttagaatattattaaatataaagattttgctgcgtttgtcttagctctttaaaatttttctttttctctttgtgacctaaaggaaattccatatcttatcactttacttctacattcttgactaagatgactaagacatatagttacatggttttttgttttgttttttgttttttaaagacgaaatctcgctcttgtcccccaggctggagtgcaatggtgccatctcagctcagtgcaacctctgccttctgggtacaagcgattctcctgcctcagcctcccaagtagctgggattacaggctcctgccaccacgcctggctaatttttgtatttttagtagagacggcggggggaggtttcaccatgttgacaaggctggtctggaactcctgacctcaggtgatccacccgcctcggcctcccaaagtgctgggattacaggcgtgagccaccgcgcccagcctgtttttttgtttgtttgttttgttttttttgagacagagtcttgctctgtttcccaggctggagtgaagtggcgcattcttggctcactgcaaccttcacctcccaggttcaagtgattctcctgcctcagcctcccaagtagctgggactacaggcatgtgtcaccacacccggctaatttttttgtatttttagtagagacgggatttcaccgtgttgcccaggctggtctcgaactcctgagctcaggcagtctgcctgcctcagcctcccaaagtgctgggattacacgtgtgaaccaacccgcccggcctgttgttttcttacataattcattatcatacctacaaagttaacagttactaatatcatcttacacctaaatttctctgatagactaaggttattttttaacatcttaatccaatcaaatgtttgtatcctgtaatgctctcattgaaacagctatatttctttttcagattagtgatgatgaaccaggttatgaccttgatttattttgcatacctaatcattatgctgaggatttggaaagggtgtttattcctcatggactaattatggacaggtaagtaagatcttaaaatgaggttttttactttttcttgtgttaatttcaaacatcagcagctgttctgagtacttgctatttgaacataaactaggccaacttattaaataactgatgctttctaaaatcttctttattaaaaataaaagaggagggccttactaattacttagtatcagttgtggtatagtgggactctgtagggaccagaacaaagtaaacattgaagggagatggaagaaggaactctagccagagtcttgcatttctcagtcctaaacagggtaatggactggggctgaatcacatgaaggcaaggtcagatttttattattatgcacatctagcttgaaaattttctgttaagtcaattacagtgaaaaaccttacctggtattgaatgcttgcattgtatgtctggctattctgtgtttttattttaaaattataatatcaaaatatttgtgttataaaatattctaactatggaggccataaacaagaagactaaagttctctcctttcagccttctgtacacatttcttctcaagcactggctatgcatgtatactatatgcaaaagtacatatatacatttatattttaacgtatgagtatagttttaaatgttattggacacttttaatattagtgtgtctagagctatctaatatattttaaaggttgcatagcattctgtcttatggagataccataactgatttaaccagtccactattgatagacactattttgttcttaccgactgtactagaagaaacattcttttacatgtttggtacttgttcagctttattcaagtggaatttctgggtcaaggggaaagagtttattgaatattttggtattgccaaattttcctctaagaagttgaatcattttatactcctgatgttatatgagagtacctttctcttcacaatttgtctcttttttttttttttttgagacaaggtctctgttgcccaggctggggtgcagtgcagcagaatgatcacagttcactgcagtctcaacctcctgggttcaagcgatccttccacctcagcctcctgagtagctgggactataggtgtgcgccaccactcccagctaatatttttattttgtagaaacagggttcgccatgttacccagcctcccaaagtgctgggattacaggcatgagccactggcccagtttctacagtctctcttaatattgtatattatccaagaaatttcatttaatcagaacctgccagtctgataggtgaaaatggtatcttgtttttatttgcatttaaaaaaaattatgatagtggtatgcttggtttttttgaaggtatcaaattttttaccttatgaaacatgagggcaaaggatgtgttacgtggaagatttaaaaaaaatttttaatgcatttttttgagacaaggtcttgctctattgtccaggctggagtgcagtggcacaatcacagttcactccagcctcaacatcctgcactaaagtgattttcccacctcacctctcaagtagctgggactacaggtacatgctaccatgcctggctaatttttttttttttgcaggcatggggtctcactgtattgcccaggttggtgtggaagtttaatgactaagaggtgtttgttataaagtttaatgtatgaaactttctattaaattcctgattttatttctgtaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtgtgagtatatttaatatatgattctttttagtggcaacagtaggttttcttatattttctttgaatctctgcaaaccatacttgctttcatttcacttggttacagtgagatttttctaacatattcactagtactttacatcaaagccaatactgtttttttaaaactagtcaccttggaggatatatacttattttacaggtgtgtgtggttttttaaataaactccttttaggaattgctgttgggacttgggatacttttttcactatacatactggtgacagataccctctcttgagctacatcggtttgtggggagtcaaaagtcctttggagctaggtttgacaaataaggtgggttaacacttgtttcctagaaagcacatggagagctagagtattggcgaattgaagaaatccccctttttttttaacacacttaagaaaggggactgcaggtatactcaagagagtaagtcgcaccagaaaccacttttgatccacagtctgcctgtgtcacacaattgaaatgcatcacaacattgacactgtggatgaaacaaaatcagtgtgaattttagtagtgaatttcattcataatttgatcgtgcaaacgtttgatttttattactttagactattgtttctgattttatgttgggttggtatttcctgtgagttactgttttcctttaaaataggaatttttcatactcttcaaagattagaacaaatgtccagtttttgctgtttcatgaatgagtcctgtccatctttgtagaaactcgccttatgttcacatttttattgagaataagaccacttatctacatttaactatcaacctcatcctctccattaatcatctattttagtgacccaagtttttgaccttttccatgtttacatcaatcctgtaggtgattgggcagccatttaagtattattatagacattttcactatcccattaaaaccctttatgcccatacatcataacactacttcctacccataagctccttttaacttgttaaagtcttgcttgaattaaagacttgtttaaacacaaaatttagacttttactcaacaaaagtgattgattgattgattgattgattgatggtttacagtaggacttcattctagtcattatagctgctggcagtataactggccagcctttaatacattgctgcttagagtcaaagcatgtacttagagttggtatgatttatctttttggtcttctatagcctccttccccatccccatcagtcttaatcagtcttgttacgttatgactaatctttggggatttgtgcagaatgttattttagataagcaaaaacgagcaaaataggggagtttaactttaatattttcttttaaaaagcatttcatgttataagatcaattctgagtggtagaaatgctttgacattttatttccattttctacttttagtttttttcctatttgtttaagatcttagaggattattaagctgaactcctcaactgataaaaagcatgacatcttaaacataagcaaagcatatttttaggttaattttcacatagaaaacagtttattttatgtgaaattctatgtagatatactatttttttggtatttattgatatgtttattttattttattttattttattttattttattttattttatttatttatttttttttttgagacagagtctcactctgttgcccaggctggagtgcagtggcatgatcgtagctcactgcaacctccacctcccgggttcaagcaattcttctgtctcagcctcccgagtagctgggactacaggtgcctgccactatgcccggctaatttttgtgtttttagtagagatggggtttcaccttgttggtcaggctggtctcgaacccctgacctcaggtgatccacccacctcagcctcccaaagtgctgggattataggcatgagccaccgtgcccggccgacatgttaattttttaaaaaaggctttactggggtatattttatataatataataatcacatgttttaactatacaattccaagctttttagtatatttatagggctatgcaaggaagatatactgttaaacagtagaaattgagaaagctcttctgataatatctcttgatttgatgatggctcatgcctgtaatctcagtgctttggaaggccaagacagcagaatcacttgaggccaggggttcgagaccagcctgggcaacacagcaataccctatctttacaaataataaaaatatctgttgatttgaagtaaagtttttttttaaagacaaggtctcattctgtcacccaggctggaatgcagtagcaagatcacagctcactgtggccttgaccttctgggctcaagtgattctcccacttcggcctcccgagtagctgggactaacaggtgtgcaccaccatggctggctaatttttttttatgtttgtagagattgggtcttactgtgttgcccaggctgatcccgaactcctgggctcaagcagtcttcctgcctcagcctctaaaattgctgggattacaggcttgagtcaccatgcccagcctgaagtagcatttctaccctgtttaataattcagcagcttgtcatgtaagatattcatatatgcatataaaacattaggcagcttaatttggtaaaactgtaaaatggaaattttaaattgtttgcagcatcaataacattgatgtcagtatgatttttacatgctgatcttgaccaatttgaaacagtgagttaaaatctggctgatccgtactaatcctaaagaaatattctatgaactattaaatgtttccagaatatataaagaaacattatgatgtcaacacacccatctatttttttttggaaataaaaactccatttttcttattaaagaaaacatgcttattagaaaacatacggctgggtgcagtggcacacatgtaattccagtgctttgggagatcgaggtgggagaatcacttgaggccaggagtttgagaccagcctagacaacataatgagaccccctctctacacaaaaagaattagttgtgcatggtggcgtgcacctgtagtcccagctacttgggaggcagaggcaggagcatcccttgagcctaggagtttgagactgcaggagttcgagactgagtggaatgcagtggaactgcattccagcctgagtgacagagggagaccctgtcttaaaaaaataagaaagaaaacacaactgcagaaaattataaaggatttaagtcattccaaatatcactgccactttttatttagaatattctaaagaattctctctctgtgtacacacacacatatgcgtactcttaatccaagtagcttggtaggattttatttacctagtgcctagatgggaaattgcctggggattccaaatacctatttcattaaattaaagatgtcactgattttaagacttaacactatttttcatactgccaagaaagaaaacactaccagttataaatgtaaattgccatcaattgtaatacatcaattttagagctattattaataaaatgtgaatgtgcatcttagagcaatgaaatatagtactatatatttgatgaccttttctgccctgtgatattcagaaagtgaaagttaaatatgggctgagcatggtggctcacacctgtaatcccagtactttgggaagtcaagacgggaggctggcttgaacccaggagttcaagaccagcctaggcaatgtagcgagacgccatctcaaaatattaaaaataagtaaataagtaaataaaaagaaggttaagtatacaaatgtatttcctttgttgtgaatttatttcaattttatagtgattttttttttttgagacgaagtctcactcttgtcccccaggctggagtgcgatggcgtgatctcagctcactgcaacctctgcctcccaggttcaagctatactcctgccttggccccccgagtagctgggattacaggcgcctgctaccatgcctggctaatttttgtatttttagttgagatggggtttcaccatgttggccaggctggtctagaactcttgacctctggtgatccacccgcctcggactcccaaaatgctgggattacaggcgtgagccaccgtgcctggccagtggttttttgttgttgttgttgttgttgttttgtttttgtttttgtttttgttttgagacaggatcttgctctgtcacccaggctggagtgcagtggtgccatcttggttcactgcaacctctgcgtgggctcaagcaatcctcccacctccctttccagagtagcggggaccacaggtgtgtgccaccacacctgactaatttttgcatttttttttgtagaaacagggttttgccatgttgcccaggttggtctgaaactcctgagctcaaacaatccaactgccttggcttccctaagtgaaattacaggcatgggccactgtacccagtctagtgatttttttatttttatttttattttattttattttatttttttaccaaaaaaacaacaaagcctcaggaggaaaagttgatacacaagtaaattttattggaaatgtttttgtgtggaccttaagcagagggaaaattagtctgcattatggtgtatccagactaaatgactgatattaaaatgaaattattcttaggatttgcaatcttagagaaaactttttcatttttatttttttgagttacaaattatcttcatttacatttgagaacagtgagtcacagagggattaagtaacttactcaagatcatacaagtctttgatttgaacccaatcttttaactctgcagaactcagagtcactcttatttggaaaaactttttaactgatgtggatcctctaatatgggcttcctattattcattctctattagtcagaagttttgcaagcagacagaattcattttgccaattacgggattttccctcagttgcagtcaaggttcataaaactataactctttatctttaattagaaatgtttttttttttgagacaaggtcttgctctgttgcccagactggaatgcagtggcatagtggcccattgcagctttgaactcctgggctcaagggatcctctgcctcagcctcccaagtatctgagactacaagtgcgtgccatcacccatggctattttaaaaaaaaaaaaaattgtagagatagggtcttgctgtgttgcccaggctggtctcaaactcctggtctcaagcaatccttctgccttggtctcccaaagtgctgagattacaggtgtcagccgttgcacctggccaaaacgataacttaaaatacacacacacacacacacacacaaacacatatgtgtatttgtgtgtgtgtgtgtgtgtgtgtgtctcaaaaggtatcaaaagagaatagctataactttagtgttgatcttgatagtgacttgattaggctctgtttaacatcaaagatgcaaattaatactttctttgaacatattaaaaatgcagaaaatattggagtattttattttaaataaattgtattctgtatatttaaggtatacaacatgatgttatgggatacatataggtggttaaaagattactgcagtgaagcaaattaacgtatccctcaactcacatagttacccattttttttttgttttggtggcaagaggagcttaaaatctcatttagtgtgaatcccaaatacagcacaattttattacctatatacttcatgttgtacattatatttctagacttgttcatcctacatatctgctactttgtatcctctgagctacatctccccattttctcacttgccccccaagtagtttcttaaagtgtctcatgtaagagggcagtagctttcagcttaaactttttctctgtatgtagtcgatttctttgaggtatacttttctctccagaatagttagatgtaggtataccactttgatgttgacactagtttacctagaacttatcttctgtaaatctgtctctatttccatctctgtctccatctttgtctctatctctatctgtctatctctatctatctatctatctatctatctatctatctatctatctatctatctatctaaagcaaattcatgcccttctcctatttattgaatcgagaccatagacaggggtgagagaaagaatttggcaggaatggggatgtgtattatctgtggcataaggaaactttacagaactaggttcaaaagtatactttctagttctttcccatggcttttcactttgatgtagtccttatcaggtaactgaggttttatataagtcccctgattcttagaacatgaaggtgtagtagtcaaggttggtcccttgaaaccacaaattttgtgaaaaaaaattaagaaaattgaataatttcctcagcaaatacatattgatcatctgttatacagccatgagaagtggttctgttgcacacgtttattttatcagatcctaatcccaaaccaggcataaaatggaaaccatgaagataggatgaaataacttctgaatgtttgaatgtttgaaaatagtgtacttaaaaataccaggtggtttttgtttgttttttgtttttttctttttttgagacagggtctcactctgtcacccaggctggagtgtagtggtgcaatctcatctcattgcagtcttgacctcccaggctcaggttatctcccacctcagcctcccaagtagctgggactacaggcacatgccaccacgcccagctaattttttgtattttttgtagagacggggtttcaccctgttgcccaggctggtctagaactcctgggcttaagcgatcctcccacctcagcctcccaaagtgctaggattacaggcatgagccaccatgcctggcagaaaataccaggtttttaagtatcagcacttactcttcaatcttttctattactatgttgtgctaaatggtattttttatttaattagagcaatgctgttcaatagaactttctttgaggatggaaatcttttatgtttctgctatgtggtacagagccactagtgacatgtggcttttgagcgcttgacacatcttgtgcaacacaggaactgaatttttaagtaatttatattgccacatgtggctaccgtatgggacagtgtagtactagatgatctgtaagggctgtgcttcatcagtgtcgttttttaactgacaaaaacctttagttttttttttagtaatgtgtttatttaaaagaattcataaaatacaagtaaacaaattaacttgttacctgagcatatgtcctttcatacttattttttctgcatacatattttggaaaatggaatatctgccctttttttttatctgagatacagtctacctctaaaaatacatgattctaacattctcacttttgttggcatttgatcagggtatagaaaaacagttaaaaggacagagaatggttgagagattatgatatgaagagaaaatgtgattgagtgtggtagacttggggcctgcttgaatgttgagagaatgactgttttccgataaaaaaaaaaagtccattctaggatcctaaaagaagggtctgaagttcactgcagaaagcaagctacatagtactaagccactaaggggacatggagcccttagtaattcctaccttagtaatagtctcatcatgccctcttgggaacccagccttgttgattagcctctctgctttctctccttatagttcaacctccctgtttgttccaagcagttcttttcctgcccatttattatgcatttctatacagctttcctcctctttttctataccatgctgcagttcttattgctacctagaggttttcaaaattcctaggggcggataagtaggcataaacaaagttcttccctattatccttcctattttttcacctagactgaagaggtagacaaaatagaaataaagacattaagggtatgtgtttgtagtcccaaagagcttctctggcaattttatgtagttgacagtgacgctctgagttcaggacagattggactccttggctgagaggagtgaggagataggacggtagaggagagggtagagcaactctggaggaagctttcccctcacctttgccagtcctgttatcctagacttaaccataattaaagatgagggaggcactcagtaaagggatctagtgggaagcttgttccagacagccaaggagggaggttcgcgcagttcctttggccacccaggtggggtaattgatccatgtatgccattcatgtacaatgtaggcacttatacctgtattccaatgtagtgaactataccattactcttaaattaatattctttattagcttccatggtggctataggccaggcaagagagttaagaaaaaataaatagccaggtatggtgactcaagcctgtaatctcggcactttaggaggccgaggcaggaggatcgcttgagtccaggagttcaagaccagcctgagcaaaatagtgagatcctgtctctattttttaaaaaagccttggggcaaacaggagtatggaggtttggatgctaatagaacagcagtgtcttactgcttggagttctcttgtttcttgtcctatcaccgtagcctttggatcacagcaatttttccatgactccatacttttcagttcttgaatattttttcctttattcctcttgtctctgtaaagacatcaactggagttggactgtaataccaggtatctccagaagatggcactatttaacagattttataaataatttgatgtgagtcactgtcatctgaagcttgttgccttttctttctttcttctttcttttttttccccatcaattctgtatgtttgaaatgctgggttttaagttagttagaataagggatgtctgtaatttccctaaattgagaagtaatatgcaaaggttgatatcagaagtcatatgctcaccttgcaacaccaaataatactggcccatttgtgatttttgaaagtaacactccataataaatggatgtatatatagaagcataacaaaaatagaagcacataaaagtgaaaagtctcataaacgccattgtcactactcatgtaattgctgttacaaatttgtttaaatgttgaataaaaatggtgtcataggcaacacagtgttccactacttggtgtttttaatagcattattctgtctcagtgtgctttggattatcaggtgctttttaatagttgcatggtattacattgtgtagatgaacttgattaatttaaatggttccctgttaatggacatgttggtttgtttttgtgaacaactgatacagtgaacatttattttttaaataaaaaaaagagagacagggtcttgctgtgtttctcgggctggccttgaactcctggggtcaagcgatcgtcttgcctctgcctccctgggattacaggcatgaagccaccgcacccggcccagtgaacactcttgaatgtatctttgtatacttgtcagtgtttttgtagcattgattcccagaagtgggattactggattaagtgacatgcatgtttgcaattttaacaggtattgctatgtcattttcaaaagaagctatgccaattaatactctcaccaacaagagtgcttatttcccctcagcatattatcaggcttaagttttgccagtatgggtgggagaacagtagaatcacattgttttagtgtttgtttctcagatagatataattttacaccttataaccttctcttctataaattgtctatttgtgttcattctccattttcctatgggttcttattgttggagcccaatatataaaagggggtatttgttacagaacctcttcagttttggttcatgtcatgcctgggtttttaccctttctacggatgttaaaaaaaattctctattttcttccagtccacttatggctttattttttacatttagattttaatccgtctggaatttatttttgtgtatgctgtgaggtagggaccatacttttattttttcccaaatgggttactagttggccaaacatcatttattgaataattcatcttttccctactgactcgaaataccatctttattgtatactaaatcctcatatagttctgggtctgtttctgggctctactttgttcatttactgtgctggtactgcaccgttgtaattgctgtggctttgtggtatggtatggcttgctctctgctagggcaagtcgaagctcttttgttcacctgctctttcacccaaattttctgtcctgaatccagcacagccaaattatggtcattgtcaccaccaactacagtgggtgttgagcatttcccattgaatctcctgtaagggttttattggattctgtgatagcagtaaaatgggagcctaagaggtattccttaaaggactactaatcagacctggtttcccagatgatgctgaagatgacggggcctgggctagacttttgagggacatatccttggggttgggtgtgatatagaccagcccttacaatttgcttgactcatgggaatcgtacagggccagaaccagacacctgtcatgctaataacttccctcacaattcagaaatcactgtgattgaagatgggtggctgttataatactacccacttaaaaatggatgtaacccattttttaggactcttaaaaacatcaaatcagtaatggccgattaggactttttaatttttactaatctctacttgaaagttttctagtcattcatttcaggaaacctaattcttataattcatatcatttagaatatcataatgctatggatattagctagctaacttctcaaatcttctagttctcatttaatttgaagtttgtgtgtgtacataaggatatacatatacatatgtgtgtgtagatatatatatatatagttttttttttttttaactagaatgaccagtcaacaggggacataaaagtaattggtggagatgatctctcaactttaactggaaaggtatgtatcttgaaagggaagaaaaaaaagcacttcataccgagtcaattagtaacagtgtgctttcaatcaatcactaagagataatttacatagtataactaaatgggttatttaacccttggaagcagtctaggttaattatcgttccctaggtcatgtagtaaaaagacagtagaatccaacattaaccttaaatgtccatattgtcaagtactgctgtctgcctctgtgggactctaatttgggatccttcaaaaaacattgatgggggaaaagatagcctttaaaaaaaaaaaaaaaacaaacctatgtgagtctatgtgaggtagactcacatagtttcctaaaagatagcaaagcagtattatgtagtggctgaaagtgtgagttccggagcctgacaactgattcaaagcatggcttagtacttcctaactctgaccttgggcaagttacttaacctctctgtgtcccatatgtgattagggtgaggttgataatagcagccatagagttaagaggattaagtgctataatgcaagtagagctcttacaacagtttctggtaaatcactcaataaattcagacatactattattttaagaaatctcaaagagttttcttgtaccttaaaattctcctagtgtgaaccattggttttggtatattgtgcttccatgtagtttaatatcaagatgtttttagatttcccttttaatttatttgttgacccattggttgttcaggagcatgctgtttacctgaaaataatggagatattaaggtatttgaatatttatcttctagtacattgaaaaactttttgagagtaaccaataataaatgatggaatgctactgctttttttttttgaagctgccagttattgtttacttacactatgccaaatataaaggcattaatctcataaaagtttcacaacaatcctgtgagggagacgatatccccattttacaaatcaggaaattaagacttaataaggttaaaagacttgcccaaagtcacagaaccagtaagtggtagagcttgaatttgaatacagacctgactctaaagctcttttctttctttagattttagtgttcattgcttacttgaatgagtatctataagaaaactttaacatgtaaaacttctgtgaaattatcttgtcccatatcagggtcatgtcaaactaatgtcctcctcagcatctttggaaaacttcagaggagaaatgagctttgcccctcctgttcatttcatataccactgttagacctgtccttccctttcagcatgctttgtccatatttagaagctgttgaagccattacttgtctggtcagtttttagtgctggaatggacctagccttttaggccttctgagatttagtttgatctcgtctttcccacctaatggctctgttctactacatagatttgatctgaaacagttctctgtttctaaaataactttcttttcatgatagtcacagtaaagtacatttattatggaaaaatcaataagtataacgagtgaaagttatttcttggtggtaagattatgggattatttgaactttctgtttcattgtattttatttatttatttatttttgtgatggagtctcactctgctgcccaggctggagtgcagtagtacgatcttggctcactgcaacctccccttcccagttcaagtgattctcctgcctcagactcccaagtagctgggattacaggcgcacgccaccatgcctggctaatttttttatctttagtagagacagggtttcaccatgttgaccaggctgatctccaactcctgatctcaggtatccacctgcctcagcctcccaaagtaccgggattacgggtgtgagccaccctgcctggcctcattttgtcttttgggggtatttttgtgtgcagatatatatgtatataaatatttttccctcttttccccagttagtatttgagcagatgaactttggacccgaatacctgtattcaagtctctaataccacttcttggctattttcattttatcaaatggcctcttatcctcgtttttctcatttattaagtagagatgtaactacttgatataattcaaaaactcaataatggcattcttttgttttttagactctagtgtctgtactcgttgtaccatgctgggattcatttgaacaattgcatggcttttttagtgtattattaaatttgcagtttacttagaatttactgggacctcatacaaatgggaaaaaaacataactgtgttactcatttgctgtgtgcctttggattgaccctattttttgtattcattttctccccatgtcctgagttccactttgaataaaaagtaatttttttcctgcctgtaaaataggctaccaataggctgcagttgtctatagtagctgcttcactgaggagagctcagcatgagagaaatagtatgaattgcttgccacaagttatgggctagccttacttcattctgtacttggacctgtttaggcttctaagagatcttacctccaacaataaactgctttgagacatgaaaaggtggaagctttacttggttataactttacttttaatacctagaacagtgagtcttcaaacttgtatttgcatgcccaatttataaaaagtttcctgagcatttacccctaatatatgcattttaaattatatatgatttatggtaataataatatatatgttacaaaatacatacaaaaatatagattaaacaaggtgaggtaaaaaatttaaaagttctaatctttcttgcaaaccagtggatcttttgtgccttactctggtaaacactgtcttagaagaatatatagaacattaaaatcttaatgctatagttatatgacagagtatgatgagagctacagataaacaacacatcatgaatcttcttgtggcagtgtttataaccattatgtgaaatgctgcctcattcttataactagcataagaacagataggactttctcgattttgaggggtaattattagatggtattttctgttaaggactcttccagctataaaattcttaaatgtagaaagcgaagtgagggtttatggtgagaggaagcattggtatcatgttttagtgtagtccaagaatatggacacatccagaaaatgcagatcaagtttagcctaatgagaaaatatattttggagtccatatggtaaattaaattatgtgatttttgagttattgtacaaatataattcttagaatgttagagtcaggagactataagagaccaactgcttcaagtttcatttaacacatgggaaactaaggccagagaaatttcaagacttgcccaagattagacctcttgttaagtaatgaaagtgttttaaaaacaggtgggtcaaattctgtttttaaaatttccattatgatgaaaatttcagtattacaggcttccaaatcccagcagatgggccacttgtttaaaggagagtttgatataataaagcatctaaaaacaagagtttggataattccttagggttgttatgatgtgatttgacttataattggaaataccgttttattcattgtactgattttcatttctctttttcttctagaatgtcttgattgtggaagtaagttcacatttacttttaatataacatttatgacttttctaacttagtatgcaccatcctaaaggtaagccagggagagaaattcctctgcatcagttttaatggtgggcttgtgttctaaaggagtgagattggttttttgtaaagactacttagtaatttgtttttaccaataatggaatggtatacttcctacctctctttttttagtttgaagtattttctttctaaacataactctctctctctatttatctatatataatatatacatatatatcttatattttatgtatatatatatatatcttgcttagattttgtcttatgtaatatttggtacataaaaaataatatttataatttatagactattttccatgtgttattatgtgctaaagtattttgtatcttagcaccgagaggctaagcagtttcctagggttaccagctagtaaactaagggaaacctttacttcctttagctcagtggttctcaaaatgtggttccctagaccaaaagtattaatatcagacaagaacctaccgaatcaaaatatctgtgatgaggcccagcaagctatgctttaacaagtttccgagtgattctgatgcatgctaaggtttaggatcccttgtttttactcataagtcactttctcattaaggccttccctggccatcctatataaaatctcatgttttcacaccgtcaacttcgtattcctcctcaatacttttattttcctgatcacttatcactaacagcctctctctctctctctctctctctctatgtatatatatatatatatcacttatcactgtctaacagcctctctttatatatatataatctatagattatatatatatgcagcattgtgcaatcattatcacgctcaattttaaaacattttcattgccccacaaagaaacccaatccccttagccatcactccccatttccccttcccccagcacctagcaaactgatcatctacctacttgctgtctataagatttgcctattctggacattttgtataaatagaatcatacaatatgtggccttttgtatctggcttctctcacttaatgttttcaaggttcattcatgttgtggagtatatctgcactcatttcctttttattgccaaattgtatggatagacaggtgttcctcaactgtgtcctgataaacccatctgaagttgaaaatatcataagttgaaaatggatttactactttgataaatctatcctaaagtcagaaaaatctcatgttgaaccatcgtaagttggataccatctgaattacatttttgttatccattcactggttgacagacgttaggttgtttccactgtttgctccttatttctcgtacctgaaatgtccttattccctcccttcttatcccatgtttaagtcatttaagacccagctcaaacgtcacctccacaaaaccttccttgatacccctttcctcttcaattcacttggaccttttgcatttaattttaatttttattttttttaagacagagtctcactctgtcaccaggctggagtgcagtggtatgatctcagctcactaactactctgcctcccaggttcaagcaattctcatgtctcagcctcccaagtagctgggactacaggtgtgcgccaccatgcctggctaattgtgtgtgtgtgtgtgtgtatgtatgtatgtatatatgtgtgtgtgtgtatatatatatatacacacacatatataaatatatatacatatatatatatacacacatatataaatatatatacatatatatatatacacacacacacacatatatatatatatagttttttttttttttaagtagagatggggttttgccatgttggccaggctggtctggcctcaagccatcctcccacctcggcctcgcaaagtgctggtattataggcatgagccactgtgcctggcctgcatttcattttaattataaaatattttgaactcagaaaaaagggtatgctgaatacctacgtacccacaaaagtattaacattttgccatatttgcttctgatcttattttttttgagaaattaaagatcataatacaactaaagccccatttctttcccttcattcccagaagtatgacaattatccttaaagttgatatatatcattcccatgcatgttttttatacttccctagtacaagttagctgtatcctctgctcaggggctcatcaagctgaatcaagggactcatgatcctcttcaaagttccttcaggttgttggcagaatttagttccttgtgattgtaggactgagggcccgttttctcactggctgctggccaggggttgctcccagatatttaaaggctcatgccctagcccatgacagtctcacaacatggcagctgacttcttcaaaaccagcaggagaatcttgctctagtctaccacataacctaatcacaggagcggctatcccgttattttcacagatcctggtcacattcaaggggagggaacccttctgtgtgtgtacaccaggaggcaggaattttttttttctttttcttttttgttaaaaagtcttaaagtcttttatccctaaaggaggcaggaattttgagagccatcagaattctgcctaccacagcccagaaatctgcatttttcacaagtctccagccatgatgtttctgatggctcacactgctttattccatttttaaagagtatttttattgaaaagcattagggttatggtttaaaaaatattttccctaacaaagatgggtttgtttagagtcctacttttgactaaatagctgagattcacttttatgtaaagtcattttatagcgttattaatttgggtgcctttaaaaatagtataaagcatgtttctcgagtgtagtctgttagccacctatattggagagttgggaggagagagtctctatcttgaatttatgggaaaaattctaaaatactttttataatgaaggacaacatcataactccctaataaaatgtgcatgtatatattcaaatttgctgtcattgatcctgcacctacaaaatccagtcctgggggctggcattcttactgcttgctgagggccagatgatatagattccagaatatctccatgtagattttggtgagaattactgtgctgaaaagaatgacagtattgcagttatacatgggggttttggtactttatattgtgactctgaatttaaagctatgcaatgtcttcttttttgaaaggatataattgacactggcaaaacaatgcagactttgctttccttggtcaggcagtataatccaaagatggtcaaggtcgcaaggtatgtatgacattttgacacagaatattttcctcatttgaagggggattaagtgattgcttctttttaaggataaatgttttcaactgtcattttatcttcgaaaagtaatgtaatctcatataagacttaagatataatccttttaaataattttgtcatgtgttaataaagctcataattacagtcacttccttgcctaatattaacatttggtttttcagcatgctaattatatcagtttgtcctgaatagcatggcagaggattttgggcccccttgcaaaattaagaataaggattccaaagcgggtgaggaagtgataggaaggggtgggccctgaagatctggacctcctggaattgagtgatgaatgctgcatcttctttgtgtctgtagtgaaattttataatgcctgcttccttttttattaagtcggcctcacctcctcaccttacctatgctgttttacttttgcttttatagttctacctgtgtttatttctcattttcgtttcatctctcaacaactctggggtggcattattattcccacttttcagataaggttactgaggcatagggaattgtccaaaggtacagagctagtccgctatagagatgagatttgaacccagggaacctggctcacagtttatgcttttgctaccttaagtttttaatagagtgacatcaaacaaacatttaagaatatgtttttcttttccttttataatttcattaaaaacattaagtctctgatcagtctgcagtttttatgtaggggtcaggtaatgttctaacttctgctttttcctaagtgattaacaggtttttataagcccttttgaaaaaatcacggtatctgtcgagcatctttgaatcagagtaagccttctagtgagtcatatgtcagcagtttgactgtatgggcttttctaatatccagttcaagtgtttatcagtgagtttttcttttaaatagatttgggacaggtactatgagagtatataagtgatacgttataggacactaactagtatcctatgaaatggcaaaaactgcaatcacttttgcaccaaccaaatagaaactaatcagtgcacttgcttatttttctacatgctctttagggttttaaatgtcaacctactgtggcatagactttaatcctctgggtattcttttgttgttctttcctggtatatgctgtggaattgagatagactggttcgtgagcgagagattttgtgttgccacaggtaggacatgctcaaacaatacttgggtcatttcttgacccaagtcatctattcaccatagttttgtagcaccgatcttgcatacatttcatgtatcttctttgaaccccacgtcagtgctgcttatatgatactcagaaattaaacactaaggaataagattttcaggtaggattgagttttggagggtcacaaatcttgtaatgtctaatatttccactctccctgctgagaattagttttggcttccttggaggtgatatcgcctctgttgagtataagtggcctactgtgatcacaccactgcactccagcctgggtgacagagtgagaccctgtctcagaaaaaaaaaaaaaaaaaaagaatgcatggcctagatgacttctaaggtttttcccacccagttccagttttcatgttctaggcagagcagtaaagtgagaaacacatggacttgggagtttagtctcgcatttcactgccacttaatctgagcgactattccatatttaatctctctgaatgtatttactcatctttaaaggggaatgattattaacatctttttctcagggaaactatatgagtcaaggagataatatatttgaaaatctttttaactgcaaagcgctgtttcactgttggttataatgtgattgatctcattgtagtgagcagctgcttaattgcgttttagaatgtagggaagatagtaatatttttcacattatatatgtagctggttctggaactgtaaacatactccttttttatggagatctgagtcacgtaccataaaattcactcttttaaagttgtacaatccagtggtttttgatatattcagagttgtgcatctgctaccactatttcattttggaacccaaagaaaccttgtacccattagcagtcattctcccttctcccagcccctggcaactactaatctactttctacagaaagtccgtacagatttgtgtattatggacattccatataaatggactcatgcaatatcctgtcttctttcacttagcatagtgttttcaaggttcatctaggttggggcatgtatcagtacttcatcccttgttttggctgaataatatttcattgtacaaatatatcacattttgcttatccatctgttggtgaacatttgagtttctacctgttggcttttatgaataatgttgatttgaatgtttgtgtacaagtatgaatacctgttttcaggtctcttgagtatatagttgctaggtcatatagtaactctgtgtttaacattttgaggaattgcccgactatttaacaaggtatatgtactgttttacaccagtaacatatgagggttccaatatctccacatccttgacaacacttgttactgtcctttttattgtagccatcctagtggctatgatgtggtatctcattgtggttttgatttgtgtttctctgatgctgatgatgttgaacatgttttcatctgcttattggccatttacatatatcttcttaagaacggttacccatttacagtatggaaaatgcttcagatgcaactctagtcatgccttagagatggagctttattaaacattcagatctctaggcatatgaagtgctgagttctcttgaactcctaatacagattgcactgagtttagtgataccttttctggagcattcctgagttcaggtagggagaagggtttttgctgtgattggcttgttatgttctttctaaatggaaatagaattgaagtgtctcctctctccatttattggaagagtcatgagggacataattagatgatcccttggagtctccggcttaggtcagtggttatctacttaggctgcacattggaatcacctgagagttaaaaaaccaggataacctctgcctgtgtctcatctccagcaattctgatgtaattggtcagggctgtggcccgagtaggtgagttctggttttttaaagctcccaggtgattctgatgtgcaatccaggttgagatcactttgggccctttccagctctttaaacatatatatttatctaggaaggtatgaaagcataagttttcttgagactgcctttaacatctgtaaaggctttcaaagcagcttctgtagttttttttaaatggctgaatatttttcaacaggcagcatttgggttataaaattagcttttggtagagttgacttataccacctccagcttttgttccaaaaataaatactggttcttttggcacactagttgttttaccctaaagttcctctttgtaagccagttattaaaagttgtgatgcagccagggcgaagtggtacacatctgtagtcccagctactcggaaggctgaggggggaggatcgctagagcccaagaagtcaaggctgcagtgaactgtgattacaccactgcactgcagcctgggccacagagcgagactcatctctttaaaaaaaagaatgttgtgaggccgggcgcagtggctcacgcctgtgatcccagcactttgggaggccgaggtggacggatcacctgaggttgggagttcgagaccagcctgaccaacatggagaaaccctgtctctactaaaaaaaatacaaaattagccgggcgtggtggcacatgcctgtagtcccagctactcggcaggctgaggcaggagaatcgcttgaacctgggaggcagaggttgtggtgagttgggcgagccattgcactccagcctgggcaacaagagcaaaactccatctcaaaaaaaagaaaagaaaagaaaagaatgttgtggccaggcgcggtggcttacgcctgtaatttcagcactttgggagaccgaggtgggcggatcacgaggtcaggagatcaagaccatcctggctaacacagtaaaaccccatctctactaaatacaaaaaaaaattagccgggagtgctggcgggtgcctgtagtcccagctactcaggaggctgaggcgggagaatggcgtgaacccaggaggcagagcttgcagtgagcggagatcgcgccactgcactccagcctgggcaacagagcgagattccgtctaaaaaaaaaaaaaaagaatgttgtgataaaaggtgatgctcacctctcccacacccttttatagtttagggattgtatttccaaggtttctagactgagagcccttttcatctttgctcattgacactctgtacccattaatcctccttattagctccccttcaatggacacatgggtagtcagggtgcaggtctcagaactgtccttcaggttccaggtgatcaaccaagtgccttgtctgtagtgtcaactcattgctgccccttcctagtaatccccataatttagctctccatttcatagtctttccttgggtgtgttaaaagtgaccatggtacactcagcacggatgaaatgaaacagtgtttagaaacgtcagtcttctcttttgtaatgccctgtagtctctctgtatgttatatgtcacattttgtaattaacagcttgctggtgaaaaggaccccacgaagtgttggatataagccagactgtaagtgaattactttttttgtcaatcatttaaccatctttaacctaaaagagttttatgtgaaatggcttataattgcttagagaatatttgtagagaggcacatttgccagtattagatttaaaagtgatgttttctttatctaaatgatgaattatgattctttttagttgttggatttgaaattccagacaagtttgttgtaggatatgcccttgactataatgaatacttcagggatttgaatgtaagtaattgcttctttttctcactcatttttcaaaacacgcataaaaatttaggaaagagaattgttttctccttccagcacctcataatttgaacagactgatggttcccattagtcacataaagctgtagtctagtacagacgtccttagaactggaacctggccaggctagggtgacacttcttgttggctgaaatagttgaacagctttaatatacaataattgttgcattattatttcagatgataaatgtggtcataagtaagaaataaatgatcgagtttagtcttttaattcactgtcctttgaatacctgcctcttactctggaggcagaagtcccatggatgtgtttatgaacatggttgaggaagatttaggaagactgcaacagtacactacctaaagcaggttttttactccatctttttttgccacgtacactggcctcccactttgatatgcttgaaattatctccttgatttgtctttcaaaactacatattgaggctggttgcggtggctcacacctgtaatcctagcactttgggaggccaagccggacagatcacttgaggtcaggagttcgagaccagcctggcaaacatgatgaaaccccacctttactaaaaatacaaaaattagccaggcgtagtggtgtgtgcctgtaacccagctacctgggaggctgaggcaggagaatcactggaacccgggaggcagaggctacagtgagccaacatcacgccactgcactccagcctgggtgacagagcaagactctgtctcaaaacaaaacaaaaaacaaaaaactacgtattaagacaagaaacagactgggcgcggtggctcacgcctgtaatcccagcactttgggaggctgaggcgggcggatcacaaggtcaggagatcgagaccatcctggctaacacggtgaaaccccgtctctactaaaaaatagaaaaaattagctggggtggtggcgggcgcctatagtctcagctactcgggaggctgaggcaggagaatggcgtgaacccgggaggcagagcttgcagtgagcagagatcgtgccactgcactccagtctgggtgacagagcaagactccgtctcaaaaaaaaaaacaaaaacaagaaacaaattaaactaatgtgatagactactgctttgttttcaaaagatacactccccaaaagttactgatctaaaatacagtagtactatctctgtttagtaagaaccctgacaactaatagtgttcttatatgtaaaatgctattcttgcctttcatttcagaatatactttttaaatgtgaatttctggatttttttttatagcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaatttaa

SEQ ID NO: 77 - DNA, 4067 bp, Homo sapiens
  modified_base (869)..(869): a, c, t, g, unknown or other
  modified_base (2622)..(2622): a, c, t, g, unknown or other
gaattcctaactgccccggggcagtctgctattcatcccctttacgcggtgctacacacacttgctagtatgccgtggggacccctccggcctgtagactccatttcccagcattccccggaggaggccctcatctggcgatttccactgggggcctcggagctgcggacttcccagtgtgcatcggggcacagcgactcctggaagtggccacttctgctaatggactccatttcccaggctcccgctacctgcccagcacaccctggggcatccgtgacgtcagcaagccgggcggggaccggagatccttggggcggtggggggccagcggcagttcccaggcggcccccggggcgggcgggcgggcgggtggtggcggcggttggggctccgggcgcgtcgctcgctcgctcgctgggcgggcgggcggtgcgatgtccggagaggatggccggcggctggcccgggggcggcggcgcggctgcccgggagcggcgacgggagcagctgcggcagtggggcgcgggcgggcgccgagcctggccccggagagcgccgcgcccgcaccgtccgcttcgagcgcgccgccgagttcctggcggcctgtgcgggcggcgacctggacgaggcgcgtctgatgctgcgcgccgccgaccctggccccggcgccggagctcgaccccgccggccgccgcccgcccgcgccgtgctggactccaccaacgccgacggtatcagcgccctgcaccaggtcagcgccccccgcggcgtctcccggggccaggtccaccctctgcgccacctggggcatcctccttccccgttgccagtctcgatccgccccgtcgttactggccctgggtttncaccctatgctgacaccccgttccagtccccttaccattcccttcgaccaccccacttccgaattggagcgcttcaactggctgggctagcactctgtgtgacactctgaagctctacattcccttcgacctactctcttcgattggagtcgctttaactggccctggctttggcagcctgtgctgacccatcgagtcctccttaccatccctccctcgacttcccctcttccgatgttgagcccctccagccggtcctggactttgtctccttccctgccctgccctctcctgaacctgagccagctcccatagctcaggtctggtctatctgcctggccctggccattgtcactttgcgctgccctcctctcgcccccgagtgcccttgctgtgccgccggaactctgccctctaacgctgccgtgccgtctctctcctgagtccggaccactttgagctctactggcttctgcgcgcctctggcccactgtttccccttcccaggcaggtcctgctttctctgaccagcattctctcccctgggcctgtgccgctttctgtctgcagcttgtggcctgggtcacctctacggctggcccaagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtgttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggcttagcacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggccctatgtccacttcaggacagcatgtttgctgcctccagggatcctgtgtccccgagctgggaccaccttatattcccagggccggttaatgtggctctggttctgggtacttttatctgtcccctccaccccacagtggggccactagggacaggattggtgacagaaaagcccccatccttaggcctcctccttcctagtctcctgatattcgtctaacccccacctcctgttaggcagattccttatctggtgacacacccccatttcctggagccatctctctccttgccagaacctctaaggtttgcttacgatggagccagagaggatcctgggagggagacttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagnccccaatttatattgttcctccgtgcgtcagttttacctgtgagataaggccagtagccacccccgtcctggcagggctgtggtgaggaggggggtgtccgtgtggaaaactccctttgtgagaatggtgcgtcctaggtgttcaccaggtcgtggccgcctctactccctttctctttctccatccatccttctttccttaaagagcccccagtgctatctggacatattcctccgcccagagcagggtccgcttccctaaggccctgctctgggcttctgggtttgagtccttgcaagcccaggagagcgctagcttccctgtcccccttcctcgtccaccatctcatgccctggctctcctgccccttcctacaggggttcctggctctgctcttcagactgagccccgttcccctgcatccccgttcccctgcatcccccttcccctgcatcccccagagccccaggccacctacttggcctggaaccccacgagaggccaccccagccctgtctaccaggctgaccttttgggtgattctcctccaactgtggggtgactgcttgggcaaactcactcttcggggtatcccaggaggcctggagcattggggtgggctggggttcagagaggagggattccctccaggttacgtggccaagaagcaggggagctgggtttgggtcaggctgggtgtggggtgaccagcttatgctgtttgcccaggacagcctagttttagcgctgaaaccctcagtcctaggaaaacagggatggttggtcactgtctctgggtgactcttgattcccggccagtttctccacctggggctgtgtttctcgtcctgcatccttctccaggcaggtccccaagcatcgcccccctggctgttcccaagttcttaggtaccccacgtgggtttatgaaccacttggtgaggctggtaccctgcccccattcctgcaccccaattgccttagtggctagggggttgggggctagagtaggaggggctggagccaggattcttagggctgaacagagccgagctgggggcctgggctcctgggtttgagagaggaggggctggggcctggactcctgggtccgagggaggaggggctggggcctggactcctgggtctgagggtggagggactgggggcctggactcctgggtccgagggaggaggggctggggcctggactcgtgggtctgagggaggaggggtcgggggcctggacttctgggtcttagggaggcggggctgggcctggacccctgggtctgaatggggagaggctgggggcctggactccttcatctgagggcggaagggctggggcctggcctcctgggttgaatggggaggggttgggcctggactctggagtccctggtgcccaggcctcaggcatctttcacagggatgcctgtac

SEQ ID NO: 78 - DNA, 6065 bp, Homo sapiens
cttcagatagattatatctggagtgaagaatcctgccacctatgtatctggcatagtgtgagtcctcataaatgcttactggtttgaagggcaacaaaatagtgaacagagtgaaaatccccactaagatcctgggtccagaaaaagatgggaaacctgtttagctcacccgtgagcccatagttaaaactctttagacaacaggttgtttccgtttacagagaacaataatattgggtggtgagcatctgtgtgggggttggggtgggataggggatacggggagagtggagaaaaaggggacacagggttaatgtgaagtccaggatccccctctacatttaaagttggtttaagttggctttaattaatagcaactcttaagataatcagaattttcttaaccttttagccttactgttgaaaagccctgtgatcttgtacaaatcatttgcttcttggatagtaatttcttttactaaaatgtgggcttttgactagatgaatgtaaatgttcttctagctctgatatcctttattctttatattttctaacagattctgtgtagtgggatgagcagagaacaaaaacaaaataatccagtgagaaaagcccgtaaataaaccttcagaccagagatctattctctagcttattttaagctcaacttaaaaagaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccggtaagtaacctctcagctgcttggcctgttagttagcttctgagatgagtaaaagactttacaggaaacccatagaagacatttggcaaacaccaagtgctcatacaattatcttaaaatataatctttaagataaggaaagggtcacagtttggaatgagtttcagacggttataacatcaaagatacaaaacatgattgtgagtgaaagactttaaagggagcaatagtattttaataactaacaatccttacctctcaaaagaaagatttgcagagagatgagtcttagctgaaatcttgaaatcttatcttctgctaaggagaactaaaccctctccagtgagatgccttctgaatatgtgcccacaagaagttgtgtctaagtctggttctcttttttctttttcctccagacaagagggaagcctaaaaatggtcaaaattaatattaaattacaaacgccaaataaaattttcctctaatatatcagtttcatggcacagttagtatataattctttatggttcaaaattaaaaatgagcttttctaggggcttctctcagctgcctagtctaaggtgcagggagtttgagactcacagggtttaataagagaaaattctcagctagagcagctgaacttaaatagactaggcaagacagctggttataagactaaactacccagaatgcatgacattcatctgtggtggcagacgaaacattttttattatattatttcttgggtatgtatgacaactcttaattgtggcaactcagaaactacaaacacaaacttcacagaaaatgtgaggattttacaattggctgttgtcatctatgaccttccctgggacttgggcacccggccatttcactctgactacatcatgtcaccaaacatctgatggtcttgccttttaattctcttttcgaggactgagagggagggtagcatggtagttaagagtgcaggcttcccgcattcaaaatcggttgcttactagctgtgtggctttgagcaagttactcaccctctctgtgcttcaaggtccttgtctgcaaaatgtgaaaaatatttcctgcctcataaggttgccctaaggattaaatgaatgaatgggtatgatgcttagaacagtgattggcatccagtatgtgccctcgaggcctcttaattattactggcttgctcatagtgcatgttctttgtgggctaactctagcgtcaataaaaatgttaagactgagttgcagccgggcatggtggctcatgcctgtaatcccagcattctaggaggctgaggcaggaggatcgcttgagcccaggagttcgagaccagcctgggcaacatagtgtgatcttgtatctataaaaataaacaaaattagcttggtgtggtggcgcctgtagtccccagccacttggaggggtgaggtgagaggattgcttgagcccgggatggtccaggctgcagtgagccatgatcgtgccactgcactccagcctgggcgacagagtgagaccctgtctcacaacaacaacaacaacaacaaaaaggctgagctgcaccatgcttgacccagtttcttaaaattgttgtcaaagcttcattcactccatggtgctatagagcacaagattttatttggtgagatggtgctttcatgaattcccccaacagagccaagctctccatctagtggacagggaagctagcagcaaaccttcccttcactacaaaacttcattgcttggccaaaaagagagttaattcaatgtagacatctatgtaggcaattaaaaacctattgatgtataaaacagtttgcattcatggagggcaactaaatacattctaggactttataaaagatcactttttatttatgcacagggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttgggttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctgtctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataa

SEQ ID NO: 79 - DNA, 19856 bp, Homo sapiens
aagtgtgagcaatgacgaaactggagagatagggttttaacaagatgcaaggacaatctgaggactgagagccatttcaacgtgagcccccagtctgagaacaagaaagaagaacttctgtctcgaggtaaaaaggcctgctggggacctggggtccaggtgaagggatgggatggttgacagaactgctcaggtgaggacaggcttctcatgaggtccctgagaaacttgccttttggagggaaatgtcctctgccctctggagcctggggagaaggttatttctgcccgccagaccagcatgctcgcttttcttccatgggcattcaggaatcctggccccattctgacattcctcaaatggaggaattcctcaaattaccagaggaaagttaccaaagtttagatctgctggagctcttcaaggattggcctgagacaagccgggaggtgccacggggcttggagctggccctgtgaggcacctccgggggaagttcatgtcctaggtggttcacgtcatggacctcttggaggtccgtgaatagatttattcatgggatttgtgaattggggggaaaaatacatctttattttcactaatctttaattgaaagtcagcacttgcttcagttatgaatgtagacaatgaaccacaatagaatttgccatcaatagaaaacacaaatattttcaaatctcattacagtttttatagatttctccaaatgtccttaacgctcagcactactacagaattacaacagttattaggctgatgtcaaatctaaagaagcatgtgtactgctctaccacacattcttctaatgttttgacaactgtcttgtcataatttgttccctttattatcccatgtatcttattaatttttaaatgttgttctgagaagggactccatatgccttcccagaccaccaaagaggtccatggcgcctttatgtcaggcacctgctttggtgtgttgagcaggaagcctgagatctcagacaagagcttcaagggccccccagcccaaacctctgtctactaacaagtctggttctactttaaggcagttggggttgtggagattgaaaaagaagccccttcacagctgcaaatgagatctttctgggcatctttttcagtgtcgtgggagatctgtatacagaggtatttgtggagctcagagctgaccttccagctcctctgagaggttagatccgggctccggtggcagaggaaatggagactcttccttgccctcttgtccccaccctccccagaaaacctctggcaaagctttatgtgtcatctaaccgtcaccacattcctatgaggtagttttaaacacaagaggaatgtgaggctgagtgaggtccagcaatgtgctggtcacacaaagcttggatttgaacccaggagtccacaagactccaggaccgcctccgaaggtgcgggagggaagagtttcccgccgtctgtgagctgtcgcctgagagaggcaccgagccctggggccaccagcgcagctcaggagccccggggaccatcaaagatgaggatgccaactccacgggcaccctcccccctgcccgcgctggggctcacaacgttttaagaggggagacccgcccctggcgtgtagtgggcccggaaaattcccagacttctcacgaccacccgctctcccctctgttgagggccaggtgccgctctagtacatgctgcgtccccaggacccaccaggcccaactttgcaccccctcatctcccctcctagtttagactttccctggctagcccccatgctcgctggatggcccatggctggagtgacgcgggccaacgcggggcaggtagggggtcactcggctttggctgaaaggcagcgccctctagcggccagagtgcgaaatcagcgccgccggctccgcgctgccccgcctgcatcacaacagggtgctcccctcccgggcaccaaggtcacttcccagagcatccttgcccagtgacctcgctgccccccagcgctggtgaggggcccacaacagacttacatgctcttcttcaactcggccctaggcaccgcgaagtctggccactccagcggagtgaccagctgcatcagcccctcccgcctgtcctctctctccttggaagcggtccctaccctgcgcccctcccatcccgctgcaccagtcccttaggaaacacgcctagagaagggacacgaccttgtcaacattccacagctacctagtgcggagccaggactggaagccagatctcctcagcccattccccaccttaattcacccaccgtattctttagtcaccagctcccgagagcccacaaacaactatgaaggcctaacttcattgccatcttgcagcctttccacatccctcatccagaatttctcctgtgctgccccttgacactttatgaccttattacttagtacagtcgttcttgtgttaacagctgttcgtgaatggatgagcggctgtgaggagagggacaaaggggactccaagagaaagactctcataacttgggttagagtcctgctccccaacttaggagctgtgattttaagcaagtcacaagtcccctccaagcctctatatgcttcgtacaaataataaattttagaaaataataatggcttagtgttttataaggactaaacacagtcttgcaggtagatgtgcctggaacactgtccattgattccaatataagaaagcataaaactaatcatagctatcatttattgagcccttactctctgccaggcactgtgctaagtaatttacataggtgacctcatttgaccctcacaacccaaggaagagaatattttgtcaccattttataggtcattaagagattaagaaacttgcccaatattacacagatagttaagtttcaaagccagatctgaaacatcctggtctgactctagagaccatttaaccactaaaacgtccgcctctgctgtgttagtgatctctctgtgccccatggtgtctgacacattatagatgctccgtgtttctgaaatatgtctatttattaaaggctgagcatagcgcctggcccaggagcctaagaaacttgaccgagtcatgcaactattaagttttttttgtttttatttttgttttttcgagacagaatcttgctctgtcgcccaggctggagtgcagtagcgcgatctcagctcactgcaagctccgcctctcgggctcacgccattctcctgcctcagcctcccgagtagctgggactacaggcgcccgccaccacgcccggctaattttttgtattttttttagtagagatggggtttcaccgtgttagccaggatggtctcgatctcctgacctcgtgatctgcccacctcggcctcccaaagtgctgggattacaggcgtgagacaccgcgcccggcgccactattaagttttaggaccaggatttgaacacaaacactctggctctagagtctacgctttttaaccataattctgggctgaatgaataattgcaatccttctttgtcttcctctttgaataaaatgatttgtcattttattcatttatcctctttgtcacttaatattccatgtttcaagagtcaccaggacattctggtgtagcatgaaggtatgataacacaggagaaggaacaaggagaggtcaaggctaggaaaggacattggggccataccatgagctgctgctgggatgttttattaggattgtgacaaatgtatagataagtacagaagaatttaacaatcgtctctacttagattttcttttatgttccttaatagtactgtatagtttgtatcctataggtcctattcggaatgttgttacatttttctggacatttgatgggttttttggttgctataatgaatggaacttttccttctaccatattttctgactaataattatatccaggaaaatttttaatcttatgtattaataagtaccttattaaattgtatgtatatacactaatttagtttattgttttatacaaactataattacataacattctattctgtggatctgcaataatttattcaaccattctcaccagtgggtcttcacctgtttcctttttttatgggggcaggaaggcgacaaagttttgctctgttgcccaggctggagtgcagtggcgtgatcttggctcactgcaatctctgcctcccaggttcaagcaattatcctgcctcagcctcctgagtaggtgggatcacaggcacctgctacaacacccagctaatttttgcatttttagtagagccagggtttcaccatgtgggccaggctggtctcgaactcctgacctcaggtgatccgcacgcctcccaaagtgctgggattacaggtgtgagccaccacacctggccttcacctgtttctatttttttggtattataaaaaatgctgcagtgaatatccttgtacatctatactagcacactcatgcttttatttctgtaagctatagccaaagggacagggtatgtgcatttgaaatgttaatatataatgagtattcccccaaagctccgtaacaatgtatagttctacctagagtgaatgattgcacatatttcttcttacccttaccaaaatttgatttatcttttaaatttttgttcacttaacaggtggtaattctgaaattctgaactctgaatttttaatttgtacttccctgaatacttgtaaaactgaaaaactttttattgcatttcgtcttttgtgaactgcctattcagatactcttttattgtttctaataattctcaattaagtttcttgggttttctagatgtaagttatatcacatataaatagtaataaatttgccttaagatttccaatatttataccctttgctttattttcttgtctaaatataatggcaaacactttcagaacaatgtgaaataacagaaataataggaagcatctctgccttgctcctaatattaatagaaattatcccatattttaccattaaatatgatgctgcaattttatctgagatatacatttctccattatattgaatagtattcatccattaccattttacttaggattttagtgggaattaatgtaagatgttatcagaaggtaatattgactttcttttttatccagtagtatgttaattaatagatttcctaatattaaatcatccaagaatttctaaaaatgaaaccttattccatttgtcatggtgtattatatttttaatatcttgtatgattggttaatttgtgtgtgtgtgtaatttttgattttggttttcttgagacagggtctcactgtcaaccaggccagagtgcagtgaagatcatacctcactacatccgtgaactcccgggctcctcccacctaagtctcttgagtagctgggacttcaggtacgcaccaccacacgtggctaatttttgtattttttgtaaagacatggtctcactttgctgcccaggctggtctcaaactcctgggctcaagtgatcctcccacctcggcctcccaaaggcttgggattacaggcgtgagccaccgcaactgggcctttcaatttttaaaaatttaaatataatattataaaacagaatacagcagcacatgaaaagaataacatactaggccgggcgtggtggttcacgcctgtaatcccagcactttgggaggccaaggtgggtggatcacaaggttaggagttcaagatcaccctggccaagatggtgaaaccccgtctctactaaaaatacaaaaattagccgagcgcagtggcaggcgcctgtaatcccagatactcggcaggcgcctgtaatcccagatactcggcaggctgaggcaggagaatcgcttgaacccaggaggtggaagttgcagtaagccaagatcgtgccactgcactccagcctgggcgacagagtgagactctgtctcaaaagaaaataacaacatactatgaccaaatggcttcagtttttgtttgtttgtctgggactgcaaagatgtatcaattttaggaaatctattaatgtagatcgccatcttaatatatcttaaagaaaaataatatcattttagttgatatttaaaggcaattaataaaacattcacatccatccttgacattttaaaactcttaataaaatagaaataaatgtatattccttaacataataaaatacatctcattctcaaagctactataatacttaataaggaaacatttaagcatcccccattaaacttagaaaaaagacagagattcattattaccattattatttaatatttttctggagatattaaccaacacaattagaagaaagaaatcagagatataaaatagaaaaggaagtaattatcattatgtacacataatatgattgcataactggaaaatccaagagaatcaactgaaaaatgatagaattaagggaggggagctgggtatgaaattaatatctagtaaaacaaatagcctttcatatatgaacaataatgaaaaattaaaagatataatgaatgatataaagagactgaaaaaataagttaaaagatacaacgagtggaaacaacagatgctggagaagatgtggagaaataggaatgcttttacactgttgatgggagtgtaaattagttcaaccactgtggaagacagtgtggggattcctcaaggatctagaactagaaataccatttgacccagcaatctcattactgggcatatacccaaaggattataaatcattctacgataaagatgcacaagtatgtttattgtggtactattcacaatagcaaagcctgggaaccaacccaaatgtccatcaatgatagactggattaagaaaatgtggcacatatacaccatggaatactatgcagccataaaaaaggatgagttcatgtcctttgcagggacatagatgaagctggaaaccatcattctaagcaaactgtcacaaggacaggaaaccaaacactgcatgttctcgctcataagtaggagttgaacaatgagaacacatgaacccagggtggggaacatcacacaccgatgacgttccacgggtgggggcccgggggagggatagcattaggagaaatacctaatgtaaatgacaagttgatgggtgcagcaaaccaacatgaaacatgtacaactatgtaacaaacctgcacattgtgcacatgtaccctagaacttaaagtatattaaaaaaaagatataatgggtaaaagatgacattttcaatagtgaaaaaatatgaattactcaagaaacaaacttagctaagaaatggacgaggactttatgaagaaaacttctatacatacctgagacacacatatttgaaaaatgaatatcacattctcggatcaaaagaatcaatgtcacaacaaattcagttctccctaagttaaaatataaattgaacatatcccaattttaaaataccaataggactttttcttgatggtacacacagtaggaagggcaagactagacaagctgattataaaaatcagaaaaataaatttatagaaaaattcttgttttccccttttgaattttaaatgctgtgaatgtaattaccacttcaaaagttataaactacaaaaccttaaatatatttttaaaacacatacacacatagagaggattttttaaaataaaaatgtatttattttatatacataattgcaatttgccctttttgacctaatgctatatcatgaacatccctccaggcccatatttatagaagtatctcattcttttaataatatataatattttgtcacatagattaattgaaacttattaaaccattttccctattgatgaaattcaagtgtttgtttttcttcagtttgtttattttgaaacaggagtaatttttcttagccaggattagaagatgtaactataaaaagtaaaacaataaaaatattgaaagaaaattatagcctcaattggagggaaactttcctaaacaatgcaggaaacccagacaacttaaaggaaaagatagatatgttgtatttaattacatacaatgtaaactttccttgtgaaaaaaaagcctcataaaaaaagtgaagagacaaacaacaaattgggagaaagtatttgcctaaaaaaatggcagatgggttaatatctctaatacggagaaagtgcctaaaagttaagaaatgtgaagaatatgaacacacaattcacagacaagggaatactaatgaccaataagcatatgaaaagatcctcaacttcactaatcatggaaatgcaacataaagcaggtctaatttttcatccatcagattggcaaaaatgttaaagtacagataatacccagagctagcaagggcacgaggaaatgtacactatcaagcattcttggtgaacatctgattatcaacagcctttttggagagcaatctgattatagtagaaaaaaagttttaatcatcatattctttgacgcagcaatccaatttaacttaaaaaaatatatatgagaaaatagcctttagtgtctccctatgcccctccctccccggctcccagtgtatctcacttggtttaccgcctcacttcccagccagctggactctcatgcccaagccctcctctacctccatcatactctagccaatcaaagctagagcctgggatggggaaatggtcttggaaccctggaaggctttgtctagtgggtccccctgtgcttttaggagactgaagccaaggataccagcagagccaacatttgcttcaagttcctgggcctgctgacagcgtgcaggatgctgttggaacccggcagaggctgctgtgccctggccatcctgctggcaattgtggacatccagtctggtggtgaggatagaccctagagcagagacggccatggggaggatcctgggcttgtgggaagggctggatcccgtgattttctctagtggggaaacaaaggactcttttttttttttttttttttttgagggagtctcgctctgtcacccaggctggagtgcagtggcgcgatctcggctcactgcaacctccgcctcccatgttcaagcaattctgctggctcagcttcccgagtagctgggactacaggcttatgccgccaccgccggctaatttttgtatttttagtagagacggggtttcaccatattggtcaggctggcctcgaactctgcctgacctcaggtgatcctcaggcgcccggctgactcactctccttgacattaaggaaagggtaaagaatatattgtctttttctttttcattagaactgatactattgcctctctatcagacactctgtctctgctatatgtttcaaagagcctggcaatctgcgcctcaacctaagattcctttaggctcttatatactataaatttatgaaatccaggtttgagatccagatactgcaatcttcattaacttcagcagctagtttaaccactctgtgcctcaatttgtgtatttataaaatgggaagagtaatacctgccctctatggctatactgaggatttgatatacagaaaagcactctaacagagaccctatagaagttccagctggaaagtagaaataaaatataaaccattttggagtgaatcaatggctgggattgcaggtctccctcagatatgggtcttggaagacccatatctcttactcttgtaggagaatggcattcaatatgcagggggcagcctccatctctgcctcttcaccgttttcatgagagtgaatttagtttactatgtataccaaggggagtcttaaaaggaaaagcaagtcatagcggatcaagctgccaagggagtgggggagggggctggcagcctcagcatctgccggatgagttttcagcagagagctggatttaaccgaggttggggttttgcgaggatccatcacagtaggagtaaagctaagggagctgagggtggatataagggagagattataataatggactacaaaatataaactacagaaggaagtgaagtttgaggagagtgaggggcagtacaaagttggcagggccaatgcattgcaaaattaggtcagagacacccatcgagccaaaacatcctgggttaacccaactattttctccacttctgtatccaggttacagattacttacagggaaaatcaagtgggcagactggcaccatcagagtcatggtctttggatatcaatggtccctcaataattagtctgtttctccagtccattctcactccatttccacacagtggctgtttttaatcatctctggtatttctgtggtctctctcatcctatatttcttagaaaaacttttactcatccttcaagtcagctccagcactaacttcactgtgaagtttccctgatgcttcagactcaggaatctctaagattcctcaattataataactgtggaattaaattgtaactttttgctaatttgtttttacattaggctttaaactctgagagtggccaggcacagtggttcatgcctgtaatcccagcagtttgggaggcagaggcaggagggttgcttgatgcctagagttcaagactagcctggacaacatagtgagaatctgtctctacaaaataaaaaattagccaggcatagtggtgcatacctgtagtgttagctattcggaaggcggaagcaggaggattgcttgagcccaggagttcaaaggtgcagtgagttacgattgtgccactgccctccagcctgggtgacacagcaagaccttgttttaaaaaaaaattttttaaattaaaaatccccggtcatctaatggttaggggaaaaaaaagttctgacagtagggctcacgtcctagtcctcatagccccagcagggcttggcagagtgaatacctaaacgtatttgttaagtggaggaacaaataaacctatgaattaatggatgctttgagcatattatttagtcccttaattttcattttccagatgaataaactactgcccaaggagttaggtaacttgcttacagtcacacagccatcgatagagctggaatttgtatttcctgtctgccagcactactgccaggttctgcttcagtccttccttgaagacttctagtgataaggagcagttacggtgaaattcacagaatgctacctgacctctgggtaattcttccctttccattccaggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacaggtgagtgctcaaatactcctaatgccaccaggtgggacagtgagcagggttgacagtggagatgtaaccagatagttcaggtcctggaaaggcagtttccttcttcctcaatccttttccaacatccccattggcagatgctgcctttcttcaaagcgcacacacaaacataatctcattttgtctttaattttagaactcttacttggggtggccattgcatttttactgacagggagatggtgacacaggggttgaagagacttgtccagtgctactcactggtgaaagtaaaaacagatagaaattaggcttcctggccaggcatggtggctcatgcctgtaatcccagcattttgggaggctgaggtaggcagatcacccgaggtcaggagttaaagatcagcctagccaacatggagaaaccctgtctctactaaaaatacaaaattagccgggtgtggtggcgcatgcctgtaatcccagctactcaggaggctaaggcaagagaatcgcttgaacctgggaggcggaggttgcagtgagccgagattgtgccattgcactctatcttgggcaactagagcgaaactgtgtctcaaaaaaataaaaaacaagaaaagaaaagaaagaaattaggcctcctgattcccaattcagaactctcccagaaatgtggctatatttctaaattcaggcagacaacgagattaggtttgagataatatgggtgtctgtcttaaggagcatttagttggaggaaacagaaaccaattcaaagtaccatagattaaaggaggaaaaaataaaaaagtacagctggccctcatgagttctagctcctggaatcagaaactagaaaggggacaggacgcaaaacagttaccgtttcaaactgtgaggcagcaaggcctctggcttctgcatctgtctttcactctatgcatgctccccctgctccattactactttggcatatcctaaatatggccactccagccccagctttaagtggcttccttaagtcaaattgtgcccaacagaaagtgtctctctgtgtaactatattcctagacaatagagcaagccttcaaaattctgtgggaaaaaaaaaatttacctagaattatatattcagccaaactataaaccaaatgtaaggaaagaaaaaagacactatcatgagatgcaatgactcaaaaaaatttgccttccatgtgatcttttcaaagaagctaccagaggatgtgcttcagtaaaacaagaaagtgaatccataaaggggataaaatgacatacaggaaacaaggagtctaacaaggaagttctaggctggacacagtggctcatgccagcacttttggaggccaaggtgggaggatcacttgagcccaggagttagagataagcctgggcaacacagggagacaccatctctagtggaaaagaaaaaaaaaaggaaattcaagaattaaaaaagggcagttagtccagaagagagcaagagaaagacgactctggaagggagatctctaggaggtaaaaatggaatcgacatatcatctttctaaaggcccattaaagacccaataaaaagattaaagaaatggatatggaaaactctgccagtaaaaaaataaaatcaggctctagaaaaaactaaattttacaaaagaaacatagcgcacaacttgattttgcaaaaaataacacagaatccaaattatgtaaacatgactaatttaaataaaatttgtggtacaattatttttagaagaatgcagagaaggaaaatgggtgaaagtataatcctcatctactatattctagcacatcttcatctactgtagcagaaagccaatagaaaatgtctaaattttatcactaggaagcagcaatatgagcatattatttaggaatataataagacatctcgaagagttgacagtggttgtctcagacaataagcctaggaggacaaaagggcactgctattattctctatgaacttttacaactatcttacttctccatgaacttacaactatcttacttttttttttctttttctttgattttttgagacagactctcactctgtggtccgggctggagagcagtggcgtgatctctgctcactgcaacctccacctccaaggttcaagtgattctcctgcctcagccgcccaaatagctgggactacaggcacacgccaccacccatccaactaattttttttgtatttttagttgagacggggttttgccatgacggccaggctggtctcaaactcctgacctcaggtgatctatccgcctcagcctagccaaagtgctgggattacaggtgtgagccaccgtgcctggcctatcttactttttaagaaaaacaagtataaattacccactcaccaccctccccccatgaaaaactggcccagagcctttgaacaaatgtttctaatcacctcctatggttcctagttaattcaaattttcaacttgtttagtttgactgactttgttccttgcttcctggtgtcttcctgtctgacctagctatagcattcagcacttctgactattccctccttcatcaaactgtcatctccagtggcttctgtgactgtactcccctggctgttctacccacctggctgttcttttgtcttctctatttcctcctcccacctctcaaacatgagtattccccaagactcacttctcaccccttcaaccttttctctttactctctctccctagttctcatctacccacgatttaaaccagcatctccctgcaactgaccagcaaatcaacttctccagcttgaacacctttcctaagttttaattaaacgtttaaactaaaaactgtactcctagctcctggatgtcccaccatttcctcaaactcagtatcaaagctatcctcctgagaccctatttctgttcatgacggagtcaactttggttcctccttttttcttaacccccaattcagagagttactaagtactgctgttcttccgcacagcagtacttagtggggaagaatagcagtactttgttattcctttccttccaaaggtgtttttcaggtcttcatcacctcacacttaacatattcctatagtctcctaactagtgagtcccttgagttcagcaactgtgccctagtcacctttgtatctcccacacctaccacagggcctagcactgagctgttgcctaatggtccagcaactctaaatactgtttctgcctccaatccattctacatactaccaccagcttgtctttccaaaatgctaatttgtacatgccacatcactcaaagttttaatggcttctcactgtctatggaataaagtctaaattacattagcctggcactagagactctatagcatttcattctatttatgtgaatacattgcttcagttaaactgcactagtggatactcctctttcattcatctaacaaatatgtattgtgcatcccaggcccagcgctatgccttggagaacagaatgaggtataacacagtccttgctccttataacctaaatcctgttctcctaatatattgttttagttgtgaagattctccctaaggaagaatgcttttctcatcttctcagcatatttaagtattagagtcagcacatctagatggttccccaagtgtggaaattaggtgcattttggaaggtaaaactagttaagaagagacaggtaataaacaatgtcagggtgggtggtggctcacgcctgtaatcccagcacttcaggaggctgaggctggcagatcatttgagatcaggagttcgagacaagcctggccaacatggtgaaaccctgtctctactaaaaatacaaaaaatagccgagtgtggtagcacgcacctgtaatcccagctacttgggaggctgaggcaggagaatcacttgaacccgggaagcagaggttgcagtgagccgagattgcgccactgcactcgagcctgggcgacagagccagactctgtctcaaaaaaagaaataataaaataaaataaaaaacaatgtctgccatttactgagtgcttactgtgggccaggcattgtgctaagtgatattatattatttaatctccatggtcttttgagctattgtcctgtgataactcaagcttgaagataatttatgttcatccaacagtaaatgatggataaaaatccagatctagtccaggtgcagtgtctcatgcctgtaaccccagcacttagggaggccaaggcaggtgcatcacttgaacccaggagttcgagaccagcctgggcaacacagtgaaaacctgtctctacaaaaaatacaaaaattggctgggcgtggtggcacatgcctgtagtcccagctactagggaagctgaggtgggaggatcgattgggctcggggcatgaggctgcagtgacccatgatcatgccactgtactctagcctggatgacagagcaagaccctgtctcaaaaaaacaaaaacaaaacaaacaaacaaacaaaaaaaacccagatctattccaaaagggcaagattttaacttatgctagattgcttgaaccactctagaaaatggggctatttggggatacccaagtccaaggcgactaagctgtttcagctatctctgtggcaaaactttagaattactttaagatctatctgcatccctagtgtctgacacacaggagattctatacttatttatggctgcctaagtacatcatcattacccacaatgttaaaaatacttatttgggcaacgaattacagagggaggaatccttggagatcataaaagagatgttatgagatgatgcaaaaggagatactgatgatttctgaaaccctcccctgatccatgattctcttttgaaccagagacagggaactacacagtgacgggattgaaacaaagacaacaccttgagttcagccataatgaaggcactctcagttcaggcttcctacaagaaaaggtctgggtaatgctggtcaccagccttgtggcccttcaaggtatgtccaaaagagccgtaagcaccccaagcaatgagggtgctattatatttctgccaccttggttattctccaggaggagaaggttggaaaggatgtccagggggagagaaaaatgttactcaagccctggctatccacaggaaagttcaaaccagtttcactgatccaaaggcactaaggaggaagacagataaatcagacttttcaatgggtaggaggtaagactcattaggaatgaaggcctgtgagagaggcaagttagtacaactacctctactcactgcatgaacagagggctacaagttgaagcaacagattttcagctattagaggaagaaaaggcaagagacagacttggtttggagatgggttttgaacaatgcggctcctcagcaaaggctgatggccagattgagtatattaaacacatgtagctgagtcctctgaaaaccatttaccaatatagattagcgttttccctattagataacaaaaagtgaaacttccaataatttgtcataacgtttttgcataacaagcaactgattcaggtttttgcctggccttggcattcttaactccattttatttaggcattcctcaaatcaataactaccactgttttgaatggcatcagaatgtaagctctatatatatgtaaggactttgtcttctttaccccaacgaaaagtcccacacatatggcaggctcttaataaatttgttaaaaaacctgtatgatgaatcagatgctttacacatgatgattctaaccttatacaacccttgcaagcaaacatcccctggttactcatcaggaaacagacacaaggaagttaaatagggcctggtgcggtggctcacgcctgtaatcccagcactttgggaggccaaggcaggcagatcctttgagcctaggagtttgaggccagtctgggcaacatggcaaaaccccaactatacaaaaaaatacaaaaattaggcatggtggcacacaactgtagtcccaagctaaggcatgaggatcacctgagcccaggctggttgaggttgcagtgagccatgatcatgccactgtactccagcctgggtgacagggtgagacactttctcaaaggaaaaaaaaaaaaaaaaagagttaattgttgcccgtcacagcaattaatacagatccttctcactctaaaaccttacactcagtaatgatctactatatgcaaagcacctcttacatccttcaccaccccattcattctgagattgactcctcccctttccagaaacaggaccacctaaacattccctattccagtcccttatttgcaagtcatcaaaagaaaacagagatttcaaaaagaaaacagagaccttatctgtaatccttggtaaggatcttccaaatttaagcctatgccagttttcaggaggaaacatgaatatgaaacagtctgacctttagacataattttttgttgactttaaattcccttggttaggccactgtaaccagtaaaataaattttattttagaataaaaattataaaggggaaattgagtctagccatacaacctactactagttactatctttgattcccaagtcatcctagagcaaaaaaaaaaaaaaaaaaatcatctctggcctttttttccttttccactcaggtgaagagaatgagcttttgaatccaattttttgttttctcctatattcaattcaagtagctttaaagttaaccaaaggaaaaaaccaaagctcaatatttgattaaacgagaaaatatacactacttagaagctttcttttctttatccttcttccccaactcaaggcttagtagaattattgaaagaggtagtattcagtagaatagtacacatgctttttcaggtccagaaacaccacataggtcaagttatcatgcttacatgtggggaaaaggaggagggagtttcctggacctctgtgcctctctcagctcatgaactagtttcagtgaatatccttgtcttaccactgtgccaacaattcagagctatacgtggaaaacctaccttcaactttttgagtggcatctattgcttctttgattgttccttccagcaaggagcgatcaaaggctagcccccttcccactcccaccagaatcagatttgctcaagattacaaccctaatttagtaataagatgcaatacataaaatagttcccactttccttttccaatccctttacagtcatgagggcctatcacgcacgcatctcaggacaggtgagacttcattatatcaggtattttgttgctattctaagttataaggcagtaatacaaactttctttccacagctttgtaagccttgtgccaaaagaaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagtatttggagtcttttcttttctcctaaatccacaaactctcttctttctctttggacagatgacctcttgtcatagttaagcagagagtgggcaggatattcctgataggaggaactacatgaataaaggggtaag

SEQ ID NO: 80 - DNA, 16303 bp, Homo sapiens
cgtcctatctgcagtcggctactttcagtggcagaagaggccacatctgcttcctgtaggccctctgggcagaagcatgcgctggtgtctcctcctgatctgggcccaggggctgaggcaggctcccctcgcctcaggtaaggcctgaaacccagcagagcagcagggaggaaaaacaaggctaagcttggttggagacttgggtgcttgtgtagggaagactccaagagcatgccacagctgcttgagagaaagaaattgcaacttttagagtcctgtgtactcttatttaagaaaggacaatctctgagaatgaggtggggttctgtttttggtggcagatgaaggactttgcagacttccggggttggaggagcctgactggccagcacaagaaggagcaggagaagaagaagggctgggcaggaggcattgccagtttgcttttagaagctcattcctgctccagcttcttttctgttgcctttcaggaactttccaggaaaacattataagttctctgtgaattgaaaatgtctttttcacagattccagaggttctaccactagagactgattttttgttaaatttatttcttctatattaaaaatcagagtcaaatatttctgagggaggggaacacaaatatttaaaaactgtggtataaattagtttttatgttgccttctgaactatctgaggatggagatgtgcccagggttgctggggagaggttaagtgctgagagggtggttatgcctgggagaagcagggtttcctgctaagcttcctttgctattggatttcttggctttcctgaaggttttttcaggcactgcaaatgacaatcaaccaaacagcaaggttttatttcaaaggataatgcatccagcatagaactaggccgcaggaagaaacataaaaacaaaacaaaataaaaacagaagaggtggtatcagctgacaagggcttatattctaagtgggtagacaaaataggcctacgaaaataacaagctggccatgaagctacatagcagaatatgcgagggggcaacgtgctaagttgtgtagtcataagccaggcatttagtaaggtgctaattatacaatacaggcagtgaatgtgaaaggaaaagggaggttgagatgggctgaggtcttctaggaggcggggagggagtgcagccttgacaagcctccctgtgggcgaggtgtaaagaggggcagaagtcagctctggaagcatagggcagtgggtggggaggagatgggctgggctgggctggagtagagatgtgtggagaagggtgagaagactggaaagacaacctgaatgggggactgggagccttgaataacaggcatggagaggagcgtctcttgaaatggaagaaacaggaaataattacagcctctatggaggagcaacaggatggactggagaaactatcattccaaaatccagttggggcctcaaaggcccttagaatttttctaggaaggttgaaggccagctgctgacccaggactcacatgtgcttcgtcctcttccctaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcaggtattcctgctggagcaagttggtggataaacctctccctctagcatagaaaatgcaatcctgaaacactgcacagcagggcttctcaattcgggatcacatttgaatcacctgaggagattttaaatcatactgatgccgaggcctcacccagaccaattcaatcagaatccctaatagcagagctaaacaagggtaaggtctaaaagcatttccaggtgattctaatgggcagccaatactgagaaccactgttcttatgtaagaagcacatcttacctatatttcctaggaagaccagttgatgaggtcatatgcaaaagttcccatttattggtttagtataattgtgcaaattagaattaacccctaagtgtataaagagtagagctggttaaaaacatagcctgtgctaagtttaattgtacagtaatttacatttgtgtggtacttccaagtttcccaaatgccctcatatttgttatccacctgtacatttaaaccaattcccagaggttagaaaaggattcttatcttatctgagagacagtatagcaccatggttaaaagctcagactctgacaccagacagtctgggtgcaaatcctggctctgctgttgccctcagacaggatttcttagcttctctgtgtatcagttttctcatctgtgaaaggaggatgaatataagaccttatgcgatgctaatgtaggattaaattccctactacaagaaaatggtcttagaacaatgcctggaacatggtaagtgctgtataagtgttaactattagtatgattcccatttgtttgatgcaggcagaagctggagcttggagttgctcagagtggtagagctgattttaacacagatgtttttgttctactaaactgcatcctcagaactcctatttactgctgtcagttatgttgaagattaagttatatggttgcaaaatatgtgtaaactgagaagataaaaggttaccttaaagtttcctttcaaatgttacttctttttttttttttttttttttgagacggagtttcgctcttgttgcccaggctggagtgcaatggcgcaatctcagctcactgcaacttccgcctcctgagttcaagcgattctctcctgcctcagcctcctgagtatctgggattacaggcacccaccaccatgcccggctaattttgtatttttagtagagacagggtttcttcacgttggtcaggctggtctcaaactcccgacctccagtgatctgcccgcctcagcctcccaaagtgttacttcttaactgatttcacataggccaaacaaagactggttaagagttgaggctctggaattgcactgtctggggttgactattgcagttgaccccacgaagtctgggtaaattatgtactttttttctcagttttcttgtcgataaaatgtggcaaataatttcatgagctgatacaagtaaggtcttacaacagtgctagataggtaataagcttaacttcataagggctagtttttatgctatttattggttcatggttagaggaggcctgggacaataagcagggcaggggacctagattctggcaaagtaaccaagtgatggccttgaccattctgggctctttaccccagtgtcatatgccagaggacccatcaccagacggcaggaccgggaacagggagggagttcatcaggcagaaggcccctgtggagtggtagtaccagcaactgaagaccaaatgggagctatgtctggttgctaatctccaggccaggccattcatggagatcggtggtcctgacatgcacactcctccccaagaccacagtggcacggctatttcccagcctgaacctggggaaatgaaggtgcaaatttcttctctgtggctcatggacccctggggagagagatcagaagatgttctattggacccctgtgcagcctccccacaaagcctgtatgtttccacccttttgccattgcagactccagggaacaccattggtcactcggctcttccctcttgtttcccaagtggtcagttgcttatgtggaatgcaaactctccttaattacttgcattagcacaaaccctggcttctttttgaacctaatctcaaaccttagtccaagtccctatcctaatactatctgtaatatttaagctattcctaaccttaatgctaaaattgtacttaaccccaaagtcaacctggttaataggcagaagttttaagtaacccttatacagagtctgccccttccccaccctgcatgtagtgatgtcatgcttactcagggctgcttctgtttcaaagaccttgatatctttgttctatgaccataactgtgaatggagacattggtgcttttatttcaaaccaaaaattccaaatgaaattgatacatctaatatcccaagttccactctggtcccaattgtatctcgaacttatccttaaacctaaccaaactcattatcataatcttccctaaacctcaacatgcttttcactccatctatcttcatctgtccccaaggtgtaagagaacccaggcctaaccctgcctccaatctggctctgtccccaaactgatcatatatcctttcctggttttatggatagccctctgcagcccctcttacctgctgcagtgtgttctctatgacccctgtgctttccatctgtcctctttactccagagctaactgtatggctatggctaaccagaagccgtcctggccaactgtgactgagtccctcaaggcaggaggaacatgttctggggaatttgaattgtgcaggcaccacccttgtcttatggattggattcctaagccaccttttagcaacccagacccttaggtagagggatgagatgtgaggcttctgctgcatcctttgaagactcccctggatacctgagccctacctgagctgctggggcagactggaaacctacctacagcgcagcatgcatgggggtgatggtgttctttttctcacattcttcttgggtcagatcttactcatctcttcaaaactcccctcctgcatcttcttgcttccacttacatgttatctcttaatgaaatgcactagttcatgatttcacttatgccacaaatatttatatttactgagcattcgctatgtgtcagatgctgagaaaacagcaaaggataagagtccagagcctcatgccctccagggtttcacagcctagctggaaataagtgttataggcttaagggaaaaggttacatactttttttcatttttgtaatttaatgttaactttattttaattttgaattaaatatttttattgatatgatttcatatttgaagttcaataaaagaaaatattcactttctgagtttttttctggaactactatttgtttcatttcatgattaccaaaaatgattttgtcaaatagaagaaacgaatgttaaaatgacctgctctggtatcaaatatacaaggtacaccactgctgaaaatatcagtcattgatttcatgatgggccagatggatactctgctgttcaaagtgttgggcttaaaggctccagtcccatggttacacaaagggcttggccaatcctcccctctctgccgtgaagctcaggctgccctggggaaatcagcttcacttctggcttctgccactcatctctgttttgtcctccctctagtggctgagcacggtgccaggttccagattccattgcttggagccatggccgcgacgctggtggtcatctgcacagcagtcatcgtggtggtcgcgttgactagaaaggtaatggctccggctgcacaccgcagtcatgggcacccccacgtctggcacccgggtcctttcaggttctctttccacccagagagagacccagatgtgatcttcccgagtgctctttgtgcctttttcctggcatttgttctgcctattagtgcagttatttatgctcttccgttgtccctctcatagggagggaccccctggacagctggacctgtttcctacccatcttgctgtcatttgtaactcctggtttctgcttatcccttaagccactgctctgagagtttaatttatctactatgattttgatgcatcgtgggcatctatatatgctagagctttctgcacattagctcttttgattattacaactctctggtagtgctaggttacccagcatgtctgtagaatgagaaataaacactccaaaaatgtagggttaggccaggagctgtggctcacacctcagaagccacagatatggctggtgctattgggaaagtcaatgatctgtaatattttcatttatgtgttggctatcacaatagacataattccacccactcgggagactgtggcgggaggatcacttgactctaggagttcaaggctgcagtgagctatgactgcactccagcgtgggcaacagagcaagactctatctctaaaaaaaaaaaaaaattggtggtaaagtgggcatggcaagatcagcaggttgtaaatcctctgtttagcttaagagcttatgtggctgaaagagtaatgaatggggaattgaaagatctagtttctagttttggcactgagtgtatgcttttaggaaagttacttaatctttcaaggtcttcatttccttatatataaaatggggatttgtcttagtctattttctgccgctgtaacagaatacaattattgggaaatttataaagaaaagaagtttatttggctcatggttctggaggctgggaagtccaggagcatggtgtatttggcgaggttcatcccacggcagaaggcatcatgtgatgagtgcatgcatgtgagagagagagagaaatgaggccaaattcatccttttaattaggaacttactcccatgatacctaacccactcctgagataatggcattaatcccttcatgagggcagatcttcatggcctaatcacctcttaaaagcattaccacttaatactattacaatggtaattaagtttccaacacatggccttttgggggacacattaaaaccatagctgtattataattcggcttactctatatcatagagttgtgatgaacaagtggcatatttcatgtaaaatctttataaataacaaagaattatatcagtgaaatttatgtcatcagctactggtattgattgggaggagtgaaagaatttccactccttgttttgtctgatctcttgggccctttaagtcagctcagcccaggtcaccttaattcaagtcaccacataaatattttgggaaacacaagtttgtaatttctacctttaccccagaccctccacctgagatcctaacccacttttcctccaactctaattccattcaattaacaactcagttctgcagcctggttgaactgcagtggctgagacatggctggtgctattgggaaagtcaatgatctataatattttcatttatgtgttggctatcacaatagacataatgaggaaatgaaccctctatgggaaggtgaggacaagagaaatgattgaatagaggggggaggtgaagaagatgaaagttgatctcttagctgggaagggagctgctatggtggttggtgaacaggttctctgctgttagcagtgtcctgatggtctggaataaaagaatcaaaggctctttagaaggagctgaacaacttttcctgttaaggattcaagactggttaattttcattctgggcacctggactaactttggtcatctggagggtagagaaagagaaaaaggtgaagagacctattgagtcctgttgctccctttctacagtgtttgattccccagccctctctgacatttccactgcttcctgtgtagtgtgggtcctctctgcatctttcctgtgctttggatatagttgtcagtcttctgtctctctctccttgctcaaagcattttatagttgcattattcagggttccagcagggaacatgtagtactcaaactgggttgtttgaagacagtttaataataggatttccagaagtctagtaggatgtaaggacaccacaaggaggagtagcaaggtgctgtaaccattcctagttcttcaaagggtaggggaggggctaattattggagcctggaaggagagagttatgtggaggggtctccttcagaagtgctgtagtctttgctggagggtcacaaccagtccaaggccaccctgcagaaagaacaaagggaactacataccctcatctcattcctctctccattcccctactgttgctttgcattggctgacctcaaacttaggatggaggataaggggactcattgatgtagtacatttagtacagtcttcatagggcacagaatagggtggagaaggttagagagcagagccaagaggcaaatggctggtatccattcaagtagtgctcatagacatgaacactggacaaaggatcttgactttccacagggttggctggcttcagccttctctcttgtagtcttgacctcttttgattatgtatgtaagcaatacccttcttggctgcccagctgtatctctcctgggcacactgtgctctattaaccattttaatattcccatggatcaggctttcttggctcccattgaagtaattacatccattttgtttctttaagtgctgctatctgttctgtactattttgggatctcctcatcctcattgctactaggaatccagttctgtaaaagcatctcctattttagccctagcctatagaggagagatgccaccaaacttctcaatgatgctggagctcccctagcacattcttttccagcttagtaaaagggatattctttttctttttcctttttcccctttattgttgctattatcttaagggatgttctctggatcttccctagaaaagtcaatataatcagctattggattttggaaattattcagtacagggattggcaaaatttctctgtaaagaggcagatagtatatctttttgggtttgtaggtcatatggtctctgttgcaacaattcaactctgccattgtagtgtgaaagtgctatagattatatacaaatgaatgactatgactctgttccaacaaacctttatttataaacactaaaatgttaatttcatataatttttatgtgtaataaaatattcgtttttctttctataaatttttatgttttaattttttatatattttttatttcaataggtttttggggaataagtcctttagtggtgatttctgagattttggtgcacccatcacccgaacagtgtacactgtacccagtgtgtagtcctttatccctcagccctctcccactcttttccctgagtccccaaagtccattagtcccttgtatcattcttaacgcctttgcgtcctcatagcttagctcccacttctgagtgagaacatacaatgtttggtttttcattcctgagttacttcacttatagtagtggtttccaattccatccaggctgctgcaaatgccattattttgttcctttttatggctgagtagtattccatggtgtgtatatatatatgtatatatatatacacatatatatgtatatatatacacatatatatgtatatatatatacatatatatgtatatatatatatacatatatatgtatatatatatatacatatatatgtatatatatacacacacacacacacacacacacacagacacattacaatttctttatccactcattgattgatgggcatttgggctggttccatatttttgcaattgcaaattgtgctgctttttgtataatgacttcttttcctctggatagatacccagtagtgggattactggattaaatcatagttctacttttagttccttaaggaatctccacactgttttccatagtcatactagtttacattcccacaagcagtgtaaaagtgttcccctttcaccacatccatgccaacatgggttatttttttattttttgattaaggccattcttacaagagtaaggtggtattgtgttttgatttgcgtttccctgataattagtgatgttgagcattttttcatatgtttgttggccatttgtatatccttttctgagaattgtctttttatgtccttagcccactttttgatgggatttttttttcagctgatttgtttgagttccttgtagattctggatattagtcctttgttggatatataatttacaaatattttctcccaatctgtgggctgtttactctgctgattatttcttttgctgtgcagaagatattactttttaaaactatttttgttttaaaaaaacacttaaaatataaaagccatctttagttcaagggctgtaaaaaaccagcagtgggccatatttgacccacaaaactcagtttgccatttctgatttagtaggtttattctctgagcattttgttccccttttccatagtttgccaaagcagtgttgtcatctctattgacagcagtatatcagaatcatctcctggggcccttgtgagggtgttaaatattgagcgttccaatattgacgcattatccctcatccaggcttatgttctaccccctaccacaatccatcaccttcagaattcatgcctaggcatcttctcccagtccctgccagtagatgttagccaggtcctgtagtatataacctttctattctcttagcagacccagcacttcctccattagcatgggctgagattttatcctaattacgggcctgatggacagtaggggaggcagaggcagggcccagcagggattcttttccatcaaggggaagtgggccacttctgcagctccagatggtataagagaagcaggtggttcctggctctcaaatgcatctttccagagatcctcattccaagtttcaggagactcctcctctactatcaagatgctagctttggcatagaaaatttacctaggcttagaatcagccttctttaaagtcctgtccctcttacaattagcttatgtacctggtcttcagctgtggatagacgagtgtcttttaaatgctgccaaggaggagctttaactctcacactttgagttgctgatagatctgaggctgtcattttctcacttcagtccatcggtgcaatttagcaaaagtcaattttgagtcctaatattaactattaccctatactgttgacccaattccagagttctaacactaactatttaccctatacacctcaaatgttagagtcagtgcaccagctcatagtttccatccatctgtgtcccatctcatttcaccaccagtcatggggtttgtgttgccatctagcaggtgaatgatcccattccacaatcctgttcttacaggctgccttctaggactattcccagcagcaactgttttagatcaggtccccggaaatagagcctgacatgcaaattttggtgagagtgacttattgggacagctctcagatgaaaagtagtgaaggaagcagtatagggagggctaagggaagaaagctcagcatggatatggtctcagctggagacttggctgaagcaagaattgtacagagtcggttgaacctttaggcagggagctggcattttggaaatccacctaggtcagtcattacttctggctgctcaccagcgagggcccaagagcaattctccagagaaggggctgctgtgagctcacagcgtacactcccagcatctggaaaatgggagtgctggtcaggtagagagatctgagcaggaactgtacattagttatgggtctccggagggacagaaccaataggagatatagatggatggatggatggatggatggatggatggatggatggatggatggttggatggatggatgggtgggtggatggatggatggatagatagatagatagatagatagatagatagatagatagatgaggagggatttgttaggggaatttgttcaggtgattgtaaaggctgagaagtctcaccacaggctgtctgcaagctggagaccttgggatgctggtagcatggctcagttcaagtccaacagcctcagaaccactgaggctgttggtgtaattctcagtccaaggctaagggcctgaaaacccagggtcaggagcactggtttaagtcctggagtccgaaagccagggagcctggtgtcctgatgtccaaggacaggatgagaagagtgtgtcccaactccaaagagagaaagtacaattttgcctctcttctgttttgggaaaggcaggcctccaggtgagtggatggtgcttggctacatttagagtgtatcttacctactcacttcactcagactgacatgccaatctcctttggaaacaccctcacagacacacccaaaatgggctttactagctctctcagctcccttaatccagttaagatgatacctaaaattagctatgacaggcacaacagcattcactacagaccttgagagcccatagactgtgttatttaggagcatgttctttggaatcagacagtcctaggtttgggtcccaactcaaccacttgagtagctgtaccacctaactttgatgaacctcagttttctcatctgtaaaatgccgataattatggcattgccttcataaggtcatgagaaaacttcagtcaaataataattaatgtaaggcacttagcatttttcctagcatgtaagctggaaaggtgagtgggaccatcacaagggatgtttttgggatcatcacaagggatgttttggggatcatcacagtttcttatgaggaatgtagtgaaattatggattttcttcttgggcaaaattttctatacaatttacaaatcccctgaaatccagctgtgcatctcaggttaagcaccctcctatatacagtggagccattgaagagttttaggcagaaatatggactgacacaacttttgtttttgaaaatcactctgctggcgaccatgtggagttggactagaagtaagagggagtccagagacagtgaggatgaagcccaggtgtgagagaagacatggatatagagatggaaaagagggagtagatttcagaactgcctaggattaaaattggatgaagttttacagataaattgagttgaacattagcctccagatttctgctcagctggtgccataaaccagggcagtgaatataggggcaggagtggtttgttggggcaggaatgtgatggtgtcgtttgagacaatttgagtctgagcttgccgtgggtcatcaggtgatgatgcccagtggacaggtggacacctgcatctggagctcagggcagaagcctgggctagtttagatagagatttgggcatcttcagaggacagatggtggttgtagatgtaagaaagtagatgctcatgaaatcactcagagagcatgtttagcgtgagagaaagcagagagcagaaccctggggaaccccacggtttggggagctgatgtgcaaagagaaaaggggcaggcctggctgaagacgaaggtgggggttcaaaggaggagaagaaaatcaggagagagtgatgccaaaggatccagagaaagagaacatttcagaaagtaagaggtcgacagagtcaagtgcagtaaacagtacaagaaaatagagaatggaaagctgcctcactaagcttagtgaacaggaagtaacaaggtgtgtggcacgtggtatatgtagtaagtgcagtttccatggactagttagcatttaaatctagctgtaacgcggttgagaaattaagggctaaggaattggtgttggtaagaacataagtttgctggtgtgcatgtgtgtaagaaaggaagagagagatgtcatattggggattaactgttgaataacatccccacatactcactttgtagtttgtttgtttttagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataaatgcaaaattaaaaaatatcttgacctggttttaaatctggcagtttgagcagatcctatgtctctgagagacacattcctcataatggccagcattttgggctacaaggttttgtggttgatgatgaggatggcatgactgcagagccatcctcatctcattttttcacgtcattttcagtaactttcactcattcaaaggcaggttataagtaagtcctggtagcagcctctatggggagatttgagagtgactaaatcttggtatctgccctcaagaacttacagttaaatggggagacaatgttgtcatgaaaaggtattatagtaaggagagaaggagacatacacaggccttcaggaagagacgacagtttggggtgaggtagttggcataggcttatctgtgatgaagtggcctgggagcaccaaggggatgttgaggctagtctgggaggagcaggagttttgtctagggaacttgtaggaaattcttggagctgaaagtcccacaaagaaggccctggcaccaagggagtcagcaaacttcagattttattctctgggcaggcatttcaagtttccttttgctgtgacatactcatccattagacagcctgatacaggcctgtagcctcttccggccgtgtgtgctggggaagccccaggaaacgcacatgcccacacagggagccaagtcgtagcatttgggccttgatctaccttttctgcatcaatacactcttgagcctttgaaaaaagaacgtttcccactaaaaagaaaatgtggatttttaaaatagggactcttcctaggggaaaaaggggggctgggagtgatagagggtttaaaaaataaacaccttcaaactaacttcttcgaacccttttattcactccctgacgactttgtgctggggttggggtaactgaaccgcttatttctgtttaattgcattcaggctggatcttagaagacttttatccttccaccatctctctcagaggaatgagcggggaggttggatttactggtgactgattttctttcatgggccaaggaactgaaagagaatgtgaagcaaggttgtgtcttgcgcatggttaaaaataaagcattgtcctgcttcctaagacttagactggggttgacaattgttttagcaacaagacaattcaactatttctcctaggatttttattattattattttttcacttttctaccaaatgggttacataggaagaatgaactgaaatctgtccagagctccaagtcctttggaagaaagattagatgaacgtaaaaatgttgttgtttgctgtggcagtttacagcatttttcttgcaaaattagtgcaaatctgttggaaatagaacacaattcacaaattggaagtgaactaaaatgtaatgacgaaaagggagtagtgttttgatttggaggaggtgtatattcggcagaggttggactgagagttgggtgttatttaacataattatggtaattgggaaacatttataaacactattgggatggtgataaaatacaaaagggcctatagatgttagaaatgggtcaggttactgaaatgggattcaatttgaaaaaaatttttttaaatagaactcactgaactagattctcctctgagaaccagagaagaccatttcatagttggattcctggagacatgcgctatccaccacgtagccactttccacatgtggccatcaaccacttaagatggggttagtttaaatcaagatgtgctgttataattggtataagcataaaatcacactagattctggagatttaatatgaataataagaatactatttcagtagttttggtatattgtgtgtcaaaaatgataatattttggatgtattgggtgaaataaaatattaacatta

SEQ ID NO: 81 - DNA, 110281 bp, Homo sapiens
ttcctgtctacgtttcatttcctgggggcttgccaagtgataaacagacccaggcgtgtgtggtagagttcgggttttttagcacgaagtgggtggctggagtttgcttgaaaacatcaattgactttgtgatcattacagaaatgctggtgtaaggtgttcagaagacaatggagaaaaaatggaaatactgtgctgtctattacatcatccagatacattttgtcaagggtaagacttccagttgtcccttcttgtcggatgggccgctttaggggcggatggggcctctgttcatttaaaatgccttgtgactgctgctgaaattgatcaccaaaggacaaatcattactaagggtttcagttatgtatttaagcggcaggtataagagagatgctagaatctagaaatgattactaatgaacactaaaaataagaagggaatgggtcatttgtgccactgctctgaggcattttcacccatttcctttctaacaggatctctggagtaattggcaaattgtgtttcttggaaatgaaatgctctccaaatggtagccaaaacaactgcggaaaaattaaaaattacaaagccatcaacgctcagagatccttgtttaacttttttctctctcaagtactctctttcttttggatataacaagtatttctcatccaaatactaaggtctttgggagttgaaaacacgttgaattttaatgaggcatgtgtaggtatgaacctgggagacaaagtggaatccttatgacagtgggaacgagagcctaatgggcctatttaaaaagagaaggaagcaagattagttctgtattccacagtatgagagtatcatagtaagcctgagtgtcttaagaattaactgtgcttttcagacatagctatgaaaatattaaggagaatttctaaatcaaaagagatttggaatataatgctgtagataggatcagagccatattttcaggcaaaggatagctcacaggaagttacattaaactgtactaacctctgcctaccaaacttttgcatccacagaagtatgataattcccatttgtcaagtacttttacttttaagaggcttgtttcttctcagttgcttgtcatctttttatcttttccttttgtgagcttcagtggtacttgtcacaataatatatatcatttctgtaacaggattccatgttaattctaaaactgaggccaacactattgaaggcatgtcacagtctcaatgcttaacacattttaagtgtcctgtatcactcagtcagactgctgatgggaaagagactctacttatgtctagtatttcagaccatcgattagaggtgatactaagtggaacctctacctaaggttagatgaggtcctttcaatccttgtatattgaaagtgaaatttcttactctaatcaactagactgaatttgggagacagtttggaagttatgtggaaggaaaataaaataaaataagtaataataaagtttaaaataataagcataacataggtaatagttaacattaagtataggttacttagaagttatatgtaggctaagaaatttaagtagcccctcccagcattgctaacaagttgcagctgtgagcttatctcaaccttccaagcttcttgcctgcccccagacccccacatatttctgtaactcctgttttaccttaccccatctctgtctagcttcaagattgactggttaagataactaaattgtaagttttctcagaattgtcacgggttaaataatttactgtctttgcctgaaacctgtatcctgccttgttttcccacctcaaacgacatataagcaagcctgctttctttgtcagagtcagcagccattttgggcatgagtctgctgtgggcctggatgcctgaattaaataaagttctctttggtctctaaaggtctctttgtcttccttggctggagttttactgttatacttatgagggttatagaaagaccacagactctgggcaactgaattcattcttttactggaggtgtgactttttttgttttgtttcgtttttcgtttttttgagatggagtctcactctgttgccaggctggagtgcagtggcatgatttcggctcactgtaatctccgcctcccaggttcaagcgattctcctgcttcagcctcccaagtagctgggactacaggcgtgcaccaccacgcccagctaatttttgtatttttagtagagacggggttttgccgtgttggccaggatggtctggttctcttgacctcatgatctgcccacctcagcctcccaaagtgctgggattacaggcgtgagccactgcgccaggcctggaggtgtgactttgagcatactgtttcatctctctgtggcccagtttcttcctcataaaaaggggttaacaacatcacctatggcgtgtgagggggattaaacaagataagatatgaaaggcccttgtaaacatgtatttttcaaagaaattgctatacacatatcatttatttttgcagtttcagaaagcatcacgtgtgtattatattcagctgtcgttttataacccaaaaagccaattatattaaacgtaagaagaatcgtcatactaagtttgctggtgtgcttcaattttcaaataggcttaattttattcacaggtagtctgaaaccttcaattatattttggtcagaccaacacatagataaatatttagaagtcagtaattacctctagcttctctacgtaaatgcctcctcatttatattgtctcatgcatctctatctgagtgagacacaagctctactctattcctaaagcagccagggagaaatttcctcagttgctcccctcaccttactgaagtgactagggtttttaattaagcgtcattctatgtgaattatttaaactcatggctcatgttctttcttttcaggagtttgggaaaaaacagtcaacacagaagaaaatgtttatgctacacttggctctgatgtcaacctgacctgccaaacacagacagtaggcttcttcgtgcagatgcaatggtccaaggtcaccaataagatagacctgattgctgtctatcatccccaatacggcttctactgtgcctatgggagaccctgtgagtcacttgtgactttcacagaaactcctgagaatgggtcaaaatggactctgcacttaaggaatatgtcttgttcagtcagtggaaggtacgagtgtatgcttgttctgtatccagagggcattcagactaaaatctacaaccttctcattcagacacacggtaagcataactggtagagggatgtgctttcattcagctctctctcattcaacaaatgtacattttaagaaaagcaaggttaggcttggtgctcagcatacaaaggttgagcagaaagagctactgtctgataagagagacaggaagtgaccacagcatttaagtaaataaatgtaaacttgcaacagtgataagtgtcgataataaatactgtaacagtcttgtgaaggagcacatcacagaggccattgaaattgtcctttagaaattaacaccatagcttaagtctaaagaatgagtagacactaccacaatttaggaggtggggctgaggcagagtgggattgtgagtaatcccagagagagaaaagagcttgcatgaagctctttggagtgtttgaagaaatgggaaaatgccagtgggacagcaatacagcaattaaaggataaggcaggtaaggaccagatcatgttggacctggtcagcttcccttttaaaaggtttctattttgatctcagaaccataagaagacatggaagtatttccaacaaaaggatggcatgacatttataggctgactgtatttgtgttgtttaaaaaaaaaaagtcatactgactttcatgtgaaaatgaggtgaagatggacaagaaggagaaggtagagacaactcaggagaccacctcagtagcccagaaaagagagagtggtagttcaggtagatatagaaggaaaatggcaaattttgttcattgggcataaaacagatatgatcatagagagaatataagacaagggcagtatgaaggaaggagagaaagaagttaaaggtgacatctgggtgtctggcatgcacacctgaatggtggtgctattcactgtgatggaaggtaaaggaaggtttgtgggtgaatttatgaaagtgattctgggtatacaatatttagtctagggcaggtaaagggacaaaggaagctgctaactatgaagcattcacaccaaacatactttggaggcctgcatttagaagtgggaatcctagatttaagttctagctcctttctgaatagaaataaaatttgacttggggcctgtggtgtaaattctctgagcccatttggaaaatgattataataatgcctgccctaaattacctggtcctaaagtaaatgattttcatttctgctaatggaaaacaatgaaagtgaaagccaacagatgcaaaatgcactggcagtggactggttctaactcagggcaaagtggcctggtaatataagaaaaaaaaataactcgtgaaggtcatattaaagggggcatagagctgtccagaacaagcaacaggtatggatttatagcctcctctccatgtcttataacttacttgctttaaaaatatgctgttggaacagtccacctataggccaaggtcccatcaactactatcttataatgcccaattcccttgctgttttccaggaggaaaacacaccacacacacacacacacagacacatacacacacacacacacacacacacacacttcagttcaattaaggatggagtggagtgggattgaagtaaagagaaatggaagacctatatagaaaactgtttagctatacatagtttgattcaggtagcctgtatttggatattggctctatcatttaccatacgtttcatcattcccaagttgtttcaagtttcttacataacaaatatggataattatagtgctttctttacaggtatcactagcttggtgattaaatgagataatctgtgtaatgcacttaaacatatagttcctgctaaaggataagagtttggtaaatggtagttttcaattaagaatagtaataattatattgagcaaattctatttctcagttccaattaaatatgagccctgctccttctttttatatattgacctcatttggaacccagtaagacatttgccatgtaatgttagtacaagtacacattgaccttggtttcatacatagttttttttgtacattctgcctgaaccagtaaacaatactattgcctcacggaggactcagtgtttccttcattgagacttggcaacatggactgatgtaccttataggaaatagaataagtgatgccacaaaatgaagacagcaatggagaacagatagtatattatccagaaaggaggatgatgttgcctttaaagaaatgtatttcttaaaataaagagaaccaagggagttaagcttgtagctactaaaaactgcaggtcactggagaggcagaaaccgtatctatactttttgcggttggaaaatttccggtcttctgaatgtaactttgctgctgtcatctggatcagatgaaaagcaatggcctcagtgttagagaaatggttctggtattgtgattttgggtacaaagggagtaaaatagaaaagagcaaaacagaagggggaaacatccttcaccacagagtgaccacaaatgtaagcctggtacggagctacagagtaggcagctgactaaagggaggcagttgccatctgagagctctgtcaagttcacaaccaatagcatattttctttctaccctttactgttttgatcttctcttgcttcttctcctctcacttgtacagttttcttcttatgcccctgtgcaatctttaagtttacaagctagttgggtaagcaaaacacacctgaagtgcaaacacttatatagtacataaacaaatgcaaattgaagtggtgcataagaacctaatttgaaaatgctgagggacttgaagtgtttgagttgatcatctcttcctgtttcttttctgttgctgtttgagtcattctctcttgtctgctcacaacacagtgtgtgtctaaatcctgttcccatgttccccaagggcctagctgtgaaaggattctgttctcttttcacaatattttgtctctgtgtgtgtcttagtgctctgagattgtggacaagagtggaaatataataaacagtgtgaggtttgcctctttttcgctttcacttgacagagtttcctcctaggttaggagattttcagtcactccaagaaatgcagttctctgagttaagccttggattgtcataatctagatttcattcatttgaatgctactggatcccataatgcttcagattgtaagattttggtgcattttaaaatttgtagttattaagatcagttataagagtataacatggctttaatttactagttcacagtaaatgccttggtgggctgttaatgttattggaagcagtagtagcagtgaatgcggttggagaagtcatggtcctggaagtagtagtaatagtagcaataaaattttgatactacaatgttgataagcttggtctaaaacatgttgttatcctgtctagtttgtattgagcctgaatgctggctcttcttaaattcctgtatttagtctttatccaacaagtgtttttgagtgcttacagtgctagacactgggcactaggcacagagtaggcatatatgcatgactgtgtcttcatgaatcacaaagttcaataggaagaagttgacattcatcaaataagcaaacaaatatcaaattgcaacagtgagaagtgcttcagaagtgaggaagtagtgtatgagagggtataataggaaaatcagaaaagactttctttactttgtcctttcctttcccttcccccttattttcatttccctctcttctcccctcccctctcttcccctcccctcccctctcctttcctttcctttggaagcgctgcttcaactggagttaaccaagtgaacacagagctttacaaagaacaggacatgcaaaggttctatgggggaaggaagttataacaactgggtaggcaggggagattttaaaaggtattatggctggagcagagggattacaggtgaggcagttgacgataaggttagaaagattgattagtccatttaaggagttttgtctttatcctaagagctgtgggaactaattaaaaggtggttgttttgtttgattttttttgttttgcatttcaaaaatgcatctttgtggttcaagtgtagagaatgaattggagaaggcagagacgatagtgtggatcagttagaagacaacagcagaaagctacatgagagatgctggtaccattaagtacagtggcaatgaactagaaatagaagaatgtttagattagaaacttgtgtaggagattctccccacaggatcagtggtggattgcctacgtgaaggaaggaataaaaagcagcgtcaaggatgatgctttaatttctaatatgtgacacagaaaaaataggggaacattgtattagggaacactggaagatgatcagatcatacagaaattattttgcatttaatcttatagatgttgagttaggcatgaagttgtgacatacagaagacgttaggtaaactggatatacaatttcagatctaggagagaggtttaagctgaagatacagagtcatctgagtgtgagtgttaactaaaattctgggagtgaaagaaatcctctaggaagagaaaatcaagcaagaaaagccatgtggcacttcagcagagtccatggtgacggatggagaaaggtgagtcttcagaggataatgaagagcaattaaagaggcaaaagtagaatcaggagtgaattgggtcacaaaaacctggaaacatattacataaaaggaatagccatcaattataaagtttctaagaagataaaatagttattcgaatgtattttaaaacatgaagttttttttatcacctaacaggaactgtttgatggcattatggaatggaagtcaggctggagggagaagaggaatgagtgggaggcaaggaaatggggacagcacattgatatgactttcaagaaatctgccagtagtaataggaagagtagatagaggtgttcaaatgcgggattctgttgatactacagtagtgatggtggtggtggtttcaattaataagaaacacttgactgtgcttcaaagttaatgggcaggatctagttgaaaaagggtagttaaatacacagtatggaagataaaataataaaccaaggtttctaagaaaatggggacaatgatactcacaacacaagtaggactaccccgatattgaaaaaaaaagaacagtttttttttattgtaacaggtgggagggaaaataagatgagtgcatatgatgagggaggtgctgtcttctatttctctaaaataggaaacaaaaccatcttcagctagagagaggaaggaagcttcagaaaagaagattgaggaaggtttgaaacagctgctatggatagaagggaaatggattcactaagttaacacatttggatttttggtctgtgttgaacatccatttgggtatggtatgaaatggtagtgaaaacaattcgcacaaggctttctccagcagtgattggctgcttgagtctgggcattaaaaagtacatagtgccacatttggattcctttttagattgttgccaaaaggaaaacaaaaaggcaaaggatttggggtataagcaaaaatattattgacataatgcactatagaactttagcttgataataagagatgcaaagaaaaaataaagctggtgatttggaaaaaagtagagtgattaactcattaaaagaccaatgaggttggagaacagttgaaatgaaactggttgcacaaactggaagaagagatgtttgtaggtctgaatttgtgattttgtagatgagctattttacatgataacaagatccaagatgtgattgtgagagtagatggctaaaatgaagtggagacaattaatgaagatgacagtgggaagaactgagagtccaggtattggagaagtcatctgcatggtcactgaaagcacctaggttatgtcaggtttggggctgcaaaatattgcagtctacataaaaacattttcaaagaaaaacggagtgtgattgggagattacagcagaagttgacaaactttttctctgaagggtcatgctaagctttgaatatttgtccccttcaaaatcattttgaaatttattgtcattgtaacagtattaagacatgggaccttctttttcttcaaattttaagttcaggggtacatgtgcaggatgtgcaggtttgttatataggtaaatgtgtgccatggtagtttgctgcacagatcattccatcacccaggtattaagcccagcatccattagctattcttcctgatgctctccttcaccccaccacaccctccgacaggccccagtgtgtattgttccccctcatgggtcagaatgatttataacagaatgatttatattcctttgagtatataccagtaacgggattgctgggtcaaatggtatttctgcctttaggtctttgacgaatggccacactgtcttccacaatggctgaactaatttacactcccaccaacagtgtaaaagcattcctttttctcagcaacttcaccagcatctgttctttcttgactttttaataatagccattctgagtggtgcaagatgatatctccttgtagttttgatttgcatttctctaattatcagtgatgttgagctttttttcatatttgttggctgcatatatgtcttcttttgagaagtgtctattcatgtcctgtgcccactttttaatgagtttgttttttttcttgtaaatttgtttaagttcctttgtagacactggatattagaccccaggccctttaagaggtgatataagggctccactctcctggaaaagatttgtggcaatataaaaatgtgtgtttgtccccctcttttctctctgtggctcttctgctcttctgccatgtggggagcagcattcctccctccgaggatgcagcattcaaagtgccatcttgaaagaggacaggacactgggctctaaccagacaccaaacctgccgatgttttgatcttggactttccagcctcaagaactgagataaacaaatatgtcttttaataagttacctaatctcagatattcttttgcagcatcacaaaacagactgaaatagtccaaatactaaatattttaggctttgtggtccatgtagtctctgtcacaactactcaactctaccactgttgcataaaaagcatcacagagaatatgtaaatgaatgggcctgactgtgttctaattcaactttatttacaaaaataggcaacaagccagatttggcccacaggccaaggtttatgacctctgagttagaggataatagcagtgaatcaaggaagaaagggattgttttgtttttcttaaaatatgttgctcataactgacaatactggtactggagatggttttaggtgattcatgaaacaactataaaagctttaattgtggaaaactctaaacaatatacaaaaaatacatagaataattatgaaaattatatagaataatttcccacatactgaacatacaacttcaacaattatcaactcataggcaatctcattttatttaaacccttatcaactgctgccttccaagattactttggagaaaatgcaagacttcttgtttattttagtatgaatctttaaaagataaagatgtcattaaaaaaaagccataatctaccaccaaaactaaaaaaaaattagtatttaatattattcaatatcccatcagcctgatgttatattttgtttttttttttaaattaggatgcagataaactagatatattgtgattatttggaaattcccttttaatctgaaagctatattacatttgttatttttcctttgcgatatatttgttgaataaatttgatgatttgtccagcctggattttgctcttatagtcccatagtatctctatgttttcaccttatagttagacttataaactctaagttatcttatattcttgacagagacttgataacatttaggttttcttttttctttttttttttttttggcaagactacgtgatagatgatgcatagttatatgagaggcacataattctggttacatgatattaagagccactggtgagccttgcctacatccattaaatcattatgatttgccgaatagaaatattctatcattccctaatttattagcttaagtatttctataaagagaaacttcctctcatcaacttattatttatttgatgtatagtttgtataagaaaagcagaatagatacttgattctttccctttaatcaccagttttaaaaatgagttggttaactagtatttttagaaagtgacccgtaagtattttatgttaagtatcatgaatttatatgaacttaaacatactgatgaatttcaattcattacggttattatccttattttactgaaaatttcccatatataaaacctattaatcctttgttatataagttgcaaatattttcccagtttgtcatttattcttactttcttatattgtttgcaatgcagcatgtttcttatttttattaaataaaatctattactcttttcccttattggtcctgattttaagttttggtcaagaaaagttttcttcatttccaaattatataagaattcactcataatttctgatacttgcatgctttcttttatgagcatttaaatttgtaacattaggtttctggtgcaaaataaaaacacctaaatttacatttttatatatctctaatgccttcttctatattttctactttttttcccttctgtgattcaattaggtattcacctgtcttccaatcatgaactctatctctatgatgtccaataagtttttaccccatcaaattagttcttaatttctgatattgtatttttaagttatttgatcacatttgatagatttttaatttttgataaatttgtccaccttttgatctacttcctccatttcttctctgttttcttgactatatgaaaaagagttattttaaatctttgttggataactccaaagtcagaagcatttgtttgtctgttcctatgtctatttttctcttattttctttttttgcaacttgctccaccgtatctcctctaaaccactctgtattactaaatatactgcatctatatcaaactataaagtacacgtatataataatatatgtattaaactcaacagttcagtgttaaattaaggatttaaagcagcagtacccaactttttgacactaggtaccggcatggaagacaacttttccatagactgtggtggagggggatggtttggggatgattcaagcctattacatttattgtgcactttatttgtattattattacattgtaatatataatgaaataattatacaactcaccataatgtagaatcagtgggagccctgagcttgtcttcctgcaactagatggtcccatctgggggtgatgggaaacagcaacagatcatcaggcattagattctcataaggagcacacaacctagatccctcaaatgtgtaattcacaatagagttcgcactcctatgaaaatctaatgcagccactgatttggcaggacacagatctcagatggtaatgcaagtgatggggagtagctgtaaatacagatgaagcttttcttactcacacactgctcacctcctgctgtgtggccccattccttaacaggccacggacaagtaccagtccatggtccaggggctaagaacccctgatttaaagaatttcatgttctttaacaaaattaagagaaaagaaaagaaaaataaatgtatgtatagtttttatttactcacatatgaagactacatatataatttttcatatttactcacgtatttaccattttttgtgctctttattttatcccatgaattggagttactgtttgttgtcatttcttttcagcctgaaggactttagtatttcgtgtaagacaaatctacttgcaatgaattctttcagattttttcatttttaattttaaaggataatttcaatggatatagaattcagagtggattgtttctctttcttttagcattttgaatatatctttcgatcgccattatttctgattaaaatgagccactagttatattattagtctgctgaatgggatgagcttttgtttttgtttgtttggttggttggtttttgctcctttcaattgctacttttataatttagtctttctttttggcttccagaagtttgattatgatgtgtcttttggctttcagaagtttgattatgggtgtctctttgtgtttgtcctattcaggttttgttaaagttcttggatgtgtagattaattttaagaaagtttttaaataatcaaatatgtgaagtttttggccattttttcttcaaatatttgatccatccccttactctttcacttctttttctactactcctgtttcatgtatgttaccatacttgatactgtcctatatggctctgaagctgttttcatttctttcaatcctttttctcccttgagattagataatttatattgaacaatgttcaaatacactgattctttcttcagccatctcaaatttgctattgagaacatctagtaaatttcttatttttgctactgacatttcaactctaaaatatacatttgcttcattttatagctttctatttctctactaacatttcctatttattgagtcattgtcatattttgctttaatactttgaatagactaataacaacttcttttttttttattatactttaagttttagggtacatgtgcacattgtgcaggttagttacatatgtatacatgtgccgtgctggtgcgccgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaaagatgatttccaatttcatccatgtccctacaaaggacgtgaactcatcattttttatggctgcatagtattccacggtgtatatgttccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctggctcaaatggtatttctagttctagatccctgaggaatcaccacactgacttccataatggtggaactagtttacagtcccaccaacagtgtaaaagtgttcctgtttctccacatcctctccagcacctgttgtttcctgactttgtaatgattgtcattctaactggtgtgagatggtatctcatagtggttttgatttgcatttctctgatggccagtgatgatgagcattttttcatgtgttttttggcagcataaatgtcttcttttgagaagtgtctgttcatgtccttcgcacactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccattcgtcaattttggcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttaattctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctctattttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtgtgttgttggtgtataagaatgcttgtgatttttgtacattgattctgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttatcattttgaaatacgtcccatcaataccgaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattggggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgactattgccacaatttcagctcctgttattggtctattcagagatgcaacttcttcctggtttagtcttgggagagtgtatgtgtcaaggaatttatccatttcttctagattttccagtttatttgcatagaggtgtttgtagtattctctgatggtagtttgtatttctgtgggaaaggtggtgatatcccctttatcattttttattgtgtctatttgattcttctctctttttttctttattagtcttgctagcggtctatcaattttgttgatcctttcaaaaaaccagctcctggattcattgattttttgaatggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgtcgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcgtggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatatgtgtctctgcacgtgagatgggtttcctgaatacaacacactgatgggtcttgactctttatccaatttgccagtctgtgtcttttaattggagaatttagtccatttacatttaaagttaatagtgttatgtgtgaatttgatcctgtcattatgatgttagctggtgattttgctcgttagttgacacagtttcttcctagtctcgatggtctttacattttggcatgattttgcagcagctggtaccagttgttcctttccatgtttagcgcttccttcaggagctcttttagggcaggcctggtggtgacaaaatctctcagcatttgcttgtctgtaaagtatttaatttctccttcacttatgaagcttagtttggctggatatgaaattctgggttgaaaattcttttctttaagaatgttgaatattggcccccactctcttctggcttgtagggtttctgccgagagatccactgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcacattggctcctgaggcttctgcattcttcacatagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgtgttcctttggaggaggagaggcgctctgcgttttagagtttccagtttttctgttctgttttttccccatctttgtggttttatctactttcggtctttgatgatggtgatgtacagatgggttttcggtgtggatgtcctttctgtttgttagttttccttctaacagacaggaccctcagctgcaggtctgttggaataccctgccttgtgaggtgtcagtgtgcccctgctgcggggtgcctcccagttaggctgctcgggggtcaggggtcagggacccacttgaggaggcagtctgccggttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgacttgcagtttgatctcagactgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcacttcccaggtgaggcaatgcctcgccctgcttcggctcccgcacggtgcgcgcacccactggcctgcgcccactgtctggcgctccctagtgagatgaacccagtacctcagatggaaatgcagaaatcaccggtcttctgcgtcgctcacgttgggagctgtagaccggagctgttcctattcggccatcttggctcctccccgaataacaacttctttgaagtctcttaaattcaacacctgggtccacccagattcagctgcaattaccttttttccttattatgggtcacacatccctgattcctccatgtctcataattttgtgttgaaaactggacattaaaaaatatatatatatttatagacagactatagaatatatatatatgttgcaactctatattatgtcttatttaggttcattttgtttcattttagtaacttatctgtgcttaaattgaatgtctcctttgcaatgcaaggccattgatctctcttctcgatttttatactaatagttattttttaatttggcttgcaagaagttgcccctgcattggcaaagccactttattggtccagccatgattttggcaaaagttatgctcaaatacttaaatccattaggcttcctctctttatgcatagatttgtgtgtcaatcagggagtgcattcaaagttgcagccagttgtccagacttcctgggcttttacattttgctacgctcttttgggtctccctgactcagtgtgtagtttcctagtcagggtataatctgtgaagtctttatcttagccattccatgactctagtttccaggatctccatgttaaaggtctttctggtctagcactgtctttgttttgtgctgctctaacagaataccacagactgatacattagaaaggatagacatttatcttctcacagttctggaggttgaaaatgtccaagatcaagccattgacatctggtgagggcctgcttgctaaatcctctggaggggagaaatgccatgtcctcacatggtggaaggcagaagggcaagagacaaaaggggaattaactcgcccttttataatggcattaatgccactcatgaaagctctgtcctatcacctcccaaaggttccaccttctaatactgacacaatggcaaccaaatttcaacatgcatttcagaggggagaagcattcaaatcatagcagccactcactccagatgggaatacaaacccaaactaaccaagcttcaggttttaggcacctacgaagtttgcttctgttatgggaaaaggtgaaaggtttctatccctagacctaatttaagtctgcccattgtggaaaaaaagctgctggtttttgcaaccagctccatgtggctaaaactacatttcttaatgaccaggttggagaagggaatggatggagctgaggcaaaaagattgaagtctcctgctgtttttactaaagctctagtgatttttcaataagaaatgctttgcaatttaatgactacctttagtcaatttccacggccctaaaattgttgttgtttttttaaacacatttccccagttttgtacttgtctgtttttactgacctcctcatgtccccataaccagaagtctctcattcctacaccccatattttgatatttatattgtatctttatttaaaaacatatattcatcactattccctttgttgtaacaattatatattcttagtgctaaaggtaaatagataatcaacatttaccactaacctttatgtaaatgcatctccagtttgaaatgtattctattggagaatcctcaggaaaggctcatagcagcaatattctctgagttcttgtgtaactctaacatctttctgtagtctttattaaaaaagactttattaaaaaagaatataaaatctttggctcacattttctttccctgagtatattaactatgttactctattgttttctggcagaggactgctatcaaaaagctaataacaatcagattttctttccccatgtttgactttgctcgatacttttatatgaacatgcttaaagttgtccattctgggtctattttcctattttgcagtataatcgtttaatgtgcagtttctagtcattttaaattttattatatttttcttgaattatagtttttaatatttgttctgttccattgctttcatcttttttctttaatgtcttttattgtacatatatttttatcttctttgcatatcatttcctttgaatctcttttatcaacttttttctttttttataattacatattgctttatttatttcaaaatttccctcattctattttgaaaatgaacttcaatgaattaacttttgtgtttctgtgtttctggtttcattctaattttgtcttagtttctggagtgatttttaaaaatttattatttctaaccctttctcgaatttcgttacctatgttttgtaagcttttttcttccactggactcattgggaactttccaaaattgtgcacaatttcatcattttatttcttttagctcattttgaataatttggctatagtttttatttactttgttgtcgtgtcttgataatatgctctcattgttgtaggaatgttattttgttctctattctttttttgcttctggtatctttataggttattctatctcattccctttctatcactcatgcttaagttaaatgcattcttatcacagaggagtgggccagcctagcttttctagagtgttcagtatccctaaagccgcctcttctgttattttcaaggtaagtaatttaccattgtactttctgagtgtatttcctttgcttctatccctcacttttacctaaattgcctatttgatttctcttagtggacctgtcctgtcttattggattctatgtccagcagttttttctccccatggcatgtgtcctgagaagtcctttctgctccagcactgacaacctttttcttatttttcttgaagacactggtgatttggtgcccgcaaactctcttctccatttgagctactattcttggattaatctacctgtctttccagtgattacctgttactaggcagagggaggtggtatgggttctctagttctaagatccatcagaagcccagttgatcttcctctgtttctgcacagttactgatagcacagtggtttagtggatttttccccaccaattaagagggatgtgttgttatttagtgttcgtgtagatatgatctatgtatttttagttttgttaccctatttatcttctttgtttttatagagggtttcaggtatattcaaaaagtaatgccacttatactgccagcttcccagattctggacaaaatttacaaaaatgtaatacttatgtatttgactgatgttcattaaaatataactaacatatttggattgcatggacttcagagatattcagtatattttaaataaatatatataagtaaaacaattacaataatttaagaataaaattagatagtagtaatggtcttatgcaaatatggcaaaaaatgatgatagtagagatggtatagaaacaactccatttggaagtgctgtgatagctaagtgattttttttctccttaagggacaggggtcttttttttcaattatgggcttggagtactatttggaaacagcagtggagagcaaggaaagcactgatcccacctccagaacttgaggaattagagtgcaagaaaatatataaccactatttggaaatgctgtggggaagatgtaccctaatgggaagatctggttttaattaggaaaaggaggaggaaagagttattggtaaagaagatagatgatattgataagagattaaaatataacaaagatctaaaggctagatataaaatttataaacagaaatatgccattaaaatgtatactgttatatagcatatatttatatatatatttatatatataatttttagccctaaattggtgctttaatcttcagtttccttttccttgatcagaaagactataaaacttcataacctagcctttgcctttttattttgatggactaatactgtataaaagttataccgttttataacatatatatatatattcacaatgttagtagcaataagaatgttcatactcaatgatccattaattatacctcagagaatttatcttaagtagctgaatggtcagaagaaagctattagcatgaggatgatccttgctatatagcatgtaatggtttaaaataaagtaaaaagtccaaactgaaagagcataatgattcaataattggaaatgactaaatgaatgatgattagtatatatgataaaatgacatgaagcccccataaatttaaatcacctgtagttcaagaatcacacaaaacattctaaagtaacaacatatataacattcattggtaaacaggattgcagactatgagaatacatgcatgtatgcaaacaagatttgaatatagaaaaaagaatataagatttttaggatatttagatggtagagttgcctttatttgtaaacttcttttgatgctatagtttagtcacaaatttatatgtatgtatataaaactttcccaataggagagactacaaaatggatatttatcttctattaccttaaaaatgaaaataattaacactgcttcctcaaagtttccttatatatgtttgtgtcattcctttgtgggaggaatgtttataaactctgggaagactgttagatatgaagactgtaaaaagaacagaattttagggcaggaaaactattatgtatgatactataactgtggacacatgtcattatacatttgtccaaacccatagaatgtgcaaaattaagagtaaaccctaatgtaaactatgaactttgggtgataatgaagtgccagtgtgggttcgttaattgtaacaaatgtaccgctgtggaacaggatgtccacagtgggggaggctgtgggtgggtagaggtagtagatatactgggaactttgtactttctgctcaattttgctgtgaacctaaaactactccaaaaaataaagtccaacaaaataaaaagacagttaaggctaggttatgaagttttgtattctatctgatcaaggaaatggaacctgaagattaaagcaccaatttggggccaaagcagaacatgccaaatcatgagtttgattctgttggggtcatttccttgtaatttttcagtgtttagcaacaattctgtgctcctcagtgactctgtttagccacttatacaatgagggctatcgtgggagtttgcctctctttttcataggtgtaccctgaggacagatgaatccctatactaaaactgtttttgtctctttgataaaaagcactttacaaaccaatcagagattcacatattttctaccttatgttttgttacagttacagcagatgaatggaacagcaaccatacgatagaaatagagataaatcagactctggaaataccatgctttcaaaatagctcctcaaaaatttcatctgagttcacctatgcatggtcggtggtaagtgttgcccttttcagtgaataacctcaatggtctttaaacattaacgaagtaaaatgaataagcagtaataatagggaaggaagcatacaaataacaggcaggcattatgccagtggtgggaagaggggtagggaaggaaggagaggtcactcagattccttctcacaggcaagcctctgagtctatgaatgcagtgaattaatttataaatttgcttctaaagattgatttttacttctatctatataccaaaccatggttacagaaagaacaaagtgtgatagtgccctagaaaggagccatattcagcagaagcccctactcacagatacttgtttcacaaacaacatatgcagagctacagactcctttctccaaaaacacttattactacatcctgggaaatatccaacattgggttagatagggaagcacagactctaatgcttgtgaaatataagcagcaaatgtatatgagacgagcaggccttgtataagaaacagtcactgcccagctcttgtaatgccacagggggctgcaggcctatagttgcatgccttctcattaaaaaacaaaaaacagacaaacaaacaaaagccagaaatctggatttttatgaaaaattttccaattttaaaaatgatgtgtagagcaaaaatgaatagtggtctattattttgatgttagagcaaaaataagtactggtctattattttgctaagacactgtaaaatataactctaattataaatttaaaaaatttcactgaggattcactttggcagttatggtgggccaactattaagttgcttaacatgcttaacatgtcctgtgatgactaaattctcccactacttttctctccttgaaatactgcagagttcatctatacagatctttatctaatcggatttatgatttaatttggcctgtcccttaacaaaactgcatcagttatctactttgtctgcctttgttattttatccttagtctacattgttctgcctaatgcatcagtttatttttaaaatctaaatttaatcttaaaaactaaaattgagctttttctcataacacgtaaacaaaatcaacatgaggataataataaatatgaaagaattgtgtcattataactttaatgttagtcaaccaaatggcagccagctactaaccagtgtatacagtaaacccctaaaactgttaaaaacaaatgacaacaaagagacaaacacaattatagaggtgatcataaacatgatttcaagaatcacataatagggcattcatttagatgatacagaatatgattactgtatgttaatttttatatttttgtcaaaatgaaaacaaaggatttaaaaattcttatgaaactcacagattctcatgaatgtaacagctggcacaatttggaaaatactgtgattcagatggctgattattcatattacaagctacctagatttttgtggacagtcttggaaactagaccctatatataaaaacatttccttgggtttgtgccaaacccaaaataattgacttgtactaaaaactttaaatacaacctactgataatttttcactgtctaggtatttttcagatagtaaataataaaaagaattatattttaaaataactttcccaaatggttgtaaaacctacagtatctctttgtcatctgtcacaaaactcgtctgcccttttataggatttgctttccaaaaagtaagtcttcctggacagtaggcctatcattaggatgagtataagtccattgttcttaataaacatgatgcaacatagttctgagaaaaaggttaattaagtgagataatttcaggaggacagaaatgtactatactaaaccttttagtaatgaaatgcatagcttgcttaatattttccaccaacagagcagaaagttcctatcccagttatctcaaattcattaacaatggcaactggtttaataaagccttactgtagatatttttactgtagtgttcttatcttgtctcatgggtatgtaatctgtttttctaagcaaatgtaaagccttcagtatgtgtcttttatgtgagtctgagcttctcctggacaaaaagttgtatctctcatttctttttttttccaaagtataaattcatattttgtaggaaatgtagtttacaaaacagtatcaatcgctacccccaatccagatgacccactttcctccgaagggggacgtttaggtcctattccactgggcaagggtaaaatgattcagtagtcttccaggttaacagtaaattcttctcccaaggctggggccgtcaaggcacagtctgtatgaggctcaccctgtctgaccctaggctggggctgcttgctcggtaggcaggaattggggtgggggtgggggctcagggaagggtctgcaccctgagacttctgcttacaggagggtgctgggaaaaccctgccttgggttggggaatcccctctctcccacctttggggaatagggtggggagggggtaagtgggaccctgctgcctggagggctcaggtctgagcagcagggagcccttagtgcccactccagcagacctattgggaatttactacctgaagacaaattataggtctagggtcttctttgtgattttgggggagtcgaggcattggggggtgagaggtatggtctaaggtcacagtctgggagaggagtccttgggatcaaaggttgtgcagaagcaccttccccacctcctgcctcatgagataaggttgccaggattccattatcatggtgaatttctctgggctcgtgggttaggggtcacagtggagccaccaaggtagaaatcacaaatgggacgcatgtgtgttaactgacagtggcctggccagacatcagggggcactagatccttggcaagaaagctaagggatcaacaggtgagatgtgagacaccaggcgcatggcagctcacacgtacatggcccgggacatgacaaagcatttgccctggtaggaatcagaggggctgctgtaggacagagcatcatagatggggttgatcttgtccagatactcttcctcctcctccccctcctcatcctctagatccagggaaacgtcttccaaagcaggtggccctggaggcaccgggatgggggaccccaggcttgtggctccagggtgcaagggtcctgaccgctcttccaaggtgggcagctcatggtatcgaggcatttcctgctcagtgcatgaggcgccagcgtcaaagtagggggtcttgagtgggctgtgctctgaggccaccagagtgaaaagctgggagggcatctcctgctcctccagcttctcttttggggtcagcggcttgtaggagggaggtccctccaggctgtggggtaggaggtaggtcaagtggagactaagacccgggcatccctctgaatccagggttacagcacatgctgttccctctacctgggtcccccttttccctgcccccttttcttgcctggagtaagagtttttttgttttgttttggtttttggtttttggttttttttttttattgctcatttcaaaaatctccagcatctagtatagagtctagagcataggtactcataaatacttaataaatacttgaattaatttatttctatttgtcccctttccccacagtcttattcattgttctcatattaaattaatgatcactaaattcatgctgtttgattgtttaatgagtggcagctcattaagtatcaaagacttgacaactgatgagtcaccgtttatcaagtagcttcctttaaagaaactaagaaggccatgtagacattacctttggattctgccaggacatttagagtaaatgaatgccagagagtgcatctaaggtcacacagtgagagggtgaatcttaaacatccactagaacctcaagccatgctgccactttaaagaatgcaccatgataccaacaacttgaagaatctttctaaagaaacctttcttcaaagggaacatggtgttggcaaatgtgctgattaaaatcctatggtacatttcctttcaaaatgtcaaaatctatttgctcctctcatttacatctatgccccacaatattgatggctgtaggattcagccagtctattaaaccatctaatgtccttataaagtagattacatagggtggttatagtctcccttaaatgagaacaaacttcctaaataagtggagggaacaaactgcctgacagttcataaaccacaccctgggctcatggttagaacatcccacagcaaggaagtaaaggaacagaatggaaaaatccccacattcatgcaagtgcagaaacccatgattagtgtctttgggctgacctatgctcatcataatggtaaaaaacacacccatgagtagagatttaagatgttaatgagacatgccatgtatctacccgcacgtacaacaatagcacatgcacatcgggaggaccaccccgaacatgcttaatagcaacacaccttcccaacccttcatgaataatcatatgagactctcataaagggagtttccctagtgtcagtcagcatcatctcacctttgagtagcccgctgtgatcagcggtgagtgtacttttgctttgcagtaagctctcttacctcttttcattttgaacttgctctcaaattcttttgtgtggtaaagtcaaaaacaaactggtgccactggcaacacttatattagggaataaactacaactcttagtatcataattgttacatgtctgcaaaggacacaaatattccagccaatccatatttttggtctttaatctcttcttaaactaagaataagaatcataagataagcctattgttcttacaaacatatataatctctttagaaagagattacaacatagaaatgatgaaggtgagctcaggagagcagaaacttcctatactgaactctgggaagtttcaaaggccttctgccccaagtgactcatgaaaccctggaaacaatttacaaactaaaattatctaagtcactgaaaaacaaaagtgatgtcttcctgtttgtggaattttataaaagctaattaattcaattatgaccctcataggaaaggttataattgggattctgtctcataaaataaactcttatgccacatctgcctgatctcatgccaaggctgtgttaagtgtgttaatgggacagactctgcattttgggaagttacatcgcaggactgggaatacactgaggtagacgggcatcaggtgcaaatggacagtgtatctaacattcatccagcatgaggggtaactaagtaaacacaaagggttaactctctaatggaaactaataatctacgtgaatggaggagtaatatataagaaatcctagaatatgtgtacttagatgggatgcagttggaagctgaaagataagtggtattttttcccatcttatgcattgggacataagcatatagtcatgagggaagttctgcaggcttattctggaagcttctaaatatactctaatattctgttttcatagcaaactatcatccttgtttcccacagcatgaatttcagttcagtccaataaacatatatgaatctgttttgagcactaagtcctgcagggatacaaaactatattggacatatttcctaccatgacatacacctttaataaaaatgttaaaaacggcagcatggggaaaatagttcaattccgactagatgaacctgggaaagcttcttagaaaaggttatatctgagctggataattaaatagttggctagcaaaagacagacatatactacaccaagaccctgggacctttaagtacaaattggtagtgcagacgggaaaatgcataagagggaatatttgttcccaaagtcagtgaaaataaagaaattcacgatttttctctttaaaatcatgaagagaaggacaagaatatttccaattcaaacaattcaatattagtgacaaaagcacataactatagattctcatctatcttaaaatttttatctataaatatatcttcaacatgctcttatttaatatttgtgctatttatgttaaaaggtaagtggtactatagacaatgtttgttatgcttatggatgcctcactattcagaaaacaaaactgtaacctcttacctgatggcagctgattctaattgtctttaataaaaaaatgaagtgccaaccaaactacaaagtgttgataaccaacagcaatggttagaaatatattgttctggtgctctagaaaatggatgtggggagctttgcaagcagcttgctttgacagcactgactggatggagaataaatggaggaaatgtgaagataagaaacagtttggagaaaaaaggagtagcaatcaatacagttaacagcagttattgaatgagctctgtacactcagcacctgccatgtgctgtggtcagtgcagccagctctgacatggagctggtttcaaggagctcaggatagctcagagatgaaatatcatcactaaatcaaggaggttgaacatcccaagtctgaaaacctgaaattcaaaatgctccaaaatctgaaacttttttagcgcacacatgatgctcaaaagaaatgttcaatggatcatttcagatttcagattttcagatttaagatgttcaactggcataatgtaaatagtccaaaatccaaaacatctgagcctgaaacatttctgataccaagcatttcagataagggttactcaacctgtagtacaaagattcctgttctaaattgaaaattttgattctagttcaaaaacaaagcctaaatgacttattttaggatttgtcaagtatttaagggacatataacagcagtttcatgattcaataagatccctttcagcagttatcatgctaattattttatcaagctcctatacataatttaattatgcatttgtttcttttctgtggctcctgattttcatatttgtttgtgtgtacatgtttgttcttctccttaagtatatttttagtgcaaaaaatctatttaaaaattatatttaaaaatatgaatttttagattttttttttttgaggcagtgtctcactttgctgcccaggccggagtgcagtgacataatcttggctcactgcagccttgacctccccaggctcaggtgatcctcccacctcagcctcccaaggaactgggaccacaggcatgtgccaccatacccagctaacttttttttttttttgtatttttagtaaagacagggtttcaccatgtttcccaggctggtcttgaactcctgggctcaagaaatccaccagccttggcctcccaaagtgctggaattacaggcatgagccaccaaatccagcccttaagtagattataagtaggaaaggctaagactgtttcttttactacttttgtgagactgtatatagcaaagtcattaacagtgtgatatttggagggaaattgctgttttcaagacctggatctccactacttactggctatgagacctaagggctgggattagagtgaagcaaggaaggccattaaccttggaagcaaaatttaaaggagcacaaaaagttagtgatcaagataaatattttaatacaacatttttaaaaatcagaagttagggaaaatccatggtgaacaaaacatcaaatttgtaaataaaggcagactgttgcttgtgtgtttttcagaccttgctacatttatattgtttaaggaacagtattttccaatcaacttgttgttcatggccattgtgtcccccaagggccaacccttacgggttgacattggcaagagagcagattgagctattcatggctttataactgtcttaatctattttgtgctgctacatgtaacagaatatctgaaactaagaaatttataaacagaacatttattctctcaagttctggaggctgggaagtccaaaatcaaggtgccagcaagttagagcctggtctctgtgcttccaagatggcaccttgaatgctatgttctccagagaggacaaaaatctttgtcctcacatggcagaagagcagaagagagagaactcactactacaagcactttgtagagtggcattaatctatttatgagggcagagccctttggatctcccattaggcttcacctcccaacactatgccattggggattaagtttcaatatgagttttggaagggacaaaaacattcaaaccatagcaatgaatctccataattcctcagtttagccaggcacatagtgaatactcatgagatagcaggttgatcataggctggactagataataataagcttgtattattgaacatctattaagtgtcaggactagagtaagtatatcatatatgttacctcattaaatctatatttcccattaaaatgtgggagtctaccaaggtgtgaatccataaagttttagaaatacttattaatattttttaaagtggacaatttttttctttgaagaacaggaaaagaaaaaactggtagaaataaggctgtcacatacaggttcttgcctctatctgtctgtttcctgaagactaggttagctaagagcattattatcaagtaggagttgaggtgtgctctaaacacctatcatcaaaagtgggccaatatgtcatacaaaggcccctttcaatcaacaaattgccctcacccctgtaatctacaactcacatgaaaggttctagctttctaaaatttctattaaatttctcactgtagatacttcagaaaggttttttatttattattattttatagtttggttcttattagtacaaattgtatctgagacttatttgtccccggttctgggcctccttgctttttgatgctgtgacttaaataactcttactttgtgtgatctttgatcaaatttttaacctcaatttattctacatagttgtaagaagtaaataagacttgaaaggactttgcagaattcttagaatatagtaggtgctaaataaatttaaactatgactaataagattatgaaagtttaataatggtcataacataatactagtattatttctccctctcccagtcctaggcatttcgttgtttgcctgtgctaattttttcacctctcctcccatttgctctgtgaaggcagccactcatatgtaagttcttgctactgccccctttataactgaagactctagaatgtcttaggatctccttatattgtaggttacggggcattctttgcaactgaatcccatctttcctaatgaaggaacaaacccttctttctgcaaaagtcaactgcccaggggaaaaaagcaacctttggataagttggaaggttttgtattttttctctatcaactaaaccacctagtcacaatctgctatataataaagaaaaaagcagtttttctcaccagtctccaacttcagcatgtaactgctctttttcccacaacaaagtgacagttgatggaactgttccaaatggcattcatatactaaatgaccaaggagcattttcaactctaaaatcctgacacacaaaaaagcaagaggctgccaaacgtacctgtgccaaaagatctgcagggggtacctgccttcttaattattgacctccagacttgccagtgctgagtgacatgctctccactttcttctcctgtccccacccaatacttagagctcctctgggggatcctatctctgtaatacagtctttctcccttcttcttttgctcttcttccttaggaaaacagcagcacggattcttgggtccttctttctaagggtataaaggtatgtaaattgctgcaggaaaaagaattcagcagagtatgattatttgcaggcaataacacaatactatctgtatgtaagactgacacaaatcctagccagattcagctaaagaacggtgtcttacataagagtttctactaagtatattctggaattttctatttaaactatttaagaagtctaccttagtccatcctctgtttctgcccatacttgaatgtggtttccatttcttgtagcctgatctgtctcatttttaaaactagagattccaattcatagatcttatcattattttgtaacatttcccccattgaatgcactcctgtttacccttctccattttacttccctccatttcccctgatgactgtacacaaggattcatctgttgtttagagttaggccagtagatgtcagccctggatctcctgagtaccttaaaagcaattgtcctagctatggccttatcccagacagactgaattagaatctctagaagacaagcttgtgcatcagagtgttttaaaagcagctcaactgagaatgttgagtcatactaacaggatatgaagacctaacccatcctctacccttgtgcccgtcaagaatcccctccttactgggcccctagtgagcacttttattgacatcaaccaacactgtgacaccccagggagtttgtccaaaaaaattccaggcacagagagaataatagggcttttcatcacagaccgaagaaaggatacgggatagaagaaccaagtacctcaaatatactctgatctccaaaattcagattaacattttcaggctactcttcatgcatcctctttgaagctaacacaaacacagaagaaagggaataaggttaggaccagaacaaggctgtgaaatgaggcaaggagctgccccagggcacaaaatttaaggaggtactcactgttgggtgtcaacatttcacttgcaagactttgagaatgccactttacctgatcctagtccaggctcggggaggagctgacaaagagtcattttctaaaggaatttagggatagctgtaatcatccagtttaaatgaagattttatgaaatcttcacactgatacagtcttctcatcttagcagtaagatgtcagaacttcttaaataaaaattaaaatctgccattagtcctgcccattccaaaccccaaatcctgctccagatatacagttcatagaagattatgaaggagaagctctagtcagaagaacagaatgcttccatttgttaggagagggtaacaatagtttttaactgaaagtcaagtgtatcatactttctctagtaatatactaaatgtcttctaatttcaatccttcattcttcctctctactttacaaaaagtaaatgaatcagtgcttgtcgaatgcctagttcagagctggcacagttgaggactcaataactggtaacaatttttctcaccaggaggataatggaactcaggaaacacttatctcccaaaatcacctcatcagcaattccacattacttaaagatagagtcaagcttggtacagactacagactccacctctctccagtccaaatcttcgatgatgggcggaagttctcttgccacattagagtcggtcctaacaaaatcttgaggagctccaccacagtcaaggtttttggtaagggcttttgttctacagactcactggcatcctcctgtctcctgccctgctcttccttgaagaggaagcaccctattatgctgcagagcagccacatgtgggtaacagtgctggagtctgtttccctggatacttgtcattcttgttgggcagggggatgagggtaggatgctaaagaatgatgattctgttaacagaataaaatcatacagaagccaataattttctgtattggtcagttttctgttgcttacaatgaaatacctgaaactgagtaatttgtaaagaaaaggaatttattacttacagttatggaggctaagtccaaggtcgaggggacgcatctggtaagagccttcttgcggatggggactctctgaagaatcccaaggtggcacacggtatcacatggcgaggggacagagtttgctaatgtgctaactcaggtctctcttcctcttcttataaggccaccagtttccctcccattataactcatgactccagtaacccattaatccatgaatggattaatcttattcataagggcagagacctcatgattcaatcacctctgaaaggccccagctctcaatactgccacactggagattaagtttcaatatgaattttggagtggacattcaaaccataacagacagaacaatttcctggtgaccactatcttatttacaatgttaatatttctcagaatactggaaatctctttaattgtaactgccaaaatctaattgtttagttgtctaattgtcttagttgcttgcttgagcaaggtggagtaaagtcagtgagaaaaggaaggtgataaatatagccccagagaaactgcagaagttcctcctcccctgctatcctgccaaggcccagctggggtgagaccatccaggtccagcccttccagcaaaggagcctttaggaaaggccctctgaacctgcactctcaggagtgtggagctgagctgtgaaatccactgtggcctcactcaaaatgcagactatctgcagcgtgccaatttaaggaggaaaggttaaaattctattttccccagtggtacaaggaagtaccactaattaataaacaccattaatgaagggaagcctctgcctttggatgtttttttcattttttgtgacaaagatctgtgttttttagaaagtcaattttaaagaaggcaaagagaaaagcagtgaggtggatagacaattaattatttttgaaaatgagataaacaaagagaaaataacttcacaaacctatggacacaggctgctagattgttcctcaattctctaaagggcagagcaagcaaaaaaaaattatttggaattgtattgccctattattggcagtcatacaatttagtattttgaagaaaacacaaaattgcctcccccttccctcctctgtcctccccttccctctgcatcctcccccttctctttctcttcatctctcctcagggatggactaggcaataatcatccctgatgatcaggttccttacggagcctaaacagtgtcctgtgaagagttggaaacaagctgttcatctcttttgctatcaccatttgtttatttaccaggctgtgactgtcttagtgcaaacatgaaactgcttcatctggtctattgtcaaaccaatgaaggcagccatcctcaatgtagaaagaaatatcaattttaatctaggcaagctgtgtcccctattgatcaagactttttgcatcataacttgatctaattgccttgtcaacatttatgctgtgtcctgtatctctttgctgcattaaaacacctctatcttgatcttaaatgtttttcagccttctatatctcatttttatcaccctattggattctacagctctttgtctctacatttctcttgtttcttctttgaagtcctttcggtggatgcttaaaaatatgaaaccctgcctgcttgttcagaaaattagatttttcgtgcttcctggtttttgcatttagtaaattggctgggcgggttgtgtttgggtggagtctcatccagtccttaacctattttgaggtgttacccaagtatatattgtggccctgaccacatatcttataagaacctactttacatcccttggtgattcctcatatagaataagtctccccaaaacacccatgaaaaccttgaaatcaatacccaaatatatatcagatctattccacatgccctaaacccagcatatttcttcttcccaaacaatgtccattgctcaactcttcattgtctaacagaccagggacaagaggggctactccagcaattttgccacttcctgcatctccttcactggtctcctttggttttcctttccttggcagggagtcacctgcccatcacagggttctgttccactcctaaattccaaatctgattgtcctcaacctcaaagaaaatctgtctcaccctgtcacctctgcaatttttagtagttgttctttctttcagggcttttattctgctggtatttgttaacaggaggtaagagatacctctccatccattagtgtttcaggttgtatcttggttttgggttcccctgaaataaaacatcgagataaggattgcggttaatttatttgaaaggccatcctgggaaacatcagaaaaggagtgagaaagtgagtcagggaagggaaggaagataagaaaatgtacaagattatatcagttagcaccataggtttagagctcatcttactgggagacagcatagaacacacatcagagttatcccacatgaagggcaagaaagctggggtattcatctaccatctctccatctgtatcactattaactctctgggactcccagtttttactacttgtggactaagtatactcccataatctcaataaatcattatgcaaagagtcatctagtcatcaaagagttatcccagtaagagatcttcagtatgccaaggtaaatggctagtggctgtagcaggcactgacagcatctgtgactggaggtttagcattctttccactgagtcatagaaggctgtgtttgctatgctcaagaatttacttgaagccacttctgttcaacacgatgtacttaatgtctagtttgtgctgggcagttaagtgctagagatgaagaaattgataaaatactggctcagaggcacttaaaatctagtaaaacaacaaaatcactgaaatattccctgatatttcctagtgccaagcaaccaaacaagaatcaaatgtttctctgctccacttcagggacctttataatgagactttatttctaagctgcattagttcattttcatgctgctgataaagacatacccaaaactgggaagaaaaagagatttagttggacttaaagttccacatggctggggaggcctcagaatcatggcaggaggtgaaaggcacttcttacatggcagcagcaacagaaaaatgaggaaaatcaaaagcataaatgcctgataaacccattagatctcatgagacttattcactatagcatggtaaagaccagccctcatgattcaattgcctcccaccaggtcccttctgggagacacaattcaagttgagatttgggtggggacacagccaaaccatataatttcacccatggcctgtcccaaatctcatgtcctcacatttcaaaatcaatcatgccttcccaacagtcccccatattctcaacccatttcagcattaacccaaaagtccaagtccaaagtcccatctgagacaaggcaagtcccttctgcctatgagcctgtaaaatcaaacgcaagttagttactttctagatataatgggggtataagcattcagtaaatacaaccattctaaatgggagaaattggccaaaacaaaggggctgcaggccccatgcaagtccaaaatccaaaagggcagtcaaatcttaaagttccaaaatgatctcctttgactctatgtcttgcatctgggtcacacagatgcaagaggtaggttcccatgttcttaggcagttctgtccctgtggctttacagggtacagcctccctcctggctgctttcacaggctagtgttgagtgtctgcagctttttcaggagcacagtgcaatctgttggtggatctaccattctggggtctggaggatggtggccctcttctcacagctccactagtcagtgccccattagggactctgtgtgggggctccaaccccacatttcccttctgcactgcccaagcagaggttcttcatgagggccccgcccttgcagcaaacttttgctgggtattcagacatttccataaatcttctgaaatctaggtagatgttcccaaacctcagttcttgacttctctgcacgcacaggctcaacaccatgtggaagctgccaaggcttggggattccacacttttagaagcaatggcccaagctgcacgttggcccctttcagccatagctggaatggctgggacacagggcaccaagtcccgaggctgcacacagcaaggggaccctgggcccagcccaggaaaccactttttcctcctgggcctctggacctgtgatgggaggggctgctgtgaaggtctctgatgtggcctggggacattttccccatggtcttgtagattaacattaggctccttcctacttatgcaaatttcggcagccagcttgaatttctccctagaaaatgggtttctcttttctattgcatagtcaggctgcaaattttccaaactttcatgctctgcttcccttataaaactgagtgcctttaacagcacccaatacacctctcgaatgctttgctgcttagaaatttctcctgccagacaccctaaatcatctcttgtaagtccaaagttccacaaatctctagggcataggcaaaatgctgccagtctctttgctaaaacataacaagagtcacctttgctccagttcccaacaagttcctcatctctatctgagaccacttcagcctcaaccttattgttcatatcaccatcagcatttttgtcaaagtgattcaacaaatctctaggaggttccaaactttacaacattttctcgtcttcttctgagccctccaaactgtttcatcctctgcctgttacccagttccaaagttgcatccacatttttgggtatattttcagcaacactcgactgtactggtactaatttattgtattagtctgttttcacactgctgataaagacatacccaagactgggaagaaaaagaagtttaattggacttacagttccacatggctggggaggcctcagaatcatggtgcgtggtgaaaggtacttcttacacagcaatgggaagagaaaaatggggagaagcaaaggcgggaatccctgatagacccaccagatctcatgaaacttattcactatcatgagaatagcatgggaaagaccagcccccgtgattcaattacctctcgctgggtctcttccacaacacatgggaattctgggagatacaattcaagttgagatttgagtgaggacagagccaaaccatatcataagcctttggacatgtagaacattgctcttttctctccctccccaccacccatcctccgcttgcactaccagtcttccacattcccaattttacttgactcatcactgataaccacatcacatcttccaaaagcctcctcctatcctccaaggttaggttagaaaatttatttaaaagctgtcttcaaatcctacatgtccttaatcattgcacttatctcagtgtattgtaacttccagtttgtttatctgtattcccatgaaactgtagatttcttaagaacagtgaatattatttgtccacatttgtttcctaagcatctagcatactgccaggtacacagtgggcctggcagtattatattaataaatattaatttataaatattaatatttaatgaatgaagatgcttatagacacacacacacatacacacactagtggccaggtaggatgacatttggtgccactaactatgttttatttgcctttaagctaaaccagaaatccctgtgattgtggaaaataactccacggatgtcttggtagaggtgagtcacataaaagcctttgaaaatctacagtattacatgtaaggtgtgtcaggttgcatagttgccaggaatgttctctcaaagaactttactccttggcccttgaccaattaactgctaatagggatgaagggaagctgggttgtttctagaaagtgaatgggaatttttacttttagacttagggctctcagaatgtttgatgtgcacttttagtccttaaatttctcagaaaaaaaaatagtcacaatttgtttaaacttctcttttataaaaattcaggtggatagtgaggacaaagtagggcagaaagcagtgtgagccctggtgtaagaaggaggcttttgctcagctgacgtttaatttgttctaatccatttcctttacccactttcccattgtttttatttcaaagtgacaggaggagatatgccctcctgtactcctgcagaaccctgggtatgtctttggtagtaatgaagaagggcaggagaaaaaagaaaattgaatagggacctctgacttaacttcttctgggtggtagttaccagcctgtagtcactaggatctggactcaatttctcgctctttctcttgcgagctgtgaccttgggcaaattacttcatgtctttgcagtcagtttccccatctatatgaagtgaataataatagtatcttcacattgttgctgtttttaaaaattaaataacatatgaaaaaatctaagtacagtgtgtgacatatattaagtgtttaataaacattattgttcttgtttttgttattattattatctgtgttaatcaactgtcttgtggccttatgactttagccaagcttttaaaaaccctaagtaaaaaatatactcattaattctctaacattttctattacatggggcgagagaaaattatattcattctagtttcttctcgcaccaataacattaaataacttacaatctctggtcttactgaatattagtcatttaatttgataattgcatacaaatcatagcttagattgtttgagatggttttgcataacttggaaaaatatcttccaagtagttgtgtcttttgccagtttcatatattagtctcttaggtaactgcttgtattagtccattttcatgctgccagtaaagacacacccaagactgggtaatttatacagggaaaagagtttaattggacttacagttgcacatagctggggaagcctgacaatcatggcggaaggcaagaaggagcacatcatgtcttacatggatggcagagggcaaaaagacaatgtgcaggaaaactcccccttataataaccatcagatctcatgagacttactcactatcatgataacagcacaggaaagtccccatgcttcaattacctcccaccaggtccctcccacaacacgtgggaattcgagattagatttgggtggtgacacagccaaaccatatcattccacctctgacctctcccaaatctcatgtcctcacatttcaaaaccaatcattcctttccaacagtcccccaaagtcttaactcattgcagcattaactcaaaagtccagagtccaaagtctcatctgagataaggcaagtcccttctgcctatgaacctgtaaaatcaaaagcatgttagttacatcctagatacaatggagtacaggtattggataaatacagccattccaaatggaagacattggccaaaacaagtctgaaatccagcagggcagtcaaatcttaaggctccaaaatgatctcctttgactccaagactcatatccaggtcatacagatgcaagaggtgggttcccatagtcttaggcagctccacccctgtggctttgcagggtataactcccctcctggctgttttcacaggctggcattgagtgtctgcagcttttccaggcacacagtgcaagctgttggtggatctaccattctgtggtctgaaggatggtagtcctcttctcacatctctgctaggtggtgtcccattagggacacaagctctgccagtgtggctttgcaggatacagcctccctcctggctgctttcatggtctgatgatgagtttctgcagcttttccaggcacacagtgcaagctgtcacggatctaccattctgggatctgaagaatggtggtcctcttctcacagctccactaggcagtagcatagtggggactacttgtggggcctccaaccccacatcttccttttgcactgccctaggtggggttctccatgagggccccgcctgcagcaaacttttgcctgggcatccaggcattcccatacatcttctgaaatgtaggcagaggttcccaaacctcaattcttgacttctgtgcacctacaggctgaacaccacgtggaagcttccaaggcttgggacttccaccctctgaagcagcagcccaagctgtacccttggcccctttcagttatggctggagtggctaggacacagggcaccaagtcccaagactgcgcacagcatggagacctggggcatcacccacaaatccattttttcctcctaaacctctgggcctctgaaggaggggctgctgcaaaagtctccaacatgccctggaaacattttccccattgccttgatgattaacattcagctccttgttacttatgcaaatttctgcagccagcttgattttctctccagaaaatgggattttcttttctatcacattgtcaggctacaaattttccaaacttttattctctgtttatcttttgaaactgaatgcctttaacagcacccaagttacctcttgcatgctttgctgcttagaaattttttctgccagatatcctaaatcatctatcttaagttcaaagttccacagatctctagggtaggggcaaaatgccaccagtctcttaactaaaacataacaagagtcatctttgctccagttcccaacaagttcctcatctccatctgagacaacctcggcctggaccttattgttcatattactattggcatttttgttaaagccattcagcaagtctctaggaagttccaaactttcccatattttcctgtcttcttctgaacccaccaaactgttccaacctctgcctgttacccagttccaaagttgcatccacatttttggttattttttcagcagtgcccactcttctgataccaatttactgtattagtccattttcatactactgataaagacatacccaagactgggtaatttatacaggaaaaaggttataataaccatcagatctcatgagacttactcactgtcacaaaaacagcatgggaaagacctgcccccatgattcagttacctctcactgggagttcaagatgagatttggatgaggacacagccaaaccatatcactgctattataatcctgattatacagcaaaagatttaatcatttttgctgtgttgtaacttaatttctaagtgtattagtgaacttcatttcaatagtttacatttcaaaaataagctaatcatacagcttttggtaggtgtttttgtttctttttttttctttttttttttttttgagatgagtctcactctgtcacccaggctggagtccagtgccgcgatctctgctcactgcaagctccgcctcctgggttcacgctattctcctgcctcagcctcctgagtagctgggattacaggcgcctgccaccatgcctggctaattttttgtatttttagtagagatggggtttcaccgtgttagccagggtggtctcaatgccctgacctcgtgatccgcccgcctcggcctcccagagtgctgggattacaggcatgagccaccatgcccggcctgtttttgttttttataaggatctctaatagattcttggtgccagtgtttacaggtaatatgggctcaatccagatataggaccataaattggatccaagaatcccagttttaaaataaaacaaaaaactttacctaatgtgccataaaatttcctcttctctacccttgctttagtgctaactaagaaaaccagagaattttccttcctagagaattagtgagtaatctttctccaatcacacataaccagctacaggacatggcttgtctatggatcttttcagatcttgccaaacattagtaactcctcactctaatattcttacaatccctgctgtatttttaataatttattaactcttcaaagtcctttcacatacttttatcttgtgctgctcccagtgagcctctgaaatagatagggcatctgtcattttacagatgaaaaattggggcctggaaagtcttaacaactggctgagtcactaataaggggcagagctgggatgcatatttagtgtgcctgtatccaggcagaatagtattattatgatggaaggatatcatgcttcagggtcagatagcacaagtgtcaaattctaattcaactacttagctggttacataccctcatcaattaattaacctccacgagcctcagctaactcatatctaaaactggaataataacaaatacttcagagggttcttaggaaggttaaatttatgctctaatggagttcatggcacatagtatacatttcaggaatatttcttccctacccactatttatcatttacccactctcttacgttcataaatcagctatgtgactgattctagcagatactgtggaataattttttttaacccagaatacagactgtgggatctgatagaactaggtttgaattctcttccagcacttattaactctggcccctaagagctcagttccttaacttcctcaaaagtaaatgagggcaatggctccaacttcacaagggtgatgttaaggatcaagtaagagaatgtatgcaaaatacctaccatccagcaaccacaggtttttggtgttggcaatttcctgcccctccttcattccttagaaattcttgaagtcaacatgcacacactgtctctgctacctgttcactacactagcagcccgcagtgtggaaatactctggggacttggtcagttgtgagctgtgtcttcctgtgttattagttaaacttacaaagtttatggctaattttagtatttctgtaaaatacaagacccaaaagcatgatgcccctcaggcatggacatgccgtagatgtctaaagagagtgtcacacctgtgaatgttgtatcttatgcattcccaaagtcaagattttgccagggctccaacttgacacacagcttcactcctgcactacaatgagaaaagagtctttaacctaaatttcagggcccctccatgtggcaggtttttgtattagagcaaaagatatcaagccaaagagcccctcaactcacagctaatgatgtagcataagaaggcacaagagggatgcataaaagctccagagtgtactcagcagttcagactttccacaagcctcatacgtctctcactcttatgcttgtgctttatactttagccccgtcatctccatgggtcttgttcatatcactcgctacctttgttatgtttgaaataaattaggaaaaaaaatctaaagaaaattatctgtcatgaaacataggaaacaaaagcagtttggggttaagttgcctacaaaggaagagaggctacaatattaataaccatgtaaaacagataccagaggccagaagcagtggctcacgcctgtaatcccaacactttgggaggccgaggtgcgcggatcatgaggtcaagagatccagaccatcctggccaacgtggtgaaaccttgtctgtgctaaaaatacaaaaattagctgggcgtggtggcacgcacctgtagtcccagctactcaggaggcttaggcagaagaattgcttgaacccaggaggcggaggttgcagtgagccaagatcgcgccactgcactcctgcctggcaagagagtgagactccatcttaaaaaaaaaaaaaaaaaaaaaaaagacaccagaacctaaataccacactggttggcatcagcagagctccagcatctttgtgcagaatttgattatttgtgtttatttggtttgggttttgcaaagcttgaaccctgtggtttcctcaagcttcctaagccccactccaaaaatatgtgttttggttttcattttttaaataattaggtattacagcctccttttttttcctagcatcttttgcaacataataaggttctgagtccaaatgtccagccgtcgtcacttgcactggtgagcacctgagcttgcaccacaggtagagaaggttctaaaagggcatcatacctctgtggggagaccacatgacaaatgaaatctttaatatcaggcagatctctagataaaaaaagaacatgacgggacttcagtgtggcctggttatttcacaagcctggtgcctggacttttgtttgttctacaaacagctgttagggaagacaggtctagaagtgagggctgcctagcaagtctaggaagaatatgagtgaactacataggtcagggccaaaggaggcaagacaccactgttacacaaggacatcctctgcttccagagaggttggtgcccacaaagtacttgggctatctctgagataatgggatgctgtctttatctattcctgtcttcccaagctctttccccactccatccccattcccaacccacattatgttttgttttttaatgtgtgtgtttggttggaggagggtggtgtggttatagaggaatctgtcttctataacaaatatcaggtccagtgcagaggccagagtactttccagtttgattttattctatttctaaattaatattttaggcatactttcagcagcccaggaaattactctctccctatagactgttaggatctcttttttcaaagcatctctgaacatttaaaggtaaacagtttttaaaaatcagtgaacagtggattggcatgcagttagcatttcagaggtatgagtaaaatctaaaacctactgttcaaataaataactggtctgtaggcacaaagcaaaatcaagttaactcattaaaattaacttcaggatctaagaaaatgtactccatccttccctcattcagacagtcatgttctcttccattttcatgataaattttccctagagcactgtctctcttccccatctttgcatttcttctctatcccatttatttctaactttccttcctctgttctttatttctccttacttcctttatatctctgccttcttttcattctgaatttctttcagttcttcctcactaactccttttcctttgacaaaccttaatatgaaatcagattatattttaactatttatgaataagttttatataatctatactgaatgtttaaactaagtaagttgagaggtttttcatttctctgtgctaattacacattaattagtttaagcattaggttgttaaaaagacacaccggactcagattatactgatgaaacaactttaatataagcaagaaaatacattgcagcaataacaggagaaagagacgcattggaaaggtccaaagatctgaggctcacagttctttgtccttccacttgctgggtcacacagaacaagcttttattcatactggtggtctggaaactccaccagtacatgtgctaagacctcagtcctaggaagattaagctctgcttccggcagggtgtctgcaagtgagctggtcacataggcacattccagctacctaaccagcctcagccctcaaaatcgtcagctccaccaaaaccgagtgctaggcaaaaatctgattattttgttaaacaacgctgactggctggtacattctgccctgaaacaactcacagagttttactttggtagaagcatttatctttaataggtacattttagagtttcggccaagggtcagcagagctctaggaacctcgtagataagcatttggtcaattcagacctgctcagattaactcatactgtgcactatttcacataaaagcaaaatgtcaccaaactactttgctttacatttgagttgaaactaaaatggctcttttctacaagtctagagtcaatgttttcagaatagattctccaagcccaatttaaacaaaatggaagggatgtactgctgcaggcagctctttctcccgctggcatgcctccttctcagccctcaccttccacttcatctccaggatggccctttccacctcctccagggctcgctcccttttttccacagccctctcccgccattccactgccctttccctcctaagcacctccttttccctttggctggcccacaaagccatggtgcccacctgctccaggagcctaccccagttaccctcaatgcctgtggggagctggggcccgtggggccttggatcctggcgctgcccagcctgaccatggccactcttctccagctcctctctgtgcatgcttttcagatgcttccacagtgcagtggtgcccacgttgaccccagggccacggctcacctgcctgccacacaggcggcaggtggcatactggttgggatggtgcccagcacgagcaggagctaggtggaaatattcccatgcctcagagaaccgggtgcccttgttgtggggcattggagtgggcatagcactcacaaaagggccaaccagttctcctgtctcactaatctcttcctcctccttcatctctaagtccccttttgccttcatcattgttccctcctcttcctcgtcttcccgcctcatcatgtcacctcttctacagcgttctttatgatgtgcttagatgtgagccaaaagcttatttgaaccacaagattaaatatatatttgggaagggcctgtggtaactcttggggattcacaataatggccaaagtctggccacacctgggtggtgtgaggtttcttcctttctgcttcactggagagtcaggggtgagtcagatacaagcaaaacagcccaagagtgcattccttccatgccccagatacttacttatcctcccttgactaggccagaaagacaaaacatatcagttcctgtagcaaaggggttctctggtccaacaattacaaagctctttgatgaactcagtgttttctgcatcaaccaccacgacaggtatttttgaatattgaaaattttaggttttcttgtttctcctcctggttgtttccactgtttctgtgcttcttatttcctataattgcattttggaggcaggagaaacagcctcagggttcaggcttttcaggaccaacagagctagggcctcactgggtcttgctcaaagtaggtaaaagcaaacacaggcagatgctggtgcaggagacaatcttgcttcctaagaactgttgcaacaagcaatccagagtagacaaagcctatgaggatctggataataaagttcccaatgcaaggtcagtttgtccttagaggtgtctctcagaggccaggagtctaagaaatccaaaaagcaagctcagctgtttcagcaggaggagctgggatgcacagaggagaaggtggagcacatcttcacaaacacagcgttgcctggctgtccttagcaagcagctcaccatactccaccttctccaccaggatcacctgcaaagccaacagccaataagaccttcctgaggcaacttactccagatgttttgctctttacctcattttaaagataaataagtaaatggaaaatcatattacatttaaaaacagcccgacttctctctcctttcttgggtcatttcttaaactaatgagagctttatttaatcaagctctgcaaccgtgaacagttaggaaattccccccagccacaagtgggtacttacaagcaggcaaggctctggacttctctctgatctttcctgcgcagagtgaaagcactcctgcacaccttggatgtctattagctgactcctacccccagaaggagggcacctccagttctggtttcctcccacttctagggaagcattgtttccaggtaggtgtgtctgtgcctgttgggtttttctgcaacacttagacacagatgcaaaccttttctccaccccctccaccaccaagaaaaggatgttcctggcatatgtcatgcagcaaaacagtaagtcaagcacctacaagtcttagttctcttttttgatgactagattacctaacctctcaagtaaagcaagcgatttgaaggaggaagagtgggaaaggctgaaatattaaatgtatacacacatatatattatatatatacatacattatatataatatgcataatatatatatgtgtgtgtatacatatttagattgagaaggaaaacctaccaagaggagataggaagactctaaagaaggtatcaatagaagaagaaaaaactttgtgttataaaaggaaagatagaaatggcattgcaggccaggagccatggatcttgcctgtagtcccagcactttgggaggccgaggcaggtggatcacttgaggtcaggagatcgtggccagcttggccaacattgtgaaaccctgtctctactaaaaatgcaaaaattagccaggtgtggtggtgcacgcctgtaatcccagctacttgggaggctgaagcaagagaattgcttgaacccgggaggtggaggttgcagtaagccaagatcatgccactgcactccagcctgggcgacagagggagactctgtctcaaaaaaataaataaataaaatgaataaataaaaataaaaaaagaaagaaaagaaaaagaaatggcatagcagaaaatatgtagaggttgacagttaaattaaaatagaaaaaaaagatgggggaaaaagattcaaaataggaatgagactgggaggagttttagaacatgaaccacatttctaaaccaaatcttggaacgcaaagtctagagagagtctagaatgtttgaaatttggatcatttcagaaaatctgaacctagagaattcatgaaagtcaaatcttttcaaaatttttagacgttaaccagagttcttcagtgagccagttgccttcgtaaaataataacacccccacttactcctgatattaccatatcgtcatctttggtgggttaactaaagagaaaggaaatgaatcataagaatggttaatgtcactggattaatgcaaaactttgtatctttttctttttttaaaaaaacattttacctcctttacctttttgtctcttcctggaccaactggagataaaaatcaatctttggcatctattgaattaaactgaacactctcctttacttaataagaatgtattttagaggatctggttttgcttttaattttttagtggagagactagcatccctggcccatatatgtatccccattatctggaaaggcaagtgttgaacggatgggaatactgggagctacggtgtttgccacccagcatcttggatatgctagacaaccccctctgaaattctcttgtttcattgggatttctgtagcaatgtactgagaaatagtaaacttctgtaggatttcaccaggaaaatgttagttagcattctcgaatttggtttctcagctctataggcccagacttcttgggagtaactagtctgaggattggcacacaaatcatcacatacatttaattgttctttacatgttaactagtatattcattaattgtggaaaatatctgagaactaagaactagggctggtcatatgtaaaatatatacatctcttgatgagaaaacaagtaattataaaaggaattataattttgaagagtctcagataaaacaatgggaatccaataattctcactggatattttcaccagactgtaaaagaaagtatcatcccccaaagaacaaacatagcattgaaaataaaacataactagccctgcatctaagttctctgctttcataatatagttacttctttcatttttttatttcaatacaatttttattaaaaaatatgttggactgagattaaggagacatggtttctaattgtgccattaactattttccacttcctcgaaccactgggtgccttgatttttccattggtcaaatggcaaaaataaggcatgctctacctatccttaagattaagccaatgaattgtttttaaaaattaggaaaatgcttcacaagtaaaaagtaggatatttatataaatcgttttctgtgattgttacaaatagtgtcgtacattatttggagcacagaaacagcttgtagatccccttgagcttttaatctaacagactattcttctctggcctctgtttgctatagcttcttccttctattctttggtttccatttagtattattttattctgcctacacagagttaagatttctcctttacagaacccagaatccagacttggaacattagtatagtcctagatccttaagttgacctaggagtatagccagaagtttataacatctctataggagatagcccatttatagtgcacgttctaacacaacctatattaaaagtagacattgccttctatttattcagttaaaaatggagaaactcttttttgccaacttatatgaatgttagtaagttgtaaggagtaccagtttcttaggaatttgcaaataatcctttttctgtctttaccccagagaagatttacctgcttactaaagaatgtatttcccaaagcaaatatcacatggtttatagatggaagttttcttcatgatgaaaaagaaggtaaggaaactaatcaatggaaataagttcggtacaaaaagaaagaaaacaaagaacattagaaattgtcattgcccaagttgatcttggcatttaagaatgattctcattccaagaaaaacatcattctgcctaccaaatgtcattttctgatgcttcatctgtttcttccaagggggtggagtgtaacattttccagaataaaagaaatacaattgatttagacaaacaacatccaaatattttatttaactagcagtaaaaggaatatcttaaatgaggacaaaaagtttaagtctacatatatttattaaaactttttctgcctttataacatagctacctgtttttccatgtctttcttatttcaatacaatatgttcaattaacttagcaccgctgctttaaatcagccaataaataatttctacctttttatgtgagaatctgaggcaggtgttggtggagcactagagaaagcctatgtaaaagagttggctccttgacaaggtacatgttccccaggaggattaaaagttcctggaggaggaacacacatcaagacaagctcaggtgaaaattcacaaagccatgattttatagatagtaaccatgacagcctctaccagaataatctcagctgtccctgcctgaacaacagctattctcctttctcctgagtcgtttttcctccaagttcaatctgtcttcaataataactgagtcacacaactctttctgaattatttttattttattttattttattttattttgagacggagtctggctctgttgcccaagctggagtgcagtggggcgatctcggctcattgcaagctccgcctcccgggttcacgccattctcctgcctcagcctcccgagtagctgggactacaggcgcccgccactacgcccggctaattttttgtatttttagatgagtcggggtttcaccgtgttagccaggatggtctcgatctcctgacctcgtgatccgcccgcctcagcctcccaaagtactgggattacaggcttgagccaccgcgcccagccctttctgaattatttttaaatgataaaattgaaagcttatgttaatgagtgtattgatcacttgatgcattttgagattattattggttttattagtttatttttaaaaaaaattcacccacaacaatgacagaatgcaattctaaaaatataggttaaaagttattataggccaggcgcagtggcacacacttgtaatctcagcactttgggaggccgaagggtgtggattacctgaggttaggagttcgagaccagcctaactaacatggtaaaaccccgtctctactaaaaatacaaaaaaatagctgggtgtgatggtgggcatgtgtaataccagctacttgggaggctgaggcaggagaatcgcttgaacctgggaagcaaaggttgcagtgaaccaagattgcgccattgcactccagcctgggcaacaagagtgaaaccctatctcaaaaaaaaaaaaagttattataaatttattctcctgttaaataagccctgcataggcaaagcacccagatttcaccaaactagaggctagattttgtggtcagaattgcactggcacacaactgcatttagctattactttggtaagtaattacatcagaattggtgttaagaatctgtaatgtgaaaaagctgtaagaatccagaaaattctgacatatagtgatagttggttttacattaattttctgctgccaagtatgctatttggaggttgtactaacataacagtttaaaacagagtttgatttctaaagaagactcacaggacccaaaatgcaatgcttacaaatctacagcttatttcaagaagaggagacaacatagcaaaaagattacaatatgcagcatatcctatcctacacttacagccaggagtccagagaagtcagatatgagctccttcgtccttcctctctaagggccacagccagacacacttcctcgctcagatcagagactactgatatatacacagaagagctcagaagtgggtagtccaaaacggagtcccaactgagattgctttatattttactggtcacttaggtatattcctgcaacataaccagattccacagcagagctctcccaagatccgacctagactaggtataaattatcagtctcacagttgtcaacacacaatgctgatgagctgggataatctgccccaaaacattttggacacatggtcacaaacaaagcaacactattagtcaacatattttataccctgaccatggatcaatgacatgcaggagcttgagcaaacagctcaagttaatttcagatctgctgaaattgactctcactgcagagaagctgccatttgaccactttagactctacattaccacaaattgatcatgccatgccttggcattattgtatggctcatacataaaatgttagtgttgaaccatgttcgtatctgtctggcaggaatatatattactaatgaagagagaaaaggcaaagatggatttttggaactgaagtctgttttaacaagggtacatagtaataaaccagcccaatcagacaacttgaccatttggtgtatggctctgtctccagtcccaggaaataaagtgtggaacatctcatcagaaaagatcacttttctcttaggtgagttgtctatttaataagatcaacaagagtttgctaagactgccataaattcaaaatatctttaatgggaagattatcacttccataacgttttaatctcagaaaactttttatgtaactcaaaactatttcaagttatcaaacatttttgacaagtaggactccagtgaaaagaattcttcaactaaaaagaaaatagttgattcatgttttcacaagaatttctgctgcatacagaaaattttttgttccaatttaattcatcataactcttaattagttagcatttttgttaatccatcacatattgaaaattaatactaatactgatgatcaagaaagatttaaaagacctaaaattccttctgcatcattagaaacattccattatgtacaacatatatacttttaatatttaggaatggataaaatgtgtacaataaaaataccataaaaatagggattgtatcttaataattgtagtatccctaggttcaagcactatagttagctaatagaagatttttatgattgaaaattgatatataggattactctagttattatatcatttgactaaccagagtatttactaccctgaaccagatggaataatggagattttactacataaaagatgaactaatacctcaataaatacagtgacaacagatatgcctgaagaaaaatagaagcaatggcaactgtcagatattcatatttaacagtaatcttataaaacgtaaatagatttgcaaatcattattacaactctataggagcattgacctcttaaaccacatcctattttcagagatatcataatctataacatactcataaaaacacagaataatttaagaaggaaacagtttttctttgttacaagggcacaacccgcatcttgggttctgtccagctccttcacaggtgcagtggttggttatgaagaaaagtgtacccagcataaatctatccctactactcagaagcaggtgtgattctgatgccggggcactggcatcgctcccgtagccttgcctgtgtgtctgtgtatatgtatatgtatgaacacatcatcctgtgtactttgagttaatcattcagaaattgtgatgtatttacactaaaatagccttactcaacttcatctaattccctcaggaataagtcagctccttcctggaaagctggacataatagggctgcagtcttggaacaatgtggaggtagctgattctcacatagatttgtcagtagctttggcagaatctaaggatgtgagctaaaggaccctaaaagctcaaattcctaaaaagaaccctattcccattataggtagaaccatgtctgtaaaactaatattttctgatgttaaaacagtgcttgatttcagtatcagaaaataatgaatacctttttaggtaataggaagaacactgattctgatactgaaaacataccataattccaattgtatagggcagagcttgatctagtataatttggggctctgaacaggtggttaattttaaattgccaaatgagtctttatcctttatgatcaaatattaaagacaattaatctttaggagttcagtttctcaaaattatagcttacattctcatcccattctggcatatatctatgtgactgacttagaagatgtagtcaaggctctataaagcagtgtcatcactgtattatgtctccctattgttgcaagctcttaaacacttacttccacacaggctgtctgtctgtgatggtactgccggatgctttatgaactccggagtaaacttctgatgtgtggtgcaagagtcattgccttaccaagctatttattgttgacaagatactgagatgaagacacagaagaaaaatctgccatccctgagtgctagattagagaaacgctaagaatattacacatcaggaaagagttttagtgagacaaggggagaagttttgctctctttgatcccttttgcttccagaaaagggtattaatgttggagactgtgaggtaacagccctttgaggtgattccttctccacctacgcccagtctcccaagtgttcagtgatccctattctagaaaactcagacagggcatgggattagggttagggtgatcagtgactcttcaggcagctatttgtgcactaggacctgcagaattcccatgatccacagtaactaccactaagaaaaaaaagcctttcaaaaatatcatggaccaggcacagtggctcatgcctgcaatcccagaactttgggaggctgaagcaggaggattgcttaagtgcagaagttcaagatcagcctggacaatatagtgacactttgtctctaccaaaaaattcaaaaaatcagccgggcatggtggcgcacatcattagtccctgttacctcgggaggctgaggtgggaggattgcatgagcccaggaggctgaagctccagtgagccgtgatcatgccactacactccagcctgggcaacagagcaaggctttgtctcaaaaaaaaaaaaaaatcccgccctgctagcatgtcaaaatgtctaaaatcatggcactgctgagtctatttctggcagatttgaagagctgggttttgtgggttttgttttggggagtggataggagacattttgtcttgttttaatgcaaaagttgagtgcaataccccctggggtggataatattttggttgtcatctcccttgacagagatttgtttattaaatggatttctgactgtagctgttgagatcaagacctttgggatagaaacagagttaagcattgacagttgtgtaggtgtatgtgtgtgtaagtatgcatgtgtatcttcgcatgtagaaagaggagtaataaaaagatatcttaatagtggaacaggaggaccactgcatattggtgtggaagatgccagacaaatacttcctgtttcatgacttccctcagtgcagctggcctcatacccttgactgatcctttctgagagtatcagttgagaactttaatatgcatataaatcacccagggatcttgctaaaatacaaaaattctgattaagtaaatctaggtgggacctgagattctgcatttgtaaaaagaccctcaaagaaacatattctgcttgtctatggacaacattttgagaagaaaggacctagcaagccctgggatttggcttacttctaggtggatgagataagggcttatacaagctctgaggaaaccccggaattaagccagttgccctatgggacagacccatggctgctgctgcccatgagggtggttctgagagccctgccaagcctactcaaatggacacacccaggaacagatgaagtggctttaggcggcagcttaccctcttatgacattatggtaaatgcaatgatctggaaactggcagaggtgtttctgctaaattctgcatttgggttttgggaaactgtctctcctttttaggttttaaccactcttttcatacccctgagttttgttttgaccaaggcagagtttccactttacagtctaatctaaaactagacagacatgtttaggtcccacattttatgtggaaagctatgtttcccctctgtcacaaggcaaagtgttcatctcaaaatgcacatcttacaataatatcttcttaatacactatgaggctgaacacctcagcttacaaaatcacttggtgatgaaatatggcagaaaagtatcctcaaactgaaatgttcaatcaatgaaaaataaatgtttcccattgtggaaactgagcataacgcaccaatatcttctgttccaggaactggcaaccttcttctgtaaagagctagatagtaaatatattttaggctttgtagactttttaatctctatcacaattactcaactctgtcaccttagcacaaaagcaaccatggacaataggttaaaagaaaaaaagggaaaaactgtgttccaataaaatttttataaacatgatttcactgtaggccatagtttgccaacctctattttaatcaatatacagagaaaaacatctaggcatttattttccaagccaatgtcctgtcttattaaggtaccactttggaagataatgcttatgatccaccagctgtcagacacacacttaatgctggtcttctttctttcagtgttaagaataaatttgcatgcattgattcatctacttccatttgccagaatccataaatatggtgtggagcaaaacagtgacttcccttgaggggcatatatgatgacacagtgatgaggcatttgctagggtaaacactgaggggtgatcacatcacaaagatccccaggcttcctcagcttgagaaggtacattcaggaaagtttggggtcaggaaaccacataaattaagatcaagaagtcccagaagtcacagagagaatattgtgtttcagaaattgggttgaaatattgcttattggatagaggggattatttgagagagatggaaaaaatgataagcaacatcaggaaattgggagtgtaatgacagcccaaatcataattagacttgtgtgtcatgctgaagagttcaaacttattttggatgtatgaagaaaaaggatggtcattttgttaacctattcatatacttcccatataaccgtcctccacctcctcagagattatttgcacaaaagcattcatatagtagtggatcagagctagctatgagtgccacccacagccactggcaatagcagtgctactagcaataagaatagaacatacatgcatctagcttagaaaaaccaattcctcccacggggctatgtgctatcaagtgacataatgtaagtaaaatatacttgtcccttaaagtacattacagaatagaaccaatagtttaattagtaattaaacatccaaataattgatatatatcagcagatgtgtaacactgtaaccagtaacattatatctacaaaaatcataaaatcttctaacttcaaaatcatctaagcacatttaacccacatgttcctaaagtcaatagagccttctggcatttgtaaattgtccttccaataggactatttttaaatacagtaatggagatttaaggaattgacataaatgtaaaatataagtaaaaccacattctagcctctgtttcaactccccccaacacagacacacgcacgcacacacacaaaagaaaaagttgtagccaaacaaaaatattatgacaaaagttgtcatgttagaaagcagaaaaacatcacacatttactaatgttacatccaattgggtagttgtatcattgtttctactcttgctgatataaaaatttttgtgagtttatggattttgtaaactgcatgattacttttcaaacacttgaaaatattaaatgctataatagttttaccaggtcttggtaaagtgtaactttttccagggagccttctcagacctcccaatctttatcagtgccccttcgttgtgttcctgtggccacctatgctttccactgtcatggtactcaacacaatgcttggctgcctagtttccaggccataggccctttaaggacgatcccatgtcttcctcattcatcattatatcccactgccttgaccttaatagggccccaatattgatttgttacatgatgaataaataaaggaaagtgtatttaagaactaagtcaatactttatcttttgattacaatattttgttcattataaatctctttctaatcctttaaggttctgaaatttcctcaacagaccctccactgagtgttacagaatctacccttgacacccaaccttctccagccagcagtgtatctcctgcaagtaagaatgttttcacactgagctattgatttaaccaagcagattgataacgataaaatttcagcaaacttgcatcattcatgcctgtttcttagctatgacttttttggggctgaaattgggttttattttttaacagctttattgagatataattcacgtcacattaacttgcccatttaaaatgtatgatctaatggtttttagtatgttcacagacttgtacaaccatgactacagccaatttcagaacattttcatcatctaataaagaaactcctaaacatattaaagtatcattctcatggcttcaaagagttaacatagcttccaaaatcctttacttaaagccctgggaaaatcaaggtaaataaatattcagtgaggaatttaaattctgtatttattattaaataggttaataaatgacagtcattctccaaaacaatgttctcagtggggagtttaagagattggttgtaaatggggataggccaaaagaggttgaatccttttaaatttaaatttgttctggttcaaattaatgttgacaaagttgactggtaaggactatgaattcagccctcccatctgaggcatcattaataatggaggtcagtctgggtcagcaatgctatggcaaaggagtggcagtgactctcaaaacttgtcattgatgcaacaaatcataaattcccacgtctgtggcttttgtgtctaacaaagaaccatggtgactctctaatacacaaaagcttatattctatgtaaagtagaagtatggctctcatttctcatttaattaaaactatcaattttagctcaaaatgagaactgaaaatggaataaaacaaaagcagtcagtaggaatgaacaattcctttggctggtaacctttggcatgtagcctgcagtcgctgtcacaggttgatacttctcagaaaatgaagcaagtggcagaaaagcttgcaaaccacccatcaaaagtttcatatccatctgattttctcatgttcttaatgttttgtaatttttcttttcttctttttttgaagcctctttttcttctacttttaactcactgccggttaatcatggcatttttcatttaacaagtattagcatattcaaaaataataaaaccttaaatctctctagtatcctgtgtattagttatccattgctgcattaaaaatgccccaaattttagcaaaacatatattgtcgcatatggtttctgggggtcagaaattcaggagcagcctagctggaaggtgctaacctgggttctttcatgaggtgcagtcacaccgttggctgaggcttcagtcatctgaaggcctgactggaactaaagaatctgcttctaagctctagcatatagatggtctcagttcctcagcacatggtcttctctatagctctgcatacaatatggcagttggcttcctctggaccaagtaattcaagaaacagtgtgactaagtcaaaagccatattgcctttttatggcttagtctccaaaattgcatgtcattacttctgctttattttatctactagaagtaagtcactaggtccatcttatactcaaggggatgagaattaggctccaagtctcaaagaatctgtgaacaaattaaagccaccataccctgtcatttagaagtgtctgtaaataaaaggcaatgtggtttgatctttattatgagtggtagacagagcaagcattattgttcccacttgccagatggggactttaagacactgagagcttaagtgatcacatacctagtaagtgacagtgttttgcattcacaccacagtgttatgaccaaatttagttctcaccacattagacaccattttttctccagttggtctaaacatatcgtgagaacaggaaccgtatttgtttttcctcctagcacagagtagagagtcaaaaactattagttgaataactaactgaatgaatgaaataattaataagaataatgttccttcactatgtagatgttatttaatagattatttaatgctaaagaaaaaagataaaaatagatttctgccttcagaaaggttgcagtctacttggaagagaaggtatacacacataaaaataataattcaaaatactaagatgaaaggtggtgtaccttacagaattaaaatgcccagggagaggtacaaaccagtaagtattagactttgaaagttctttgtgagttcatgggctcagaaaatgttacccgggagagatgaaataacttgacctttgaagtatgtattgtatatatttgactcagtggagagctcgaaagaacgttctaaacagagaaaacaaagtgagcatttgtgcagtgacaaagatgtttatgggcatttgagaaagcatcagtagataagtttggatcaaagaggtggtattgtgtaccaaaaaaacagggatgaaaattggaaaatgcaaagtaaacaaagccttgagccccagtttaaggactccaaatgctatcctttatgaaatgggggaaggacctcattccactttattttagaaagaaagtggtattatttattcatcaaatatttattgagcacttactatatatcaggtacctttgtaggtgctgtgaatacagcaatgaacaaaactgaaaaaaaaaatgtcctcatggcatttatattctgctagttaaaagcagacatgaatttcttctagttgcatttttatggggttagtctacatacactaagtgcttatatcagtgcttacaaacacaattcttctgtgacaaaattcaaagcaaaagaaagcagttgttacacttcagaagcctacaatttaatatagttttagtattaatgaaggaaagaaagcacagtcaagtaccatatttgtttaaaaagcaggggggaaaaatgccacctgatctactatcacactaagacgatgtagttgggaagtctgtgcagactcaaaagacctccgtaaaacaaggttccaccacattggacctgaggattgtgttagataagtggttgtcaaccagggtaattttgccactccagaggacctttggcagtgcctggagacattttgggttgtcacaatgagggtaggagggtgctactggcatctagtgtatagaggcctgggatgctgctaaacattgtacaacacagcccagaacagccctcacaacaaagaattatttggttcaaaatgtcaatagtgccaaggccaagaagacttgttttagatcaaggcttaggtgtaattacagtaggtatctcttactttacaaaatcaaatctggatttctgtcaagatggcaacaatagtttatgtttggaataattttctgtttgattttgtatgtcaataaaactcatgttaaaccagtggcagattatgtctaaataaacttatctttttggaataatcactgaattactattgaaaaatccaaattttgccttggcaaactggagggtaattgtgaaatcacacgatgacttcctgcctcagaagctggtaggattcacctttgcatgttctttgaagaaaggaagtgagatgaagtatgtcacggaaaccaacttcaaaggctgtggtttcattccgaattctaagatgtaatgagctttataatccagtcatcattacgaagctgcatgtctggctgcaagcatccaattcttattttttcctcgatgaaaggatattttttaaacaaatgttgaaggtcatgaaagcaatattctttaatgaggggaggagaacttaataactcataacaaactgtaagagttatccagggaagcccagctcaattcaacctgaaccaattcgtgtttgctgagtcccagctgcattctcagcgcagttcaaggaagacaggctgacaagctaagtggcaagatgagacaagtccatgtggaacaatcagagacaactgatgaatccagggtggggctgtacagacacaattcaggagtttccgtcgccttgaggagagagccctgtgcctttcaattcactggctatgatttggctaagagttacgtagcctaagagatgccaacccggtgtggcaatcatccaagacacttattcatgaaactcataagtatggagcgcctacaatgtgtcagggacttttgaggtacaggatacagtgatgaacaagacagacagggctcctgttgcttacagagcttacgatcctgtgtgacccacttgccttgcctcctgttttactgcccatcagtccctttggctctgcctcctattgttatgtctgcacatgacccttagacctgatgatgttgattttaatattaagccctttctaaggacttagctggtcctcactatctgggtctttctattcctggatacttagagtaaaacactaggtccagtctgcctctaaccctcagccagcaccccaggtagacataactgatcttcggcaagtggatgatcagacattgaggggcacagggtaaaggaagcaactgaccaggggatgcaacaaaactactgatttatgagtaagcatgtcagaaatggtgggggatcaacccagaagacatgtcattagatgagattagaagaaagtaaatcagaaattcggcagttgataggggcattggattctagtgttaacaggggaacgccagagagagtctgcaagacagtgagaaggctccagtgatttgtttgtgatagcaacttctgacccctttgctagtcatgccatgcctgtattcaggtgcctcaattgctgtccaatagtttctgcctttatcaacatgtatctgctgctgaaaagtaagaaaagtcagtgagtgctgggggaaaggaagggggatcagggaagtcttcatgcagggtctggaagaaaatactgactcaggtggaagaaagatgagaaatggatcttcacattcgcatcataagcaaaggcgtaaaacaaaatgagtgcaggacatgagaagacaagcaggagttctgacattgcttgttgggagagggctaagggttgattaggtggggtggaacaaggtaaagatgagcttcaactcatttagccccaattcatagcccacagcccagcatgtctcctttatgctggactgaaggtcagtgcccatgttatcctgaccacgcagattgatgaggccgattcaaatgtgtttagatgtagttgaaggcctgtattgtccagttaatgtcactactgtgtttaaacgtcaactaatgggctatgaatcggggctgtgatctgaacaacaaatagccactatggctttttttgtatgtgggaaaatgtcaggaaaacagcagttatgtatatggtaggtgatagttgcaagagcagggagaaaaaagactaaatgatatagatttaaagtggtttaagtttgttttccatgatcacgaaggtggttaaaaaaatgatatgatctgaactagaatgggcatttgtagaaatggagagtgctgcaacagaggctcaccaggattgtctgcctaaatacagggactaaaaaggttttcagagaacaatcatacaaggacctttccattttttccctagcaattacataaaaatgtttaccaactgccatgattgtataataatactaagcaataatattaatatttgttggttgcctccaatgtgtatggactgttctaaactagtaaatgtattttctcattgaatcctcccaacaacacaattacttaggtactattattatcccactttacagatgaagatactgaggcacaaagaggttaaataactcacccaaagtcatgcagaaagtagatgagccagtattgagcccagacagacttcagaccttgagtcctgctgcctcaaagagtacatggttggtgctgaataaatgtctttagacactgaataaatcccttctagtgtgaagctgttataggtcttaggaaaaggtcaaacatgacacctatgcttatattaatctctccctttttcagaccagtgttttcctgagacatgcagcatctgagagtgaagataacatttcctcagttggaaataaattagagaaacccctcctgcatctgtagcccacccccgccatcaacactattatcatataattctcactgtagatatgaatctacagaatccatacaaaactccaatgcttttccttgaatcctgggaaattctgtttattgtatctttttcatcaccttccacctggggcacacaacattctgcagactgttaaaaggatttttcttttttctacatctgtcacctgtaagtcaaggttagccttcttgatgactagtttactttgggtattcatctattcagttactccccttggggtgagattcctcagggtaaaagctatcagttgacctatttttcagtttatttcataattattgagtatctacaagctcaccacatgatgcgtgatgagctctgtcctgcttactgtcatcttccccaagggagtcctgaaaccctttctggaccagtaatccagcaatacacattattattccccatttagtcagcacatgccccaaacaatctgcctcccacatgagaaaaattttatgcagggtttagatttaggtttaggtttcacacctcatgtctcctttatgctgggctgaaggtcagtgcccacgttatcctgaccacacagattgatgaagctgattcaaatgatgaagctgattcaaatgatgaagctgattcaaatgtgtttagatgtagttgaaggcctatattgtccagttaatgtcactactgtgtttaaaggctctttgtgctgcaggtgaattgatggagagcaattacacatttgtccagaaactagatggctaagtctaagtctgtgctatgccgataggtgctatagtgatagaatgaaaggcccaatggaaatatttctatttgagacaataagttaaatttttaggttcagttttacattggaataaggcaaaaccttagatagcagagtctgactaaccagataagttaaccagcagcttgaaacttacaaataacttttacctttgtacttggttgattaaataagctaaaccggtaggttagcaaagaataatttttactttttccattcttctctgttcaaatgagatatattgaataattttttcttggcctctaaaagaaatttcagacagattatttggcttttttggtgatttccatataataaatgtcatctggtccttttcagccacaagaacagacctgtgtcaataattaaaaactcttgtcaaatgtaatgtcaaaactcaaaaaagttaatttagtccagaacttctttcctcttccttcccccaagtgtggctctaactcaacttggaaacgctgggatatgtgaggtgggggtagggaagagacagggaatgtctctgattccctgacttggcttcatcctctcctccgctcctagctgctggcttgggtccctctttatggggaatggcgtaagaagaagagggagaggtaggtaaggaaggaacttccttaataggctggatgtaatctgacttaggtgtcctctggatgaggagaataaaaattgccatattgacttcatggggcactctggcagatttttcagaaatccctgactgtcctatggctgctgtcccttggtgcaggccatgcctctcttctggtcttctgcttccttctctctgcagcctctaaacttctgaaggtcagctcctcttgggggcttctttgttcctctaggtgttcttcctgagtgagattcttttcatggcaccctattatgtctggaaaaatgtgcacctttgcctactctatgggggaagtgctcctcttcaccagtgtggccctgtctctcttctccatgcccattcagagccactaaccaaccatggactcctaatgcagcctctccagcctgagtaaggcaccatgcccctttgtcctaaattccaggacacacaggtcaagagatatgagtatttctctcagatccacacttcgcttggtctaaagtgaaggagcggattcttcttcatcttctccatgagggagggcctgatgcacaggacccttcaaaggaactcttagccagtctgctcccaccccgtcacacagctttgaggttgatgatggaccaccactgacaggtcccactccacactgcctcgcatgtcctgcataggtgggctagaaccctgctttcaacgtgaggtggcttgtgccctgtattatggttcttaacctttggaacctcatctgaaatgaaggtacaagtattccatttaaaaattttgttctgcattaaccattgaagagttaaaggaaatacagtgaaaatgaagcaaacatgatgaggtgatggttaacccactgagaggatccacagaaagctgtagttcttagcaatagtgtgatggatggaagataaacactgagttctagaagcattggccaaaggtgaggatgcttgaggaacatgaagggagacaggagaatgcagaaaagggaaagctttcacgtgggtggttccttcttctaagggtgattaaaagcaacagaagagactaagcaaacaaaataccttctatagcacttggttcacagtaagtgtcaacatgttgtattctattattagaacctctaaatccatttggaaatacagtaagaacccaaggtaggaaatagagtggctgattgaccagtctgtctttgtctaaggggtgtgtgtgtatgtgtgtgtctgcgtgcatgtgtgttttaataaaaataatctaggtttagaatgaaagcaaataatctaggtttagaattatgtatctacttgagatagatactgatgtaaacaaaaccaggctcacaaggaccaacatctagtgaggggaggagggaagtgggcagtaaagatgagcagaaatctacagttagcatgaaaagccacattataccctacttgatatatcccccacgactgccctctccctttctcttgctttgctcagccaagctagcctcctagctgtttcttcaacataccaggatttctctcatctcagggccttttaacctcacttcctatgcctgaaaaattcttcccccaaatatctacatggatcacaccctcatcttctcgaaatttttgttcaaatgtcaccttctcgatgaggtactccatgaccatcatattttaaattgcagctgcctcccaccccatttcctgttccccttttttggctgtattttctccataacacattttaacaccgtctataagttacctgtttggctcctctccacacataaaaaaagtaaatctgatgagggcagtgttttttatcttatttgtctactgatacagctgtatcacctagaacaatgataacacatggttaccaataagtattgataattcagtaaatattttttaaatggagaatttttttaagtataaaaaagaagagattaacaaaggaaggctttagggaatgcagaggatatctccctaaagaaaagccatctggctagggctgatgtctgggtagccttatgacaggaagctgaaaggtggtggtgggacaggaagctgaaaggtggtggtgggacaggaagagaagctatcaaaggcctgctattctgggtggttgcgtgctagacatcatgagtgagctcttccgtggctaggccctgatgatgatgatgcatgctgcagcaaggctaactacacttataaggctaccagaatggaataaatatagtctttagtgtcagacagccttgggttcagttgttgtctctgccacctactggctctgtagcctagagcaagtcattctgatggcagcagctgcccgactggactagctgctgtggggatgccagctgtagtgagggaggcctggctgggactgttgagcccgtagaggctgagaacaggagggagcctgccccctactgacttggcaaggcaggagccctgggctttcagggcagctgcagccacccagctgtggctccagaccctgacacccctgctctcttgagggcctgggaacacccccgcttctgcaggctcagaagggcctgcttccaccccctggactcttcccactcccagcacctgctccaatttcagagcaaagatgaggctcagcccaggcactgtcacaacctggccaggtgtgtgcacacttggggcagcactgacacaccaatcccccaccttggccccctccagactttgggcgccaaggagcacaggaaggaggcagcaggtggagatgggctgagggcagctgggtgcaggcctgcaggtgccatttggtgcaaacagcctgggctatggaaggcatgatgacagtgggaggctgactaggttcctggatggaaaggtgtaggtccccagtgaaaccccaccttcaggccaggcatggcctgaagcctgggagccaggctgccagttccaagtgaagtccatggatatgagtaataacttcatcgatgaccactgggccaattggatagtgctttttcctggcctgcctatggccatctatggaccaatcaccatgcactttctcccttctgagcccatgaaaaaccggggattcagccagactcagaaagaagtcaagactaccagctgtgggagggagctacccactatgggtctcctcatccagacaacttgcctgcagaaaggagctacccactacaggtctcctctccactgagagctggacactcattgggacagcctgcatatggaaaggaactacccacttcaggtctcctgagagctgttctgtggctcagtgaagctcctctccaccttgctcaccctccagttgtcagcatacctcgttcttcttgggggcgagacaagaacttgggacctactgaatggtgggactgaaagagttgtaacacaaacccagctgaaacacacctcccacctgctcaccacattgcaagcaatgagaaggagagaagagctgtggcccttcagggagcccagacctaaggcctcccaggccagggctgtaaaaccctctttggagctctacagttcctggcatctccaagctttctggtgccacagtgttccccttgtccagacaccagtgcctgcagcagaaactgcttgccatacatctggtccagcagcagcatcacacagagtcggcacccatgctggagcctggagattcccaccctgcctcagcagccagtgtgcctggctgtgtgcagtggccagaccccacgctcactcgttcacacaccccttgctgctctgcacctggctcacccttggcaggtgtgggatccaggctggtagcacagaccaagcacagcctgccaaaccaagtgggtggaatgagcccagaagtgtgagcaatactcaggcagaaggtgccactggccacagaatttctggctggcaaagcaagacctcaaggatcccgtgacaatttcacctctgtagtagtttccttgtcttaaaaaaatgagagtaacattatctagttcatacaattattaggagaatcaaatgtgaaagtgcataaaaaacaacaatgaagctacgactcatactgtccagtttgagaagaaatgtcatgattaagagtctagtaagcaaaaaccatctcaaaataaatcaagacctttatatgtaatttttaattccttgaaggaggaaacaatgaccaaatttatttctctcttttttttttttttttttttgagacagagtctcgctctgttgcccaggctggagtacagtggcacgatctcagctcactgcaagctccgcctcccaggttcacgccattctcctgcctcagcctctcgagtagctgggactacatgtccagctaattttttgtatttttagtagagacgggggtttcaccgtgttagccaggatggtctcaatctcctgacctcatgatccacccgcctcaacctcccaaagtgctgggattacaggcatgagccactgcgcccggcctcgctttttttttaagttaccagcttattctttatgctccacttatgctactttgcaactgctcacttgcttcttttatttggcatatagtaggtccatattaaattatttttaaaatctatgttgtttggaaaatatttcagtatttcccaaaagttaatcaaccataggtcttctagccttcctctacctttcctttctctagcagttaggtcactaggaagactggcaagagtataggttaagagattcagttctgcttaatgatgtcacatggagatgaccagaattagctcttttagaacatgtttctgtctgcccactcaattcagcactgactggagctgtcttctaacttaattgaatttccagtgatagcataaaagggtgggtttttttttattttagtgagaaaatttttaaagagttaaaatagaaatgagccaggaaggcttcaaacctcctcatgtaacctcatggccatttctgagctagtataaacaaaacattttgtgtgaagtagtgtttacctctaaatttcatcttatttcctggagacatgggtcattatagtgtaactctggatacttgcaagatttgataataataaacatttacattgaagaaggaataaacaatcagcaaacaaagccatcaactccctatcacagagtttgtcatcttacttgcctacatagtatctcatgatttagaacacactattgaatattgaagagattttgctatgttgtgaaatataaacttagccttaaaacaaaaggtacaaagcaagctttctcacatctggaaatatatgatcaatatgaatctttcaaaaacatggctatgaggaatgcaaataaaattttttaattctctgcatgatatcaagagacagtcagacatgttcttatatagttacagaatctccaggtcaggttctaagaagggattttttaaaacaaaacaaaactcctaagaaataagcagtgttgctgcacactgtgccacagtttggtcactgttctcctgctgcttttgtcttggatatgcactttggcaggtaacgccccacctagctctcacatccagttcaactcagcacatggaaaaaacacccctgagggcttgtaaaagcccagccctggaatggacaggtgccagacatggctattactaatccatgacatgtgagaccacacactgggcttttgcatggctatgccctctgcctgaaagctcccaccctccctccgctggccacaatctcccactaaattccttgggaaagctttcctgggattctgactgggctacccctgctttaatatgttctagcatttgaattggcttatgtgatcgtctggttgatgtccatctccttcatgaacttaaactccaggagagcagtattcccagtgccaagcacagtgcctgaaatttagagactctcaaatgttggttaaacaaacaaaaaaaatgtatgcagggagtatcaagagaggactatgtgaaggtttttagagatcaggtcatggaatgtgaaggggccttaaccttgaaccacagtgtaaagtgggagagagaggggtagatttaatttatctaggaactacatagttctctaaaagactttaactctgacttctacataatgagtgaggtcccatagtaaaggggtcattatcccaataacctgtcaagttggttcagaccctcaagtgaaagtctaaagaaaattcagctggagaccaataggagcgaaataactttgtgctccctggggaaagagactaggagactaggtatcattgatctttttgttccccacacttggcatgtattcagccctcaatgtactccacagcactgtgtgtgagaagggtaaagcaacatagatgtctaagttggggcagagacatagtcacacaaggattaaggcagcatgcatccctgaggcatgtttctcccccaacaaggtccctaaataacataataggtagaatcaaatgagtgagttctccttctcctgcagtaacccttgagaaatgatttatgtcacattattttctgacctccagaagagaacatttaatcagtcattttaatataaatgaaattcccaatcaagttatacttcatcaggattcctgtgattcctgccagaattaaatcacatgtcctggtcagtgccagcacccagtgtgggcaaccaggctggcataggaaagtgtctgttgcttgcaggtaagatatatttttaaaggctgctggcagttgcttattagactgagatttctaggtagtggtcatgtagtttacaaataaatattaagttctttgatgtttatttcctagatctttttcatcatcctcattatgacaattgttatcatagcaccactgttaagaacaattcctttgaatttacttaccaagtctctcagcaaatacttttggaggttaattctcagcatgagagagagaaggtaggggaggaaggaggaaagaaccatctttattcattaggaagagcctatcatatctctcagtatctcacagtgttcaaattacttatacctaatttatttattttcttctatataatttttaccttgtcttgtcccaaaaggaatatgaagtaactttaaaaatacataacaatacagaattttgaaaagaggtaactgaaggaattgctgcagagagaacaaaagcaaagtcttcttaatgacagaaataaaattataaatcacttggtgatccataggtttgtaaaatggtataacaaggcagttgtccagaagcacagccgctcttaatgcagagactgcctgggccctcctctagagggcgtggtggagcacagtcccagggactttctcactgcaagtgaacaatggcgacccctccccgcatcgtattagactgtcatctagtgtcagccaatgggaaaatcctcagtactatataagagcaattccacagtgactaggaatgtagttccaatactcagttcaaagcaatctacaaaagcatcatatatgctttaggtagtcaatcttgtgcaatttttctattaatacagcctttgatgaatggtgggaggcagtgagctagaagttacaattaccgcacaagaatctggtactgatggctcagtgggatggcagaggagaagaattgtaggtgattctgccagtgagaagttattaccctaccacaaagctaatgccccagcctactatcacactctgtatttctgactattagcccttttctagtgcaacactttggaatgtagttcttgacttgggccaggcctggggaagaaagaattagttaccttagatcaactttcttccagaaagaccaaggtaaatggggtaattgtggaactcctcaggagattcaagtggcctatagttagaatatgcttgtattatcaacatctgctaaactgcaagtgacctattttacagattctaagacatactttttagcatttactacatgtcaggcactcttctaagtattttatatgtatgactcttttaatcatgaagccacggtgtgtaagtatctttttgtagttcattgataggctgcattgcaaaaaaaggttatcattgatgacctctggatgtgaactacttataaatgcattaaccacaatgccaacttattcatttgatttgattgcccatgttctctatttaaggcatgtcctttcacataactgaggtaccaggaaagctggctgccattcactaccaactaaagcttgaggatgaatgaacatactggctatcatactgtaatgatattttataggatactttacacaattatacagcattctttttatgaagatctggggaaaagtttctttttaatcacaacaaaaagaataactatttctctagctattcataataatactgtttttatcttattatattcatcaagcacataacctatactctttatttcttagcacttcctaccagaaaggtcagaccaaatgtggggcccacatctactaagagcataagacatcaggaaatgcactttgtccactatccctgtttaggtttcaacaggactcaacataatttttctactgtattttccttgttcctattttgcctttctgcttttatcttcttgtattgcacattgatataaaccaccttaaatacattttggaccaaaagagaaatgcacacaaaatgtatttaaaatttttatttccaagagatataaacctgatttcaatggactgttgttggatattcttctttaatctaccttgctttatataatagttctaaaatatagagctattttcaaatgaatatgaatcagtctttcattttgggggagtgagggggaaggaagagaatgtaacaattatggagtataaagatggagaaatgactttgcaaactaacaattgaagtaaatatgaaaccatatttagcatgtgaagatacggttttcacagtagtatttgtgaaaattcactataaggtaagtttcatgagagcagggaccctgtcttcattgtttattactatatccccagcgtgcagaatagagtctggcatacagtagacactgaaataatatattttgaaagtatgaatataatacatttagaattaggaaaccgggttaatagcaaagaaatgatattggatattgattatttaaccacaagcatattccttttggattcggtttcatcatttataaaatgaggctgttcactaagattctttccaactctaatattccaggctcttgttaaatgtagtggcacagttaaacatacgaatgtaaatacatataataatttgggaattttattttcaaaataggatatccagctacatcttcagtgacccttgtagatgtgagtgccttgaggccaaacaccactcctcaacgtgagttcagcaaagttttcctacatgattggaaagagacaacacactcacaagttttactactgcttctataatgttgacgtttcagcaaacagctgtatttttcatttgatgtttgttaatatcttggttttgggttactctgcggtgactatatattgatatgacaatttctataatcttaaaaaataagggctggtgatttattatattgtatcttttatttgtcaagggattttaaggtaatattaaagtagtcttcacaatactctcagtgatctgagtttgtgacaagaacagaaaaagaacacaaatcagtgacaagctggcattaaacataaactacagagcttttgcttaatatgccagctagtgttcctgcatagggaagcacattttcaatttcagatttccccaaagtcacatagattaaaaattctgtgcatcaaagcaaagttaaattacagctttcgaaaaaagctggattctgaaaataattttgtctttcagccagcaattccagtatgactacccgaggcttcaactatccctggacctccagtgggacagataccaaaaaatgttaagtataatcgtgggtcccttgagtcctctggacttcagtcattcatccgacagatatattgaacgacatctatgtgctttgtttgtaataatatttgcaaatgttcacaaagcatctatcatgtttaaagtattgttgtagattctgagactacacccatggacaaaagagatctaagctccaaattctgattaaggggagacagacaagtggtgataagttatatgaaaaaaaggcacaggagggagacagtgggaatcgagagtgaagggttgccattttaaatgggcagtcttgaaaggtcttactgaggaaggtgacatctgagcaatgctataaccagtcaacccgaaagagcaagctgtgaatatatttggggaaagagcaaactagctagaaaatgcgtatcagtaataaaaatgaaaagagagagaccaacgtgagtccagaaattgtttcattcttccttttaatctggccaactagcagtagagtctgtaagtgctgctttagcagatacagacaggatctgaagaagaaatatattgcctcttagtggtattagacaacgatcagtgtggtggggaagtggtaaggaaggaggctggagcaaaaggagagaggacgatggatgccacagggccagaactctgaatttaaatgttagactctttgccacaaagcgtaatgtgtatgtccctttggaaagcatttaagttttacagttaaaacctttaaaaatatttcatatactcttgctccctcattcctgggaacttgtccttaggcaagaaagagagaaaaagaacatgaataggactgctctttgtagcattgtttatttattttatctttttgatggccctcaggctcacagatttgaattaatcataatatttaattcatgagacactttcatcattggtcgatgcatgaccctctgtaatttaacatatttcttttaataaatatgttaatgtaatagacacccatgaacccagtacccaaatataagaattgaaaagacagtattcagaagggggagcatagaaagaaatctaaaaataaatggaacttaagtgtctatcaaagatggtgtggcagattactgtgaaaagaggagactgttcagcaaaaggatctagaaatagtgattattgataagaaaaaaaattaaaatgtacccctgccatgcacattacacaaaaataactctatatagtttaagatctttatgtcaaaagcaaaacattaaaacatggaataaaataaatgtggatttcctcctgctttggagtagggaagggcttaacaaagagacataaccataaaaaatatgtaaaaattagaataaaattaagaaacttgggttcatcaaaagacgtctttaaaaagtaaaacaaaaagcaagctataatctggggaacatatttgccacacatataattgaaaatgaatcaggaatatataattgactaaggatcaaaattttacatcaagagattacaaagaatgcctacaaattaataacaaatatgacaaaataaacaaaagtcacaccacaaaacatgaaacacacgtggctagaaacatctaaagaaatgctcaatctcggccgggtgcagtggctcacgcctgtaatcccagcactttgggaggctgaggcgggtggatcacgaggtcaggagatcaagaccatcctggctaacagtgaagccccatctctactgaaaatacaaaaaattagccaggcgtggtggtgggcacctgtagtcccagctactcgggaggctgaggcaggagaatggtgtgaacccgggaggcggagctcgcagtgagccaagatcgagattgcgccactgcactccagcctgggtgacagagtaagactccgtctcaaaaaaaaaaaaaaaaaaaaaagaaatgctcagtgtctctggtaatcaggaaatataaatgaagactagaattagaaaatcattttatatgtaatcagtttacaaaaattaagaaatctgatattgccaactattgaataggatttatccagcatcctttcaacataatttcttatatgttactggtggtaccatcactttccaccatcctttggcattgtatttcaaagctgaatatgtgcatacctacaatccaacaattctattcctagatataaaaatccctccaaaattagtacatctatgcatgagatatgcacacaaatgtttggaggaaacactgttcatatagcaaaaactttaagtaatctaaatggccatagtcaggaggacagataaataaattgtagtatactaataaaatataatattaaagagcaatgaaaaacaagtgaatggcaaccatatacaacagcatgaatgaatcttaataacattatgttgaattaaaaagtaaataccaaataacaacatatggcatattttctaatgaaattttaaagcaagtataaacaccatatgccttagacgtaatatgtgatataaaattttaagctttataagtgaataataattataaacattcaggacagcatttgcttttgatggagatataagggatgagacagggagaaaacatgtataaatctgtgtacatgagtaggagtgagagggtattaagagggtgaaaaatatgttcagtaataagaaatggcaaataggatgagataactcaatgaaatactatgaagccagccaaaacaatagccataaccctgatccgttcttcttcactgggcaggacctcacagctggggcctccagccaccccaccagctgtattctatggacagaactctgatgtctccttgggacagagtgccttgtgggaggggtgggccatcaccttggttgtttggatgactcagcccttccagcctgtaggcactggaaagtccaaacggaacagagcagaggcagttccacaacacagttccccagcacagctgttttgttaaggaatgaccagactgcttctttaaacagacccagatccattcctcctcactgggagggtcctcccagccagggcctctggccagccccacccatgttctatggccaacagagttctaatttcttcctgggacagagtgcccagtgggtgaggcagacatttgctgtttgggcatctcatccagttcaggctgtgggccttgaagagcccaaatcaattgggtgctgaagagatctccaacatagcacagctgctctaccaaaatgcagccagactgcatctttaagcaggtccctgattccattcctcttgactgggtgagatcttccaactggaatctccaaccacctcctacaggcacggtcaggccagcaacaggtcagtacccccctgggacagagctttcagaggaataggcaggtggccatatttgctgtttcacaaccttcactgatgatacctccaggtactggaaaaaccaatgtgactagggtctggggtagacccgtagcaaaccacagtagccctacagaagagtgcccagactagtcgttcaaagaaaacaaataaaacacaacagcaacaacaaaacaaaaaaaccatccaaaggtcagcaaactcaaagatcaaaggcagataagcccacaaagatgagaaagaattagcacaaaaacactgaaaactttaaaaaaagaaaaagaaaaagaaaaaaaacaacaaccagaatgctccctttcctccaaataatctcaacacctgcccagcaatggttcagatctgggctaaggctgagatcactgaaatgacagaagtagccttcagaatatggataaaaatgaagttcactgagctaaaggagcacattgtaacccaatgcaaagaagctaagaatcatgataaaacaatgcaggagttgacagcctaaatagccagtacagagaggaacataaccaatctgatagagctgaaaaacacactacaaaaacttcacaatgcaatcacaagctttaatagcagaatagaccaagtggaggcaagaatctcagagcttgaagattgtctttctgaaataagacaggccaacaaaaacagaaaacagagtgaaaaaaatgaacaaaacatttgagaaacaggggattatgcaatgagactgaatctatgactgattggggtacctgaaagagacaagaatggaaccaacttggaaaacataccatccaggagaacttcaccaacctagcaatacaagccaacattaatttcaggaaatacagagaaccccagtaagatactccatgagaagatcattcccaagacacataatcgtcagattctccaaggtcaaaatgaaagaaaaaaatggtaagggcaggcagagaaaaaggccaggtcacctacaaaggggaagcccatcagactaacagtggacctctcagcagaaatcccacaatccagaagagattgggagcctacattcaacatacataaaaaagaattttcaacccagaatttcatatctggccaaactaagcttcatacataaggaagaaataatatccttttcagacaagcaaatgctgagagaatgcattaccaccagatctgctttagaagaggtcctgaaggaagcactaaaaatggaaaggaaagaccattacctgccactacaaaaaaacgctgaagtatacaggccattgacattatgaagcaaccatataaacaagtctgaaaaataaccagctagcatcatgattacaggatcaaatccacacacagcaatattaattttaaatgtaaatgggctaaatgccccaattaaaagacacagaatggcaagctggataaagaaccaagacctgtcagtatgctgtcttcaagagacccatctcacatgcaaagacacacagaggctcaaaataaagggatggagggaaatttgccaaacaaatggaaaacaggaaaaagcagaggttgcagtcttagtctctgacaaagcatactttaaaccaacaaagataaaaaaaaaagacaaagaagagcattacataatggtaaatggttcaattcaacaagaagacctaattgtcctaaacatatatgcacacatacaggagcactcagattcataaagaaagttcttagagaccctcaaagagacttagactctcatgcaataatagtgggagactttaacaccccagtgaaaatattagacagatcatcaaggcaaaaatcaacaaagacattcaggacttgaactcagctctggatcaagttgacctgatagatatctacagaactctttacccaaaaacaacagaatatatacattcttctcatcacctcatggcacttcctctaaaatttatcacataatcagaaacaaaacactcctcagtaaatgcaaaagaatggaaatcataacaaagtctctcagaccacagcacaatcaaatgagaactcaagattaagaaattcactcaaaaccatacaactacataaaaattgaacaacctgctcctgaatgactttcaggttaataatgaaattaaggcagaaatcaagaagttctttgaaaccaagaacaacaatacaatgtaccagaatctctgggacacagctaaagcagtgctaagaaggaaatcgatagcactaaatgctcacatcaaaaagctagaaaaatctcaagttaacaactaacatcacaactaaaagaactagagaaccaggagcaaacaaaccccaaagctagcagaagacaagaaataaccaagattggaactgaaatgaaggagatagacacacaaaaaacctttcaataaatcagccaatctaggagctggttttttaaaaaagattaatatgataaatataccactagctagactaataagaagaaaagcgagaagaatcaaacacaatcagaaattataagagggatattaccactgaccccacagaaatacaaacaatcgttagagaaaagtataaacacctctctgcaaataaactaaaaaatctagaagaaatagataagttcctgggcatatacaccctccaaagactgaaccaggaagaaactgaatccctgaatagaccaataacaagttctgaaattgagacagtaattaatagcctactaaccaaaaaaatcccaggattatatggattcacaactggattctaccagaggaacaaagaagaactggtaccattcctactgaaaccattctaaaaaatttaaaagaaggaaatgcttcctaactcattccatgaggccagcatcatcctgataccaaaacctggcagagatacaacaaaaaaagaaaacttcagaccaatatccttgatgaacatcaatgcaaaaatcctcaacaaaatactagcaaaccaaactcagcagcacatcaaaaagcttatccaccatgatcaagttggcttcattcccaggattcaaggctggttctacatacactaattaataaatgtgattcatcacataaacagaactaaagacagaaaccacatgattatctcaaaagatgcagaaaaggccttcagtaaaatttaacatcttaaaaactctcaataaactaaggattgaaagaacatacctcaaaataataagaaccatatatgacaaacccacagccaatatcatgctgaatgggcaaaatctggtagcattccccttgaaaaccggtacagggttgccctctctcagcgtttctattcaacatagtattggaagttctggccagggcagccaggcaagagaaagaaataaagcacatttaaataggaaataaaggaagttgaactatctttgtttgcagatgacatgattctatatctagaaaatcacattttctcagcccaaaacttcttaagctgataagcaacttcagcaaaatctcaggatacaaaatgaatgtgcaaaaattgctagcaatcctatacaccaacaacaggcaagctgacagccaaatcatgaatgaattcccattcacaattaccacaaaaaagaataaaatacctaggagtacagctaacaaaggaagtgaagagcctcttcaagaactacaagccactgctcaaagaaatcagagatgacacaaatgcaaaaacattccatgcacatgggtaggaagaatcagtatcatgaaaatgcccatactgtccaaagcaatttatagattcaatgctatttccattaaactaccattgacattcttcacagaactggaaaaaaaaaaaactattttaaaagagcccaaatagccaaggcaacccaaagcaaaaagaacaaagctggaggcatcatgctacccaacttcaaactatactgcagggctatagtaaccaaaacagcattgtactggtacaagaacacacacatagacgaatagaacagaatagagaacccagaaataagactacacacctacaactatctgatctttgacaaacctgacaaaaacaagcaatgagaaaaggattccctatttaataaattgtgctgggagaaatggctagccatatgcagaaaacttaaactggaccccttccttacaccatatacaaaaatcagttcaagatggattaaagacttaaacccaaaactataaaaaccctagaagaaaagctaggctataccattcaggatataggacgggcaaagatttcatgatgaagatgccaaaagcaattgcaacaaaaacaaaaattgacaaatgggacttaattaaactaagaagcttatgcacagcaaaagaaactatcaacagagtaaacagacaacctacagaatgggataaaatttttgccatctatccatctgaaaaaggtataatagccagcatctataaataccttaaactaatttacaagcaaaaaacaaacaaccccattaaaaagtgggcaaaggacatgaacagacagttctcaaaagaagacatacatgtggccagaaacatgaaaaaaaagctcaacatcactgatcattagagaaatgcaaatcgaaaccgcaatgagataccatctcacaccagtcagaatgtctattactaaatagtcaaaaaacaacagatgctgatgagggtgtggagaaaaaggaatgcttttatactgctggtggaagtgtaaattagttcaacattgtggaagacattgtggcgattcctcaaagacctagatgcagaaatatcattcgacccagcaatcccattactgagtgtatacccaaaggaatataaatcattctattattcaagacacatgcaagggtatgttcattgcagcactattcacaatagcaaagacatggaatcaacctaaatgcccatcaataatagactggataaagaaaatgtaatacatatacaccatgcaatactatacagtcataaaaaggaatgagatcatgtcctttgcagggacatggatggagttggaatctgttattttcagcaaactaatgcaggaataaaaagccaaacaccacatgttctcgaattttctccatgtcagcagtgttatcatttatgtgttcactgaggtggcacttttagttgccttcaataactttttctttgcattcacaacttggctaacaatttggcccaaaaggcctagctttgagcccatctcagcttttgacgtaccttcctcactaagcttaattatttctagcatttgatttaaagtgagaaaagtgcttctcttcctttcctttgaatacttagaggctgttttaggattattaattggcctaatttcaatattgttttgtctcagattaaaaaaaaaaggcccaaggagaggaagagggatgggggaaccaccagcaagtgaagcagttagaacacacacaacatttatcaattaagttctccatcttctacgggtgcagtttgtgatgcctcaaaataatttcaatggtaacatttaagatccctgatcacagattaccatagtagatataacaataatatgaaagtttggaatattgcaagaattaccaaaatgtggcacaaagacatgaattgagcacatgctgttggaaaaaaaatggcacctatagacttgcttgacacagggttgccacaaagctacaatttgtaaaaaaataaaaataaaaaaaacaaatgcagtatctgtgtctgtgatacagatacatggtcaggcacgcctgcaccaatttctgggggcttcatgggtttccccatggttaaggcataagccccatacttccaaagcttgtgaatgtcatctttgtcagcaagagtatgagggccacatttgtggaccaggtggacatggcaaaactgggcacagaagctagcatcagtgtgtgcatcctggcggcagaggtggtgctggcccagtacatattcaccttgaaaaggaagatgagatgaaaaatcaagatcatcaaaattcctgtgtccaggccttgtatctccggatattgtttgccacctatactgttgttcaaggacaaaatcgaaaacagaagaactcagaatgccttaaggagtattgaatagctaagaagttgctcatcaaaagtctgctgtgcatgtaaaaatgatgcaagaattccagaaaagttcagtttgcatcaagaaccctgcaaaaataacaaattatctgtggttttattaaaggaagatgccaaactttagtaataatggactttgatatgacactaagtagattttcctaccaagggaaaagatgcctaatgtgtcataatatgattgacaactataaacttgtcacaggtgaatgtcaaagaggttattgcaactaaaggaaaaatattttattattgaagttgaacctgttaacttcaagagaagtacccatttatggtagaatagtatgctgcccatcaatagtgtctttgttgaacaaactttaccaaaaaatgaaatttaaagaaatcgtggaagaatctgatgttatgctcaaggaaggatataataatttacttgagaagctccaataacacagtattcatgttcatattttcagcagatactggtgctgtagagaagtttatcagtcaagctggtgtttatcatccaaatgtcaaagtagtgtttgtttgtagatttgtgaaaatgtgtactcaaaggatttaaaggagaattacctcatgcagttaacgaacataatgttgccttgaagtacacagaacatttcagtcaattaaaagacaatagcgacagggcacggtggctcacgcctgtaattccagcactttgggaggctgagtcaggtggatcacctgaggtcagaagtttgagaccagcctgaccagagtggagaaaccccgtctctactaaaaatacaaaattagccaggcatggtggcacatacctgtaatcccagcttcttgagaggctgagatgggagaatcacttgaacccgggaggcagaggttgcagtgagtgcgattgcgccattgcactccaacctgggtaacaagagaaaaactctgtctcaaaaaaaaaaaaatagacaatagtaacataattctgctgagactcccaagaagactttaaaagggcatacaaattagccaaattttcacattctgaaaattagatccctaaatgatagagtggataagcattcaggaaagtattgtttcatcaaaagatgaatcactagaagtagccaactccatcttacagacgattctataaacaagcattcttcaggatgttctctcctgcaggagcaagagataccagaattgttcatctcttcatcttgctgaaaggctattttttataatatctttctggtcttgaaagtttacctttatgtatttaagtgttttcagacatgtggaatccatcaacgggaaactccattttcttcacctctctcaccatacttcccactacatgttattaacagattaaaaacaaaacaaaaaacctcaaagtcaaaattagaaaaataactccctacttttccaaagtggcttatgttttttaattttttaattattttgaggggtcttttaaaattgggaaagttagtagaagtccaaaaagaagtttcatgaaattacaaaaagaaaatggcataattttaagtgttgtaatgtttgtaatttgtaattgtgctgatggtatcaccatctcctgaaatcgtgttatgttaggctattttgcttggggaaaatcaatattgaccagaaaagcctggcactgtatacttgctgaaaactattagtgtccacacatcattaaccattacaaaatgttctatattgactcactgataataaacatgaaatggaaaatatttttaaatacccattttccttaaatggattgtgcttattcagccatttagactttagcgtaaattaatttatcccattctttcttgcaaacatactttgatgagatacaaaataaagacatcaaggtcagaaagtaagaaaggagtcaccataccatattgagcaaaaaactacaaggttattcagaacaaacttccttcttcataattttacctaaatctaggcctagtcccaattgtttttcagttagttattgctctttggaaatcaaattccggcgaatggcataatcattaaaaaattcttagtccatcatcatcaatagaccttgatattctgtctagaacaaaaattaatatgcagtatcagagagttatattgaaaataagaacagctccctgaactcagactgaaaaaaagctgtgtatgaaaccactcttacttctcaggtgaccccaaatggaaatagctatgacaaattgtcctgtaatcaagccctaaagaatggactcttacctcttctggagggcctgatcacacacctttgtcagcaactgcagctgctgttgacatctaagaagaaacaaggaaagcggagggctgagggtattgtttgttttattttgattttgctcacttgatttggtcttggcacacaagaaagcttttaactatgaacatcatttatgctaatattttaaatgaatggatgtaatatatttgtactgattacaaccgtgtattactatagttattttactttacattgcactgcaggccttttatcaaatacagatatgtggtgtctgccaaggagtgactctttcttgccagagatggggcaataaacaaaatgagttgttagatctatttcaaaagccatatgtgctgtctgagtttgctgccatccactcaaggggaaggtttgtctctaaatgcttcaaaaggactcactcagcagctgacaaggcctgtgaccccaggggtctgataattcactgctgacatgttttgttttcacagttcagcaagactgtcagctgacccacaagtacaaagtgttttcgtcccctatgcatgttctagcaaggtcttcaaagtcctattggcagcttttcttgactaaacgccgccataacacacctggaccttcattctcttccattttttttttggctcatctatggaatgagcatgacacactctggctagaggaaccccttctagtgttttctttccatatcttttcctgcttctaagtggccataattaaaaccttccccattatagacatctgaaccacaagaatcccttcaactcccactttgtttgaggacattcttgtgtatgctatggaacagtttaatgattttgctttatgtactcattaatatccttttttataattattagattaaattagcagtcaagaagtggtaatatagtctcatataggttaactcttctgatatcttcttcctttagcagtttcacggatacctagtgaaacatacagttcatccccgtcaggtgcaggctcaacacttcatggtgagtacttggggaagatttagggacactgaagctagtggtcagctttatttggacacaggtgtaaaaacaagaactgataagaagccagcctcagatagatatataaaagtacatcttgatgatgaaaattacaatgaatggaaacaaaattcttctcagccattcaaagaagatagagaccaagccttagatttttatacattttatttccaaaaaaatctacacaatagcattttttactagttatatctatgaaaaataaatttcaatttttttattggaaaatagaataattagtcaacatggatttgtttagtctaatgttgcaaatgaatttttattaaccttatcaaacacatcggtgtggagagaaattagtattttgatcagctgaacctctcataccaagagaacaggaacagagcctcacttatccacgacccccaactctggcctttttctgtaccacttacatttctcatggagattctttagcagacatcattttgttgtttggaagtatggagcttcttttttttttttttcaaccaataggaaattttcctattttcaaccaacaggaatttttttttcaaccactaggaaattttattcctttggcaattgttagacaaatctcaggatcccagccttgctataaattggttcttaataaactttacacataatatttaagggatacttagacaatttaaattgagttctttcaaataacatatgaaacccaatcatggttttataccacttgatcaagttgagatgtcttgtccagatatcccctttatatccctagacaatgtctttaccagcacagccagagcattttcagaagtccccacaactgccaatggatctacgaaaactaatcacgtccatatcactggtaagtcatttatcctattttgggggattttatgctttattcactcaataaatatttatcaagtacctgccatttgccaggcattatgccagttgttggatatacagtgaacacactggctttttgaagattataatctattagtgatcgatcatgtgtatagtaaataaataatcacaactaaatttattttgacaagtactatgataaggtgttgtcagggtcaaacaggaagttctgattttaattggaggataggagaggactctgtgaggatatacttaaattaatatctgagaaaaataaataagaatttattcttgttgaataaattgaaaagtagcaaaaagcatttcaagcctatgaaaacatagtctgagaaagaaatcattggaacaaagagtactcctataattcaactaatataatattgtcatgcaaaatgtaatccctcttttatatcataagagagcaaaagattcaataaagttaggaccctcctaatgaaggtcatgattgtaagttcacaggcataatcaacttcaggggtgttcacttgactagtgaatgccacacctaggtactcagctcattttgtgtcaaaggtcatacagtcttctgatcattggagcatcatcttgcacacgtcgtggcaataaagctgcaaactgaggcactacaaagattttaatatattggtgccttaaagagctgtctagtttagagatgggtcaaaaatggagttctgtttttccacttccattgtgaaggcagtggtctcattttctacacttggttggaaaaaaaaatataggcattgatgtaagacctctttaaaatattttgtttggcaagaatgagggatcatggcagacaggaagcaggactagattgcaactctgcagcatgcagagtcttcattgtgaattttagctccagatcaactgcaagaacaaaccagcaatcctgagaaaacccacagaccctctgaaggaagcagacagcctctgtagcacccaggagacaccccaaatactctgggaggtggatagcctcacaaattttcaagcccatctcgccctccacctggagacagactcggggctgttggcggggtggggggcatggtgggagtgagaatggcctgtcagtttgtgtaggagttcggtgaggcctgtgactgccggctttcccccctctttcctgacaacctgcatgattcagcaaaggcagtcataattctcctaggtgcacaactccagtgacctgggaatctcacccccatccccaacagcagtggcagcaagacctgcccaagaagaatctgagctcagacatgcctagccctgccccgacctgatggtccttccctatccaacctggtagtgaaagacaaagggcatataatcttgggagttctaaggccccgcccaccaccagtccctctccagactactatagctgatgctttctggagagctctacctcctggcaggaggccaaccagcacaaaaacaaagcattaaaccaccaaaggtaaggaccctcacagagtccattgcaccctctgccacctccaccaaaacaggcactggtatccatggctgagagacccatagatggttcatatcacaggactctatgcagacaacctccagtaccagcctccagccaggcagactcactgggtggctagacccagaggagagacaacaatcactgccgttcggctcacaggaagccacatccataggaaaagggggagcgtctacatcaagggaacacccagtgggacaaaataatctcaacaacagccttcagccctagaccttccctctgacagaggctgcccaaatgagaaggaaccagaaaaccaaccctggtaatatgacaaaacaaggctcttcaacaccccccaaaacaatcatcctagttcaccagcaatggatccaaaccaagaagaaatccctgatttacctgagaaagaattcaggagattagttatttaagctaatcagagagggaccagagaaaggcgaagcccaatccaaagaaatccaaaaaaaatgacacaagaagtgaagggagaaatattcatggaaatagatagcttaaagaaaaaaaacaatcaaaagttcaggaaactttagacacacttttagaaatgtgaaatgctctcaaaagtctcagtgatagaattgaacaaatagaagaaagaaattcagagctcaaaagcaagatcttcaaattaactctgtccaacaaagacaaagaaaaaagaataagaaaatatgaacaaagcacccaaaagtctgggattatgttaaacaaccaaacttatgaataattggtgtaccagaggaagaaaagaattctaaaagcctggaaaacatatttgggggataatcaaggaaaacttccccagcctcgtgacagccctagatgtgcaaatacaagaagcacaaagaacacctgggaaattcattgcaaaaagatctttgccgaggcacattgtcattaggttatccaaagttaagacaaaggacagaatcttaagagctgtgagacagaagcaccaggtaacctatagaggaaaatctatcagattaacaacagatttctcagcagaaatcctacaagctagaagagactggggacctatcttgaacctcctcaaacaaaagaatttttagccaagaattttgtgtccaatgaagctaagcatcatatatgaaggaaagatacagttgttttcacacaaacaaatcctgggagaattttaccaaaccaccactacaggaactgctaaaaggagctctaaatcttgaaacaaatcctggaaacacatcaaaatgaacctgtttatgcataaatcacacaggacctatgaaacaaaaatacaagttaaaaagcaaaaacaaaaatccaaagtacacagataacaaagagcaagatgaaagcaatggtacctcatatttcaatactaatactgaatgtaaatggcctaaatgttccacttaatagatacagaacagcagaatggataagaacttacccatcaactatttgctgccttcgggagactcacctaacacataaggactcatataaacttaaagtaaaggggtggaaaaaggcatttcatgccaatggacaccaaaagcgagcaggggtagctattctcatatcagacaaaacaaactttaaagcaacagtggttaaaaaagacaaagaggacagtatataatggtaaaaggccttgtctaacaggaaaatatcacaattctaaacatacatccacctaatattggagctcccaaatttataaaacaattactaatagacctaagaaatgagatagacagcaacaaaataatagtgggggacttcaatactccactgacaacactagacaggtcatcaaaaccaaaaatcaacaaagaaacaatggatttaaactataccttgaaacaaatggacttaacagatatatacagaacatttcatccaacaactgccgaatacacactctattcaacagtgcatggaactttctccaagatagaccatatgataggccataaaatgagcttcaataaatttaagaaaactgaaattatatcaagcactctctcagaccacagtgaaataaaactggaaatcaactccagaaggaaccttcaaaaccacgcaaatacacgaaaattaaataacctgctcctgaatgagcattgggtcaaaaatgaaatcaagatggaaatttaaaaattcttcgaactgaatgacagtaatgacacaacctatcgaacctctgggatacagcaaaggtggtgctaagaggaaagttcacagccctaaacacctacaacaaaaatctgaaagagtgcaaacagacaatctaaggtcacacctcaaggaactagagaaacaagaacaaactgaaccgaaatccatcagtagaaaggaaatagccaagatcagagcacaatacaattgaaacaacaacaacaaaaatgcaaaagataaatgaaacaaaaactagttctttgaaaaggtaaataaaattgaaagaccattagtgagattaaccaagaaaagaagagagaaaatccaaataacctaattaagaaatgaaatgggagatattacaactgacaccacagaaatacagaagatcattcaaggctattgtgaacccctttatgcacataaactagaaaacctagaagagatggataaatttctggaaaaatacaacccacccagcttaaatcaggaaaaattagataccctaaacagaccaataagaagcagcgagattgaaatggcaatttaaaaattaccaacaagggctgagcgcagtggctcagtggctcatgcctgtaatcccagcactttgggaggctgaagccagtggatcatgaggtcaagagttcacgacccgcctggccaagacagtgaaaacccgtctctactaaaaatacaaaaatcagccaggtatggtggcaggcgcctataatcccagctacttgggaggctgaggtgggagatttgcttgagtctgggtggcagaggttgcagtgagcagagattgtgccattgcactccagcctgggtgacaaactgagactccgcctaaaaaaaaaataaataaataaaagaaaaattaccgacaaaacaaagtccaggcccagatggattaacagcagaattctaccagacattcaaaaaagaattggtaccaatcctattgacactatccacaagatagagaaagaaggaatcctccctaattcattctgtgaagccagcatcaccctaacaccaaaaccaggaaaggacataaccaaaaaagaaaactacagacctatatccttgctgaacatagatgccaaaatccttaaaaaaaaaaaaaaaaaaaactagctaaccaaattcaacaacatatcaaaaggataatccaccttgatcaagtgagtttcataccagggatgcagggatggtttaacatacacaagccgataaatgtgatacaccacataaacagaattaaaaacaaaaatcacatgatcatctcaattgatacaaaaaaaaattcaacaaaatccaacatccctttatgattaaaactcagcaaaattggcacacaagggacataccttaatgtaataaaaaccatctatgacaaacccacagccaacacaatactgaatggggaaaagatgaaagcattccctcttagaactagggcaaaacaagaatgcccactctcaccactcctcttcaatgtagtactggaagtcctagccaaagcaatcagacaagagaaagaaataaagggcatctaaatcagtaaagaggaagtcaaactgtcactgtttgctgatgatgactgtttaccttgaaaaccctaaggactcctctagaaagctcctagaactgataaaagaattcagcaaagtttccgaatacaagattaatgtacacaaatcagtagctcatctatacaccaacagcaaccaagcagagaatcaaatcaagaactcaaccccttttacaatagctgcaaaaaaaaaaaaaaaaatgaaatacttaggaatatcctaacaaaggagtctaaattcctctaaaagaaaaactacaaaacactgctgagataaatcatagatgacacaaacaaatggaaacacatcccatgctcatggatgggtataatcaatattgtgaaaattaccatactgccaaaagcaatttagaaattcaatgcaatacccatcagaataccaccatcattctttgcagaattagaaaaaacaatcctaaaattcatatggaaccaaaaaagagcccacataaccaaagcaagactaagcaaaaagaacaaatctggaggcatcacatacctgatttccaactatactataaagccatagtcatcaaaacagcatgctactggtataaaatacgcacatagaccaatggaacagaataagcccaaatacttacagccaactgatcttcaacaaagcaaacaaaaacataaagtggggaaaggacacccttttcaataaatggtgctgggataattgtctagccacatgtaggagaattaaactggatcctcatcttatacaaaaatcaactcaagatggattaaggatttaaacctaagacctgaaactaaaaattctaaaagataacattggaaaaattcttctagacatgagctcaggcaaggatttcatgaccaagaacccaaaaagaaatgcaataaaaacaaagataaatagcaagcacccaaaagcaaatgcaataaaaacaaagataaaaagcaaatgcaataaaaacaaagataattaaactaaagagcttttccacagcaaaaggaacagtcagcagagtaaacagatgacccagagagtgagagaaaaccttcacaatctatacttctgacaaagaactactatccagaatctacaactaactcaaacaaattagtaagaaaaaaacaaacaaccctatcaaaaagtgggctaaggacatgaatagacaattctcaaaagaagatatacaaatggctaacaaacatatgaaaaaatgctcaacatcactaataatcagggaaatgcaaatcaaaatgacaatgcgataccaccttagtcctgtaagaatggccataatcaaaaaaaatggtagatgttggcatggatgtggtgaacagagaacgcttctaccctgctagtgggaatgtaaactagtacagccactatagaaaacagtgtgaagattccttaaagaactaaaagtagagccatcatttgatccagcaatcccactactggatatctgcccagaggaaaagaagtcattattcgaaaaagatacttgcacatgtatgtttatagcagcacaattcacaattacaaaatcgtggaaccaacccaaatgcccatcaatcaatgagtggataaagaaaccgtggtgtatatatatatatatgcactatggaatactacatagccataaaaaggaatgaattaacacatttgcagtgacctggatgagattggagactattattctaagtgacgtaactcaggaatgaaaaaccaaacatcatatgttctcactgatatgtgggaagctaagctatgaggacgcaaagacataagaatgacacaatggactttggggacttggagggaagaatgagagggggcgaggggtaaaagactacaaatatgatgcactgtatactgcttgggtgttggctgcaccataatctcacaaatcaccactaaagaacttactcatataatcaaacactacctgtaccccaataacttatggaaaaaaaaaataaaataaaaccttttgttctttcctttatctaaaactttggacgtaaaatattatatcccaccatattaccatggtagagcttagtaaattttgacttgtgtgaaacagaactttgtctagtcctgagttgaccaattgtctctttcatgatcatgctactctagtggtttgaactatgtaaactttctagtcatctgtatatacaatgtgtcacataattatgtattattggactacatgggtctccagggaaccctcagtttctactttgacaggggtgagaatcaggaagacctcgaatccctggatgtatgttgtatgaaagggaactgtcttcaacacttctaaccaatgctaacatgataacatcacatggtttcagtccaggctatgtaaaaacacagaaaagatgtgataactaatattacatctagttctttgacctgtattttttgagattttgctatatgaaaagcagtgtaataaaaacggggcaatgaaataaatttaaatccttgtcttcactcacaagcagttactacctagccgagacaaggaaagaaaaccaatccagatagctttttgcccaaatgatccatgtaatcgaaatacctaaagacctatctatcatgtataagaaatttcactggagtatcattagcaataacaaagtctggaaacaatttaaccatctaacatcgtgagataaattaaataaactggtatatccattgaactatccagtcatctaatagaatgaggtaaatctctgtgtggtgatatggaaagtattccaagaatgttttttaagaaaaagaggccaggtgtatgtcttttggcctcttattcttaaaaaaacatgtaaaatgtaaaatgttaaaaatgtaaaatgatttttaccttcttaggatactttaaaagctcaaaatcactaatcactagagaaatgcaaattaaaaccacgataagataccatctcacataagttagaatggctattactgaaaagtaaaaaaaaaaaaagaagaagaaactgatgcaggtgaggatgtggagaaaagggaatgcttatacactgccggtgggaatgtaaattagttcagccattgtggaaagcagtttggctattgctcaaagaacttaaaaaaaaaattactatttgatccagcaatctcattatattggatatatacccaaaggaatataaattgttctaccataaagacacatggacacgtatgtttatcacagcactattcacaaaagcaaagacatggaactaacctaaacacccatccacagtgactggataaagaaaacgtggtacatatacaccatggaatactatgaaaccataaaaaggaatgagataatattctttgcagcagcatggatggaactggagaccattatcctaagcaaactcacacaggaatagaaaaccatctacagcatgttctcactattaagtgggaactaaacatcgagtacatatggacacaaagacaagaacaacaaacactgaggcctactgaaggttgagaggagggtaaagattaaaaaaaaaaaaaaaaaaaaaccctacctgtcaggcactgttgattacctgggtgacaaaataatctgtacaccaaaatccccacagcacataatttacctatataacaaatttgcacatgtacccctgaacctaaaatagtgaaaaaaaagaaaaagaaatcatggacagaatagtgtgtataatatgcccccaactgtaataaaaagggtatatattcatggtacatatgtatgcttatatatatccacagaaaatttctggtagggtacgtaattaactcttaaaagttatcacctcatgtaggtaacaaggcttagacatgcccacctccagagtatgatcacagccaatgttgaagaaaatatgtttcacgtaggaaaaatggtttaatcctgttttccaaatgccaaagtttgggattaaagttcatctttctttatgcccttttcaggtattgtggtcaataagcccaaagatggaatgtcctggccagtgattgtagcagctttactcttttgctgcatgatattgtttggtcttggagtgagaaaatggtgtcagtaccaaaaagaaatgtgagtataatactaacatatgtaggaacagattaatttttcattataaaatattcatcagtacaatatattattactctatgaagttcctcccatattttaatggggaaataatgctcacagaagctcagagagattatatagctttcccagcattacatagttgggattaaatacacaactcctgactcagtatccctctctgcattggcctagtcaggctgtaacattcgtcagatagagcaagtccgtggacatgaaatgagaactgagcctcacctctcctcaaaactaaaactgatttttcttttaatcttcattattttttcattttcatgcatctttgaactgcctaggctccactggtcatagatgctcaagtgtgaaattgagtgagaaaggtaattttaagagatttccagctgctttttttaccagagtgggcttttactgcccttttctttttttcccaagcagaaaagaaagtaagcattgggttaccccatttttgtcttattgaaatattttccaaaagccttctccaatcggcagtctgaaatggtacataaggttaagcctcatttttctgacttgctattttgagtcagtctgggttgggccataactggaagggaccccagtacccagaactgatcttccacttgtcttactactactctaagataacattaaccattgtgccatatactttcctaccttttgcagagtatccttgaagactctgtaaccacatacagggagtggtgaacaaaacactaaaccagtagttagaaattctggattattttccaaggactacaatttggccaccacatgaccttgagaaactcataattccccaaaaaacaaaagtaaaacaaaagtgcatgtttcgtagaattacctattaatacatatgaagtctccattaaagcatctaaaaattgggtaatagggattagagagctttatattaaatgaacaaatgaaatctgaaaatctgaactgattttttaaattgttctgtattcaaatgtttgttttatatggagatgagaatcaatctctctatcctccttcccccactacccactctttatctctcctaagatgctatggattgccagggcatagaggtgtttgagtgatgaacataaagatgttcacagatatatttctgttgcctgatatcaagatagctagagcatttgtatagctaaattccatactaacttggctctttaatgcatttcggaaaaagagattacttgtactaacataaaatagttctttgtacaaagatgactttaagaatgttcactgattcaaacaaaagggatttaggcattatctagccagtactcggggattgagaagagctttacttcccatctctaccctatccccgcagtacatagtgagtgtttgggcaaaggctggggctagggttagcaaagaggctgtatgaaaagcttcagtcttaaatcctaggattttaagatttagtctctggaggaatattttaatccacataaaagaaacatttcttctattaggaggcagttgtcatggagagtatcagttctggtgaaaagacttgaattgttggtctggttctcttgagcaagttgtttaaaacctctgagcctcagttttatctgtagaatggtgatgcatttcctgcacacaaagtaaataatgttatgatacatttcctgcacacaaagtaaataatgttatgataaaaatgctcagttttatctgtagatggtgaggcaatttctacatacaaagtaaataatgttatgataaaaattctttgcaaactacaaaataccgtatagatcatgaggttcaaatgtgactaacaggcacagggttatgccagcaaaaatgctgaaagaactgggagagtatgtctctttctcatcaatctgtgttctcctttaaagaaacaacacatgtctgtgtgtgtgtgtgcataagactccctcaattcttagcattgaaagaccaatattttgttcctagaatggaaagacctccacctttcaagccaccaccacctcccatcaagtacacttgcattcaagagcccaacgaaagtgatctgccttatcatgagatggagaccctctagtctcgtgagactttgccccatggcagaactctgctggaatcctattgagaaggtagacattgtgctttattaatatagtcgctcttcagccatgcctttgctgcagctgaaatggaagtcagaagtgagtgacctgttttcccagcaactcaccctcttccatctccaaacgcctgaagcttaaccaagagtgagaggatatgtcatgttcacactcaatgcaattcgtagtggttttcttgcttatgtaagaagtacatattagtctgccatctttaaaaaaaaatacagtattttcatttaaattctctgatggagggacaacaatggtttcaactgtatgcccatgcctgatcctcttatttgaacatctatcaacattgtaaactctttgccaaaatcctggggctttgctgcattccctaagataattacaggaaaaagaaaatgtaaaagtgctaacaaggctgccaagtaatggagaagtatggttagtcttcatattgaaattctgttgcttattttcatggaaggaaacagaatactttgcacaggaaccacattttcaatcctccttcactgtcttcctaccatgttcagcccagactcctgccacatggaccaggatgaagagggatcaaagagataattagccaaaaacccagtagcctagaagatacaaaactccactggcctctaaaattatattagccaagagtggtttcatttgagtgccttcgtgtgtatgtccatcaaactggaaccaaactgttttgtaagtaaacaggcagcctaagcccaaccctactttctaattccagttattctctttttcatctggggatttacctgttcatttaatctgcctgttttgatctgttttgaaaaagataaagagcctcaaatcagaccagcactgattaattaaccctgctcctaccaatcttttttaaagcagttgaagcagaatgtataggtgtcagagaagaaacctagtcagccagacgtgctctgtattcagcaatagtttgtgaatgaataaattactaatcctccttgtcgcttgaaaccttcccacactccctgctccaggagggaaaaacagatgttgttgacagatagagtgataggcaaattctgtgtggactttagtcccaaaaggaaactttagttcacttgcagtatgcttatccttgactgcacatgagaatgccttgtgcagagttatttggagattatgtctttttcttaaacaccatggctgtcacacttcagttcaattaaatcagaatgtctgaggagtgagacacaggcatcaacactctcaaatgattcacatgttcagccaaagttgagaaccatcgagcctgtggaagttctttctcatggctcagaatcttaggtaggtgcttaactcttgtggtggccagcctccaagatgagccccagtgttcttgcctcctactattcacatctttatgtggtcccctccaatgctgaatacagatgatttgtgtaacctgaggccaggattaaggggaggcaatcaatgcacctagggaaaaaatttaaggaggtattcacactcagggtcatgcacttgcacaatgttgagaatgagtaccactctcaccattggtatagccaaaaaagcttggaagtgaccaaggctaggtcacaaaatacactgtggcttcttctttgatctctctttgaccatactgacactgggaaaagcccattcccatgccatgaagacaccaaggcagccctattgagaaatctacctgtcgtggccgggcgcagtggctcacgcctgtaatcccagcactttgggaggccgaggtgggtggatcacgaggtcaggagatcgagaccatcctggctaacacagtgaaaccccgtctctactaaaaatacaaaaaattagccgggtgtggtgtcgggcacctgtagtcccagctactcaggaggctgaggcaggagaagggtgggaacccgggaggcagagcttgcagtgagccgagattgtgccactgcacactccaatctgggtgaaagaccgagactccgcctcaaaaaaaaaaaaaaaagaaagaaagaaagaaagaaagaaatctacctgtcaaggaactaaggtattttgctaacaagcaccaacttgccagccatgtaagggagccatcttggaagcagatcctccagcctccagtcaagtcttcagataattgcaacttcagttgatcttttgaccaagacctcaagagagccagaactacccagctaagccttttactaaatttctgaacttctaacactattagataataagtgcttattgtttaacaccattaattttgagtataatttgttacatagcgacagataactatacagctcaacaactagaaaaataaactgtttacctgccttaattatttatctttagttccttattagttctcaagaaacaaatgctagcttcatatgtatggctgttgctttgcttcatgtgtatggctatttgtatttaacaagacttaatcatcagta

SEQ ID NO: 82 - DNA, 34213 bp, Homo sapiens
gatacacatgaggtcacagatctactgcctctccccctttaaaagaaactactcagctccatttgtctcagaatctagaggaagttgacaaaggtgccacagcagcacagcacagtatgtggtggagagttctcagcttgctggcatggttccccttgcaaggtaaggacttagagttatttttgttgttgctcagctgacttaatgttttgccacatctacctatcagtcagtcaactgcatttacagaggagctgctgtagaagacaacccaggtaactgctaatactttccaagccatgctcaaatcatgcatctgagggatgttactgcgtttatttgatctctcgttcaatggctaaggagtatagaaaggatcattatagtgtgtgtctctgtgggtcctatgttacggcaagatgaaacaagcttattaggctctgtcttttaagggcataccagttgaaagagcatccgtattgaattttattttattttatttatttatttatttatgagacacagtctcgctctgtcgcccaggctggagtgcagcggcacgacctcggctcactgcaagctccgcctcccgggttcacgcctttctcctgcctcagcctcccaagtagctgggactacaggtgcccgccaccaccacgcccggctaatttttttatatttttagtagagacggggtttcaccgtgttagccaggatggtctcaatctcctgacctcgtgatctgcccacctcagcctcccaaagtgctgggattacaggcgtaagccaccgcgcccggcctccacgttgaattttaaaatttccttgctgtataaatcttagccaaacgatttaatctctttgaaactcagtttctgcatcttaaaatgaaaatgataaaaacttttgatccaccaaactccctggattgttagaaggatcaaatttcaaatgtgaaagcactttgaaaatgataaagcgctgtgcaacacttatttagctcagaggtaataatgagaccaatgaaaacttcgtgtttatttttaaagagtaagttatactttacattttactataattttcaaatttggattttagtgcttaatcctaatgtagcattatgaaaattaaggatagaagcagttacctttttggagcaggtcaaattattttctacccaaaagtgggggcaggggtgtaggaagtggctcctgttgtccctcagtctctgcttacaattgtatcagattcatgcaaaggacatccctcacaaatccactcaaaaattttgctttttgtgtgtttgttaccaaatattgaaactgtagttctgtttcatgaaatgcacctatccttctaaatctacatttaatctggaatggcatctgaaggacgctactttaaaaaactcgatttcctattttacatagtacttcaattccctattttatatacttcaattaatgccttctttttttggtccctgtaccctgaggcacttaataaggattcaattttggtaatgaataatattagtttcttcattaagtggcttaaagaatagctaatacattcaaaaagagtacatttagacagctaaaattaggatgatttcaatttttccagagtttaaagcctttcactgaccttaactttttcaggctttgagttattgcctcataaaaaataactcataaaaatacattttttaaataaatagcaaaaattatgtttcaaggtaaacctaaattacttaaatattatttatatagagaggaaaaatattgtttcatgcacagtgctgagtactttgtgttaattacacttaatcatagcggaagtactgaggtaggtactaatatccccaatttaaagatgagaaaagaagttatgtaacctgcccaagttttaaagctagaatatgacaacataaataccagcctataaagcacatagtaaaagtatttatttcatgaaacttctaattaacgtgtgtgtgtgtgtgtgtgtactagttgtgacagaaaatgtattaatgtggatcaaaagttggaaaaccactgactttcacaatttggaggattcaatattaaaaagtcctatttgaaaactcgttcaaggggccacccgagggcatctaagctcaatggcatttgagcagtggctgccacccctgacctaaccttgctcaagcccatcccagacgtaattaggaggaggtgaccatgttgctttcttgtcagcaaaaaaggcagcaaatcatcagttttggcaaagctataaactgtcagctgattttagcaaattaaattatgggaagatcactgtgactacttctacagtgttacttctatggctgccaaaaatttatggaaaaaaaaaaagtcacgtaatctcagagcctgccctcttttcaaggccactcccagaataaatagtcttaggactggtaaaaacacaataaaaatgaagcatttttcaaaattcatcccattaaattacactgtagacaatgaaaatgtcaaatccaatgaattttgaaccctctgttttcattgttttgtggagggtaggatgcagaaaacaaaggaaaattgcaaattgagtagttcttttcatactttctttgcccaggaaaaagtcacatgttagatgacatgttgagacagcttctttaaaatgtactaaaaatattccgattctgacaagtctgatttatttttatacctgcaattttctctattgattcaatctaaaaataataaaaatctttttttgtaatgatctgaattaaaacacacttttgcttaatgcctcatgacagtcatgtaactagggctctgatttgagaattaatgcattgcatgtctctggctttaacttagccctagtctttattatttgatataacagttaaagagcaaagttagcatcctattataatatttattcctaaatatatacttttactctattttttttttttttgagacagagtcttgctccgtcgcccaggctggagtgcagtggtgtgatctcagctcactgcaagctccacctcccgggttgacgccattctcctgcctcagcctcccgagtagctgggactacaggcacccgccaccactcctggctaattttttgtatttttagtagagacaggctttcaccatgttagccaggatagtctcgatctcctgatctcatgatccgcctgcctcagccttccaaagtgctgggattacaggtgtgagccaccgagcccggcctatttactcatttttatccactaattcaaccaatatctaaaattttacattatgctaaaatgagtggatggcaaacagcttttccataaggagtttgtaatctatctacagagaaacacctgtaaccaaataattataaagtaatgtgctaagtgctgtaatagaagtatatctcaagactttgggaaactaggggaaagacattatggggaaaagggaagctaaggcctgttttggaagttttgacaaaagttgtgtaatttgagttgagcctataagttgagtcttgagttgggtcttaatgttgagtcttgaaggagatgagaaagacattccaggacaagagaatatcatagaaaaagacaaactatcttctggagcctggaactttctggaaacagcaagtggacatgtacaaggactatctgaaaaggagtatcacgacatggcaaaggaggagaacacaggagtcaagtcggctggaatttgggcctgattcctataggcaatggaagccatagcaaacacttgaatgaaggaagagacataatcaaattcatgggttatatgtttgtttgtttgtttgtttgtttgttgagatggaatttcattcttgttgccctggctggagtgcaatggcacaatctcactcaccacaacctccacctcccaggttcaagtgattctcctgcctcagcctccagagtagctgggattacaggtgcctgccaccatccctggctaattttttgtatttttagtagacatggggtttcactatgtcggccaggctggtctcgaactcctgacctcaggagatccacccgcctcggcctcccaaagtgctgggattacaggcgttgagccaccacgcccggcctcaaattcatggttttaaaatgtaatcctagaaccagatgatgatgatgaattagagagaagagagactagaactaagttattacagtggtccaggaaagaaatgatggagtccttaactaaggcagcaataatagtgacaaaagaggactaaattgattaaaggatgttttggagaaagaagagtttagagcacctctcaaatatctggtgtgcagtggttggtgatgacattaatttatataagggaactctagaatggggcaggtggcatatctgtgttagacatgggtggagcatggggacagtagagataacgagttccaatgggacatgtagagtttggggtctttgcaggacaggcttgctctgctctggttttaaatttattgcatgtaaaaactaggctattaaggcaagaaaaggaaagaatattttattcttttctcagtctacatgatagtctatagtagaggtaaagattgcacatgagaacttccaaaatcttgggaaagaccaaaaaatcttacgaactgcactggttttgtctatgtgtactttggtagatggctgttactgctgcttgtccttttgtttgggagtagatcacatgtgctttggtgtaaagccatccactgataggacaattagttcatgggatttgggatggtgatgacggtgaaggtcacaggttccatttccatatataaagcagtcacaatctatagccccaggatcagctagcaatctcataacatatggtcatgcatggatggatgaattcagtcacggagataatgacaaagcccagaagtcaataatccattctgtaaacatcacctaccgtaggaagtggtgacctcacaggcgaaacaccacagtcattcattgtcaaggtctgtatgttcagcatgtggggagccgtgcagggctaatttgcagataagaactctgaagctcagataggactaggaagtaggtgtatggcactcggggtctaataagaaagcttaaaggtaaatggggatgtacatgtctctagagcctacagaggaggaagtggtaagcaaagaagatatctcacaccccatccctctgacaacaaaggtgaaagtctgactccaaacttaggtgaaagaaaagtcaaaagaagttctaatttggtttccagtggcaatgagaagaccctggggaacttgtccttggaaaatgtgccaccaaaacttaggcacagcatcctgctcttccacctttaacaaaactacagacattgaaacatatttttaagcactacagtctaagcaaagctgggtgggtctgtggcttctcactggggctattcttcccttctacagtgatttcctgtttctaaatcgaacatggggtctacatgataacactgcaagataagcagacccgtaaagccaaaagcaaggcttgttgcaaagagtaaaggaaacaacgaatattctatgcctcaaacacagccctttccatatgaaactcaggcctctacagtgtggtcaatctggttagccgcctgataccgaattctcagcaagtgcaaacattaatcttaagacatacagtactttagtgtataataaaaagccaaactatatttcatcacaatttttaaaatgttgtaagggttaaattatactatttaattcataagcatgcatcctaagaaagagaaaaatgatacatacaaccttaaaatgggagacatttattcctaaacaagctgcagataaatctcaccactcccatcttacccaatgcaggctttctgtttagaccatcattttaccaaaggtaagaacgttggcaaaacttctgtcaatgtctagtcctcaaggatgaaattagggcatgtttcttaatactactctttattctatcattgattccatgtgtaactttcttccagtagcttccttcctgtttctcagtatttttattaacaacaggagaacaaaggtatctgtcaatcacctacattatagtgccatcgtgaatactagcattaagccagtacttttcaagctcacattgtaatagtttctgtaaggaatgaattttagagaaatataaaacatagccgttgtcctctagaaacttcagtctgtttataggcatcaagacagtacacaagaactagtgagtaaaacagtaagcatcacaatgctatggaagttagacagttctggattcaaatcttggctcaaaagctgcttaacctctgagctttgatgccctcatctgtgaaatgggaataacaacaccttctttacagagttattggttttgggcctgaataactaggctatttgctgttggtgaaatctaaaataacacatttgggggaagagaatcaagagtttgtgttgtacttgttaggctttcagacttctaactgatcatcagaaaggtgatgaggccagatgagatgacctatggagtgagtatagagagtctatccaggatctgacctccgttgtgtgaagggcagattgatgagaagaacccggaaatagagctgaggagcagcagctgccagtgagttaggaagggagtcaaaaagagactgacatctagggaaccaggtaaagacactgatttaaggggcagagagtgatcatatatggcgaaggaacaccataggttgaataagatatggtctgagaatggagcattggtttgagcaatgtgaaggtctttggcaaccttggcaaagagagatttcaacgaggtagtggagttgaaaacctggtcagaaaacaaagagtgggataaacaaatatagatagttctttagaaaaatgtgtcagtgaaagagagggaaggcagggcacggtggctcatgcctgtaatcccagcactttgggaggcagaggtgggtggatcactttaggtcaggagttcaagaccaggacaacatggtaaaactccgtctctgtactaaaaatacaaaaattagtcagatgtgctggtgggtgcctgtaatctcaggtactcgggaggctgaggtaggagaattgcttgcaactgggaggtggaggttgcagtgagctgagatcatgccactgcactgcagcctgggtgacagaatgagaatctgtctcaaaaaaataaataaataaaaaggagggacatagggtagaatagggtagtataggatagtagctggaaggaaatctgacatcattttgtttatgcattttaatatgggatgaatagtatatatttgtgtgctgatgagaatgacagttttttttcttaattttttgtaaagacaaagtcttattatgtttcccaggctggtctcaaactcctggcctcaagtgatcctcccaccttggcctcccaaggtgctaggattacaggtgtgagccaccacatccagccagagaatgatacagctaaagagaaaaaaaacaatgatggtagaattatttttgtaccaaatcatcttttgagagatggagcaacacagaagggaattccttgtgtaaataaatgagatggaaactagtgtccaagtggagataccgggtacccactccattcacagcaatgtagggcacgccaagtatgcaggatctaaaagcaagtagatgtgacttggggatgacattgagaaacacatatgcaaataagttagcatttcaatagcaaacaatttatgtgatgaagagaagagagaagtgggaaaacatattattatttaatttaatttatttttgagatggagtcttgctctattgcccaggctggagtgcaacagcatgaactcagctcactgcaacctcctcctcccgggttcaatgattctcctgccccagcctcctgagtagctgggattacaggtgcccaccaccacgccaggctaattttgttcgagaccatgttggtcaggctggtctcgaactcctgacctcaggtgatctgctcacttcggcctcccaaagtactggaatacaggagtgagccactgcacatagccataaattttattatttcacagagttctaacacctctgtctgtctgtctgtctgtctctctctgtcttttcatcaaataatgattgtgtaccatgaactgagtggtatgattaactacacctttggttggaatctaaggtccaaaatgaaaagaactcattatcaccatttgctcctcaaaacctttaatccttctgaactgttccaatttagatttactgcgactggaactgcttcttccttaatgtctactaggacctaactgcttcttccttaatgtctactaggaccttagaatgtttaataataaatagtcctgtaacactggggaaggagatccctagtgaagagctgcagagctacaaggctttgtcttttgacactgactctttccacttttctttgtaaagcaagagtcagttcagcttttcaaataattattaagcactatataccaagtaaaagaagaatgtcatgcttactatggactaagtactacactaggttctttacatatattttttaattgcctcaatgactctatgagatgaatactattgtttttcctgtttttatggtaaggaaattcacacacttaaattgcctaagttcgtgctgttagtagtggaggagccaggattccaacccagtcaatttggctcgtgtgcgtgtgtgttaccattgcatcatatgccacccaggttagggacacagagatgattataaacagctcctcggtgcaacaggttcagatggtacaaagcctaggggtctattgacagataagacaatcaagagccagaatgttctcagaaagcttgaaccctcactccaaacttaccagataagactgatgtagggagaatatgaaatctgaactttggttccaaaatgaaatgcatcatgaacacaggatagggagacgtgatgtgacacaaattctctgaagaagatctgggtgttttgggtgactgcctcaacaggagcctagtgagatgttacagctcaagagtgaaaccctgggcttaatagaacaaggaagtccagagggtgggtggtgatgcaagtgaatgtccccctatgctcttgccagctctgatgacacataagtcccctgtcccatgcaaaggggcatatttttggaggaacatggacaaactacagtatattcacatgtggctgttggcaagtggtgaacaaatgataatgaaactagaggcatagcttctttaattatttgaccttatgctatggaaaagacttttatcttcagaagacccagtctgactaagggcataagggcttggacgcagtggtatggtagaatgtcttctggaagtctttgaaagtgagattgatactcatcttcctgttccatgtggtttctgcagcagcagagagttggtcccaagtatctgaggagcagccacagggctctggaattttattcattacactgcaactgtgggctttgggaataggatgctctgaacactcaggcctggggtcagaagaactgatgcgtgggccccaccacgaattccgagttaattagtagtgaatgaggccaggacacaaactccctgagtgagtctaacatactgccaaggtggaggaccactggctttcctaccttcttaatatggatgtcatgagaacacaaaatagggactcaatggcttcttaaatctttattatcagcaaaaatcccttagaagaaattctattgtcattctctattaatatcatccttattactcaattatggattgatgtcacagaggagaatatttccaaatggccaaacctaagcagaattctggccttatgccccagtgctttttttggaaagcacagatctctttttattacctccttgttgttcattatggtattggtggatgatatgggtgtttttccattagaactccagcaaacagtttcccgtgaaagcttatatgaatccaatacaataattctgggttatttctgctagaggctagattcaaattaatgacctaggaatggaacaaacaaaaaagtagacaccaattaattcccagagctctccaaagcacttttcctaatacttgaaatttatcacaagaaaatatattctcctggtttcttttttgttgttgttgttaaggtttaagatgatgccgtaaaacttgttacatttgctattcataatttataaccccatggtattcttctgtttataaaagtggtttataccttcattgataagaattgccttttcctcaggacaaataatttaatttataatatgaaggaataatgaatggcaataagcatgccaaatcatcaggaatgccagtttatttttcatcaatttctttttttggggagataaatgtgcagctacttagaacaaattgttcatcattctctgggggttgtgattcggagaaattagacttgtgtttgtctggagaaagctcggctgtggaatactgaattgaatgaaatcttagaacatcctccctctggtgtagaaactctcggacaggtggggctcagccacttgccctgaagggtaactccgcagttcaccagagcaccacgattataacattctttcttagaattctagacacacaacttgaaggtactagatgctcttttataagctgaggccagaaaggttgcattttctggggccttgtggcttagataggctgatgtagttacataaacacggcctttgccatccacagccctgggtacagatcccagctcaatgacctctgttaccttgagcctctattccctcgtctgtaaagtgagcacaattcttcctttctagggttagtttgaaaattaaattcgggttgggtgctgtggctcacacctgtaatcccagcattttgggaggccgaggtgggcagatgacttgaggtcaggagttcgagaccagcctggccaacatagtaaaaccacgtctctactaaaaacacaaaaactagccaggcttggtggtacgtgtctgtaatcccagctatttgggaggctgaggcatgagaatcgcttgaacccaggaggcggaggatgtagtgagctgagattgtgccactggacttcagcctgggcaaccagagtgagactttgtctcaaaaaaaaaaaattaaattcaatacaggtaaatggcctggtacagttcctggcatatggcagagcaatcgcccaaaacctgttgaactgtagtttgaccttccctgtcttctgtcaaaatcctaccccttccttcagacctgattccagggtccccttcttcaagagatatcattactgctcctactctcagttcttgcctctcccctcccattttgtttgtatttgcttattttttggtttctagaagaaatagataatacatgattgaatgaatgaacgagacaaaatccctgagacactgtggacccccggcctgatcatccccatttctcttcctccacagaggcctctctgactaaccacacagaaaccatcaccgtggaggaaggccagacgctcactctaaagtgtgtcacttctctgaggaagaactcctccctccagtggctgaccccctcagggttcaccatttttttaaatgagtatcctggtaagtgaaagaaagaaagaaaaaatgccaccagaccttaacctgagggtttttccagccggacagtttggtgggacagaaagcctgcatgagtcacccaaggggtgggctcagcccacctactgttacacatgaatcacgcctccaaatcctgttattttacacgcagtggcttgctgggggcaggaactgtgaaatggaaaccccaccagaatggttgttaaagggggttcagattacaaagcacatttccatgtccccaccccacactcacaccactttttcactctcagtaactatcacacaaccacagcacaatgacagacaggcaaccaactgactgggagcccgatcctcatgcaaccaccaccaccccagataagaagccagctgcttcgttttccatctgagcaatccaaaggcacattacaaagctcctttccagatagctcttcttctcctgttggtcttaacataaaatcaagatttttaagcaatagaaatagacaggatgtattaatttggaaatgaggacagtcatttctcttttcacaaacacacatgaagaaagtacaagatgtctgagatggaaaaagactcttaagaatctcttgggttcatctctttgacgttaggcagggttttactaaaccctagatcattttatgtctccatttaatattgctaactgccaaatacttggaaaagtctaaaacacatttcagtcttatttataaagcagagcctcttaaagcatatcatgctggctgggcgtggtggctcatgcctgtaatcccagcactttgggagactgaggctggccgatcattttgaagtcaggagttcaagaccagcctggccaatattatgaaaccctgtgtctactaaaaatacaaaaaaattagctgggcgtggtggagcactcctgtaatcccagctattgggggaggctgaggcaggagaatcacttgaatctgggagatgacagttgcagtgagctgagatagtgccactgcactccagcctgggcaacagagcaagactctgtctctaaaaaaaaaaaaaaaaagttatgctttgaaagcattattagatactgatatgttaacataaagaaatatattatttcaagctaaatcaactagaagtaaatactaattgttaaaagttctgagagaaaaaaattttaaatagagataattctgttacataatgctttttgttgttttgtttctggttttggtacactgggagaagagggactctctcggatttctgcagcagaatggcttgatctagctcagtggttccccacccggaatgatcttaccttcccgtggagataggacaatgtctggagatagttttgattgtgccaaatgtagaaagcggggcagtgcttctggcatctactgggtagaggccaacgattcatcggatatctttcctcataacagctctatttccctcttgtacagctttaaaaaattccaaataccagcttcttcatcactcggccaatcagctctccatcactgtgcctaacgtaaccctgcaagatgaaggcgtgtacaagtgcttacattacagcgactctgtaagcacaaaggaagtgaaagtgattgtgctgggtaggtacctgcaagtgaacccagtaggggagcaatatggataggaacacgatatgtcgtttttaaactgaaccttttagtttaaaaatgttgcctagagcaaggaattgcctgggacacctctgccatcttttattgaaaggaaacagaagagagcattttgagaagcaagaccaagattgaactgtgaacttgtgaaatttgtctttgacagcaactaaattttctctccagggaactaaaagaaaagaaaaattgatatttgatgagctgcgactatgcgccaggcaccatgtgaggttctcgggaatcagagatgaattaggcacaatctctgcccataaggagtttgcgcaccagctcaggaagaaaaacatgtatgcaaatgaagtggaacctcatgacagcaaatcctaagatagaatgaattcagatgtagctgcactgcttgatctgctcaaatcctctctgccaaacaattcctcttttctgtaggagggcgggattgggaggtgcggataggaagtgacagcctcctaattacctgggacttactcagttctacagatggtcaactgtgtccagtatgtctatccttacttgttttgttttttgtggcagaacagatcgattaaaaacattgctttttattgatctctaagtaacatcatctcacatatcacacaaatgaatgtcttagacttctcctgttgaattactgcagtgtggtgcctgccatacggtaaaggcatgatgggaaagtagctgagaaggagtggctctcggggaggggtttgagaaccattgtgactcagctcagcgttgtctttttgtaagggagcacacatcctggctcagctgcttgtgtgcccttctgggctctcataacaccccatgtatactctgtcattgctctcaacacataatcttttcattaacagtttaggggctgaagccacaccagactattagctccttgaatcatacctttttcatcttcgtattgccaacaagtaacacatctaatgtatatttggagctaagaagtgcctttataaggtcttgatggcagatgggtgagttaagtaaatggggaagagctcagttctggactgaagtggaagtagaatgggaaacaggaagaagcaagcctaactaaaaagtatttccaagacagaagtataaagaaaaaggacgaacatgccctttataagataaatgcacctttttttttttttgatggggtcttgctctgttgcccgggctggagtgcagtggcgcaaactcggcttactgcacacaacctccccatcccaggttcaagcgattctcctgcctcagcctcccgagtagctgggactacaggcgtgcaccactatgcccagctaatttttgtatttttagtagagatggggtttcaccatgttggttggccaggatggtctcgatctcctgatctcgtgatttgcctgccttggtctcccaaagtgctgggattacaggcgtgagccacctcgcccggcctcatataccacattttaagaattgttgctacattgcttgttcgggaattttcagagactaacaacacactgagtaatacacattctggcttcagccaaagtagctttgcaagcacatgaaagccctttaacatgactgtattctggaagagattaagttaaaaaatatgggccgggcgcagtggctcacacttgtaatcccagcactttgggaggtggaggcgggcggatcaattgaggtctggagttcgagaccagcttggccacagagaaatctcatctgcactaaaaatacaaaaattagctgggtgtgatggcgggtgcctgtaatcccagctactcaggaggctgaggcaggagaattgcgtgaacctgggaggtggcggtttcagtgaggcgaaatcgtgccactgcactccagcctgggcgacggagactaagtctaaaaaaaaaaagaaagcccattaattagagtataccctataacaatcacctacagattattagcctctgtgctttgttgagatatgcagactcatatctaattaacacagaaaaatccattttgttctagcaactcctttcaagccaatcctggaagcttcagttatcagaaagcaaaatggagaagaacatgttgtactcatgtgctccaccatgagaagcaagccccctccgcagataacctggctacttgggaatagcatggaagtgtccggtaaggggagaaatggttctctttgtcttccttcctactcaaatttccaggggatttttaaatgttttggcaccctctagtggcagacaatgccagaagacatcatttaatatttcatcagctcttttccagacaagttattcttacaaccaatcaattttatgccttaatcttgaaaggctaatcatagatattgaaaatgtttttgtttaaaacaggtaaaaatctaaagtgaactataatgacttcttaaaatttcacaaaattgtctaaaataagtataatacagaagtataatatctcaggcgaggcacaatggctcatgcctgtactcccagcactttgggaggccaaggtgggtggatcacctgaggtcaggagttcgagaccagcctgaccaacatggagaaacctcgtccctactaaaaataaaattagctgggtttggtggtgcatgcctgtactcaggaggctgaggcaggagaattgcttgaacccaggaggtggaggttgtggtgtgagccaaaaatcacaccattgcactccagcctgggcaacaggagcaaaattctatcaaaaaaaaaaaaaagaagaagtataatatctgtgagcataaactttttcccagatataaaatcgaaaatatatttaacataatacatataattggaacagatatgatcttccctatattgtatagtactatattgtgtcatacccacaagaacagattaaaaatattcttgtaacaaagcacctaaaggttgagcctttgaaacagaataactaattaattatggtgtctgggtactgtttatagtttgcttacatttcaacagacattacctttgatatctatgtaatcaaccatcttttttttttgagatggagtctcactctgtctcccagtgcagtggcacgatcttgactcactgcaacctctgcctcctgggttgaaacgattcttctacctcagcttctggagtagctgggattacaggtgcatgccacaacacccagctaatttttgtatttttagtagagacagggtttcaccatgttggccaggctggtctcgaacccctgacctcaggtgttccaactgcctcggcctcccagagtgctgggattacaggcgtgagccactgcgcccggcctgtaatcaacattcttagagttgcaaaggaccctttacagttgagaacactgagggccaaatggagttctagagagaaaagacctaaacccagatctgattcccagggcagtgccaattctacttcattataagacttccctttaattcgccttattcatataaccagaataaggtcttggatctttgtgtttcataacaacatcaagctgtccttcttaagctttgaatttttttttccagtagtgaaaagtttgtagaaaaccatcatctactctcattcatctgtttgcctttgtgaccagaaccaagcctatacaagggaactggctgaggttagaatgaggttagaaatctaatgtttgccatgaagtcaaggccattggcctctaatagaaccaacctcatccagtagcattaaatagccataacctcttcaaattgctacataggtggaacgctccatgaatttgaaactgatgggaagaaatgtaatactaccagcactctcataatccacacttatggcaaaaattcaacggtggactgcattatccgacacagaggcctgcaagggagaaaactagtagcacccttccggtttgaagatttgggtaagaagaactaatgattctcttgaataatttttgatttactttaatattacactatcaaacaaaattaaatgcagtgggcagagtccttcagattaagattactgccaacaaagctttcctaatagcaaattcctgtactgattgaaatttctccaggtgagtgacggaattccaactattccaatgttcaaaagaaccccagttgagcagaaagcctagcacagcgccatatgcaaatagtgtcatgcttgctttttgataatgactttaaatcgttttattgctgttgtgtttttggagtaatcatatgaatcatactgcatctttgtacttgacccagaaggagataatgttagctgaaataaacctaaattgtcaatatcattttatgtgaatatgaaacacacagatacatgaagacataattcctgtttagatttattttattgttataattgctttgaagattttagtttaaccatgttaatattctgagttgaacaccattttaaacatccaatattaaatgtgaagaggagttgcctccattctcagaacctctattctatgattctttccccaaaagtccaagaaataattttaaaactgtacacaactctttgagccaagaggtatcctttaagatgcatgagtcctgtaagaagtctgcaattagtaggactctgagtttcactgttttacaaggtacttctctgtgtaatcaaatcctaaagtataaggaattactcacatcagtgaaagaggaaactgttggatgacaatgcatttattgaaaaagctcttttatcagacgaaatcgctgatgctgaaaggcaagcttgcttaggagaacctcactgtgggaaagctgccgtgatgccctgtgggggctgtggctgcggttaacaggccccctctgactaccacaaactttccatgggtcactttctcaccaaaccaaaagtagtcattgcagaagctgcactgtaagactcatggacctacagaccgagctgtacagtaaccttacacaaccacccccacccctctgtgagtcatccccaccccacgcctccacctccagcagtagaactgaagcatagggcatgtgggggatgagcctgtatctaaaagcttcctaaagacattcaggttcttcaataggagaaccaacaatgtcgaaaaaaatgcattcttaattttcagcaattgttcaagccatctacaaaaattactatgaagggggaaatggcagttctccacctttacggctatagctctgtatgactcaaaattatagctaaagatgtttttaataataggctaaggccaggcgtaatggctcacgcctgtaatcccagcactttgggaagccgaggcgggcagatcacctgaggtcaggagttcgagaccagtctggccaacatggcaaaaccccatctctactaaaaataaaaaaatcagctgggcatgattgtggacgcctgtaatcccagctacttgggaggctgaggcacaagaatcgcttgaacccgagaggcggagtttacagtaagctgagatcacgccactgcactccagcctgggcaacagagcgagactctgtctcataataataagaataataggctaagacttaatttttatttgtgatctatttgctgtactcattgccagatctccaaatagtattcaaagagaaacgccagcatcagctgttgatagcttccattagttcattgtttcttccatttggctagctgctactatattgacatatagatgttacaaacattttgttcacccaattaggtaaaaaatattactagctgaggatgctttaaaacacatttacacataagggttctgacccctttcattcctgtgctctgcatggaaggacctgggtaaagtgagggtcatgccagcaccaggactagggtggtcctgaggaaagaagtgccttcctctgaaaaagccacagtgtgatgcttcgagaaagagagtagagcaacaggaattgatttttgaataggctatctttgtttttatgttttgttttgttttttgagacagggtctcactctttcaccaaagctggagtgcagtggtgtgatcgcggctcactgcagcctcaatcttccaggttcacaatcagtcctcccacctcagcccctcaagttgctagtactacaggcatgcaccactacatctggctaatttttaaatttttgctgagacggggtctccctatgttgctcaggctggtctcaaaactcctaggctcaagaaattctccctctttggcctcccaaagtgctgggattacaggcatgagccacctcacccagatttcagaattatcatttatttatttcttttcttgagacggtctcactctgttgcccaggctggaaggcagtgacacagtcttggctcgctataacctctgcctcccaggctcaagttgatcctcctgcctcagcctccggggtggctgggagcacaggcatgagccaccacgccctgctaattttcatatattttgtaggtatggggtttcgccatgttactcagcctggtcttgaattcctgagctcaagcgatccctcaacctctgcctgcctcccaaagtgttgggattacaagcatgaaccaccacacctggctctttttgttgttcttgttgagacaaggtctccttctgtagcccaggctggagtgctgtagtgcaatcatagctcgctgcagcctctacctcccagacttaagtgatcctcccacctcagtctcctgggtagctgggactacaggtgcacacaccacacctggttaattttaaaattttttatagagacagaatctcattatggtgcccaggctggtctgaactcctgggcttaagtaatcctccctcatcggccacccaaagcactgggattagaggcgtgagctactgcacctggtttatttcatctttttagtatttaaaatgcggaatcttggttttctattacttacctggggataggattttttaaatatttgaaaaacagttctcaaacttttgatttcaggacctctctacaatcttaaaaataatcgagaaccccaaagaacttttacttatataggtgatgtctgtcaatatttacctattagaaattaaaactgagaaattaaaaaaatatgtatctgtcaatttattttaaaataataaatctgctacatgttaacagaaatggcatatttgtttttattttattttttgagatggagtgcacttattttttgagatgagtgcagtggcccgatctcagctcactgcaacttccgcctcctgggttccagtgattctcctgcctcagactcctgagtagctggcattacaggctcctgctaccacacctggctaatttttttgtatttttagtggacatggggtttcgccatgttgggcaggctgatcttgaactcctgacctcaggtgatccacctgcctcggcctcccaaagtgctggtattacaggcgtgagccaccgcatccggcccagaaatgacatattttaatgaaaaaaaaagtatattttgtaacactgaaaagattagtgtgaaaatgtcatttttttacattttgaaaatctcataaatgtctagcttaacggaaaacaattaggttcttgtaacttttgcattcgatctcttccaaaatgttattttgctttaaataaatatataaaaattcaatctcacacaaatatataattggaaaagggtagaatattttaatagctggttcagataattgtggctattcttctttgatgttacaccaaaactcaacaagtagtagtttcttaaagattagttgctatgtggactctgggcccatgtcaatgaacttttcatactgttatattaaaacccactgaactgtcttacactttgcttagaatttttacccaggcatgatttttctaacattatgttttagtcatttggaaaatactgattcactaagttctacagaactttccaatgttgatatatttcagcatcaaaatcacattcattaatatcatcaccgatctcatcagaaatctttaagcatttggaggttgtcaaactcacagtggtggatacaagttgtccgaaatttgaactttaagtgtgactattgcaaatgaggagctattttattttttgagatggagtcttgctcttgtcgttcagactggagtgcaatggtgctatctcagctcactgcaacctctgcctcccaggttcaagcaatactcccacctcagtctcctgagtagctgggattataggtgcccaccaccatgcccagctagtttttgtgtttttattagtagagtcaggtttcaccatgttgaccaggctggtcttgaactcccggcctcaggtgatctgcccgccttcaccttccaaagtgctaggattacaggtgtgagccactgcacctggcctaaatttttaatatattttcattttaattaattttaatttaaatagtcgttggagctagtgcataccatattggatagcagaggtctacaatattctgaccaactaggggggtagatcatcatgtgccagtatccacccaattaaaacaacattcagtctaaatgcaatagtttgctagcttgttaattaacaggataaatcaaagtaaatacagagtctagttttaaatatgtatagataaaacttgttttgtacataaacataattttctgaattcacatagtatatactatgttagaagatttaaatcactattgataaattttattctatatgtccccagtgatgtccttcttcttttttaaaattttgagacagggtctcactctgtcacccaggctggagcgcaatggtgtaatcacggttcacagcagcctcgacctctctgggctcagatgatcctcctaccttggcctcctgagtagttggaactacaggggcgcaccaccatgcccagctatttttttgtagagatggggtcttgccatgttgcctaggctggtctcaaactcctgggcttaagcaatctgcctgcctcggccccccacagaactgggattacaggcatgaaccattgtgcccggccccatattcttcttaaaatttattcccagtacttctatttgactagcattccagcttttccctcttttcattgccagcagctctcctctttcttcaattttctctggcacctgtgtggtcagagttcattttagccttatagtctatactattatctctataatgtttccttagtaattctttctttcctcagagcccttacacacaattcaggtatttttatatttttcatacagtttgaatgtttgattaaccagatatgttttcaaaaccatggaaaattatttgattaaataaacaccaagaagcactcacaaattttataaaaacatgaaccacctgtgacgtgtcagtatatatatatatacacacacacacacatacatatacgtatatatatatatatatatatatatatatatatattttttttttttttttttttttttttttttgagagggagtctcctcgctctgtcgcccaggcttgagtgcagtggtgccatcttggctcactgcaacctctgcctcccaggttcaagcaattctcttgccttagcctcccaagtagctgggattacaaacacacacacaccaccacgcccggctagttttttgtatttaaagtagagatggggtttcaccatgttgaccaggctggtcttgaactcctgatttcaggcgatccacccacctcagccttccaaagtgctgagattacaggtgtgagccactgtgcccacccgacatgtcagtgttagtatttgtaaagtgacaggcacagttattacatgcttcctggatgtggctggtaaaacctgttcaatgactggtaaaacctatactaggctgaccctctggaaacattcctaagcattgattaatgttatacaataacatttagcactgtgcttcataaatagctaggcattgtactaaacatgttatataaatgaacttactaattctcacaaaacactcgaagaggtaaatgctgtcagtatctccattttacagataagagaaaaaaaagtgctaggtcgggtatcttgtccaactcattcaggagcaggtaaatagcagcactggaattcagcccagtctgaggctgattccaaagccatctaataggtagatagataggtggatgggtagataaacagacagagggattgattgatggatagaaggacacagatagaaacagtgaatactctttgcctaccactgccaccacacagaggtccagcatgctgtgctttaagccaggcaggtgagcagatggacactcagtgggatacagattcaaaaaccagagcaggagccacagaacacacagttctggggtttctgcacaacctctacaagcaggtagccgctaaatatattctccaatctcttttactgagcacaatgtgggtaaaactgctctctatagtagcagaattttgtttttcccctttcctagttactgatgaagagacagcttcagatgctctggagagaaactctctatcctctcaagacccacagcagcccaccagtactggtaagtgtcaaaatcattcaaacttgtttttaaaaaatcacgtttccttgggaaggttatttttctcattctaagttttaagaatattttttgttttaatttttactaagaccatacaggcccctccaactggctccagctttgtaccatcctagagaagaaccacatcaggcatcggaatacttagtgggatgggcttcaggctgacataaagctttgcaagttcagttctagtttgcctgagatagagatgtacacatgtacacacacacattcacgactgtgacatttgaatttcctctgcagtaaaggacaaagttgaattcatttatagagagactcgtttctttgttttcccatctgaagcacaccaaacacaaaacacagacttggtatcaacaaagagaaaagaagcagaagctggagatttggtgttgtcattgaataacaaaatcacctctgaaggcacatcaattacttgattgtcaataactcaggtcatttttgatgatgggattgaactacaaatacagaataatttagaaagcctggattataattccaattttttagacagtgaactcactagaggttaactcagagcaatgattgtatatctaatttaactttgtattttacctagcatagtatccagcaatagcagcttctcagaaaatgaattacgaaagaaagaaagaaagaaagagagaaagaaaagaaagaaagaaaaagaaagaaagaaaaagaaagaaagagagaaagaaaagaaagaaagaaaaagaaagaaagaaagaaagaaagaaagaaaaagaaagaaagaaagaaaaagaaagaaagaaagaattggttatggtgctttgagcaagactattagcctcatccagaaaggcataaattcctacatattctctttccatttcatgtaatgtgtcaataataatttcatttgttggaataagggctttcagagcattatcatgttcatagttctgagtatcagatcatatttttaaaaatttgtatcctaaataatatttaaaagtaaatgtttgggatttctaaacactgataaatacaacatgtaccatacaattttttgaaggacaatggaaattgaaaatattatgaagtggaacagccacatcacttgctttaataatccaatatttgtaaacgtgtttagaatctagtaatctttaacggcttgctactgagcaactcaattttctgctctgctttttcatatataagacttttaaaatagggtttctaaaattcctttcagctttccatttctacgattttattacatttaatacccattttcaatagaatgggaggcttcattcccctcggggtccacatagtggcgctgtgcaatggactaaaaagcaagaaactgcagagagaaaaaaggaaattggaaacatcagcagtaaaatctggaaaaaaaaaccacacagtttctgattttttataatttatcttatctagaaaaaacatcatagtacatcccacttctaatggggaggcaagcagaggtttgaataactgaagctatatttcaacataaatttcaggctgtaggttttctataattaaagcttggaatgccgttcctcggtgttcagttgttatcttgaagcatcctaaagaccttctccctaataggcctgattcaggatggaaatatgaaataatggtttaaatgctgggctctagagttaggtaaaacagagtttatgtattggctttgccacttatttgctacaggactttaggtactttacataactgctctaaacctccgttttctcagagctgtggtgagaaataatatataccaagtgctcagttcaaggccaggcacagagtaaatgcccaaaacatttaccttaaaaaaataaggcaaagtgagcctagccatttgcaattatgtttgcaagaaatccatagttcacaaatgatctcagtactgtttttaaatttggcttcccaagctgctctgggaagacttacgtaactacagttgtatgtagtcacatgtatataatgcatgcatagctcatgttttatcttctttcactttagtctcagtaacggaagattctagtacatcggagattgacaaggaagagaaagaacaaaccactcaagatcctgacttgaccaccggtaagtgtcacccactgcatttagaataaacactcgacattttaacctcttaatcgataaattcaatggcctttgtcagtcctcccttttcttgacctttctgccctttaggacatgattggttaatcactcccttgtccctccttgatttagttacctctcggcttcttgacatacttttcctggttctgttatttgttgctaaccactgcttctctgtatccattaattaacttatcttcctcttctgacttcttaaatgtgtatgtacttctgattttacttctccatcttttgttcttcccttttttttatatatatatattttttttgtgagacagagtttctttcttgttgcccaggctggagtgcagtggtgcaatcccagctcactataacctccacctcccgggttcaagtgattctcctgccttagcctcccgagtagctgggattacaggcacacgccaccaccccagctaattttgtatttttagtagagatggggtttatccatgttggtcagtctggtcttgaactcccgacctccggtgatctgcctgcctcggcctcccaaagtgctgggattacaggcgtgagccaccgcgcccggctgttcttcccttattttttaaagagtttactcattcccaagatggttcctgttgccactaggcaaaagatttctctcttttttttttctggttttgttttgtttttagagacagggtctctctctgtctcccaggccagggtgcaggggcacgatcatgttcaccgcagccttgaactccagggctcaagagatctcctacctccacctcccaaatagctgggattacaggtgtgagccactgtgcccagtaagcaaaagatttctatacctatatttccagaacatcctcctcagcattgctcccaatttctttccattttctatgtatctgtagctgaattttctgtgatttccccaaactcaacattgctaaataccaaacagcaccttctcccacaaaatcagcttgtccaaagcatcacacaggccccaaagcaacacacgggtcccaaaccttggtgttatctatcactcctatgtatgtgtacaaatatatctatgtgtatatgtatatgcatatgcacacacgtatataaaatcagtcaatttccaagaacttttgagtcttgtctttcaggtattttgtccattgtcactgttaacgtcccaatccaggctctcatcatctcctgcatggagtattataacttcagtttctcctcctctggttcacttttagcaccctaccatcaaaatatctctttatctgcatacctgtgttctaaaaccctttatagcttcctgaagtctacaacacagagcatgagtcccaaacacctcattaggtgccatctattacctacttctgcagtctcatatctacaaagtccttatgagatacatatttttctctgaaaacatcaacccttttcaatcgccctgcccttgtttatcctcactgcccctggtggaagaggagacctcctctcacctctccttactccctcttcaaggccaatatcttcactgaaaacttttttgaccaactcaaccctcagagaccattcttgcctctgaacccctgaacacactatgatataaatacatatggatccagaatttgacatatcttacttttgtttgtttttattaatttgtttatatatagagacagctaatccccaaagcatgtgaactgtgccttctgtaggtccaagcacaatgttctacacatagctggcactccttaattattcattggttaagatgaggtgactaggacatttagcaagactacagcccatagaatcagaattctaggtttagaaagcctttttttttttttttaagagacaggtctcatctgtctcccaggttggagtgcagtttcacagtcatagctcactgtaaccttaaactcctggactcaagtgatcctctgcctcagtctcccaagtagctaggactacaggtgtgcaccactgctcctggctaattttttattattattatttttgtagagacaaagtgtcactatgttgcccaggctggtctcaaactcctggcctcaagcaaccctcccatcccagcctcccaaagtgctgggattacaggcatgagccactgcacctggctagaaatattttcacaagctcatctgatttagcccaaatgccttcctgtagggccacatttaacctaaccaagataaataaattttcattttatttggatagttttttaaactccttaacaatccctcttgctacttaactatattttgctaaaaatcattcctaaagctaatttgaatctcctgactataacttaagtcgattttctcatatgctttctgtagaaataaaaaataactagcccaatagctacgtcacttaaaaaatcttttcaaatcatcacacataattgccttgtttgttgtatgcctgtttgcttgttctcagagaatgaacaatgtaagtctctttaccttcaggggtaagctctttctcatctcttcatctgagctgtctattagcttatatcacattgtagaagtattgttacatattctccagtggcaaaaaaaaaaaaaaaacccaaagtatctaaactcctttttcattttccttatagaagcaaatcctcagtatttaggactggcaagaaagaaaagtggcatcctgctgctcacgctggtgtccttcctcattttcatactcttcatcatagtccagctcttcatcatgaagctgaggaaagcacatgtgatatggaagaaaggtcagtgggcagggaacctgacgggggctataagacgccagaacaaatggctaaaaaaaagggaaattctgtccattaaagctttctgtcagacactacataatctatttgataagtgctgtctcagataagcaattgtttgttttctagtaaactcgggtgtgaatctccagggactatagtctaagagtgtataatcaatagaaactagcatagatccagaaattggcattaaatgatagacacttctattcacagaaggataaaaatcccaggactgcctagcacagtccctacaggaatcaaaaactatgtgttgaattaatgaggtatgagttatgggaggggcatggtaagtctactattgcacagtaacagaggtattatcttattcaaatatacatttctacatgtccatggcatcagaaattagttgcttgattttctttttttgtagaaaacgaagtttcagaacacacactagaaagttacagatcaaggtcaaataatgaagaaacatcatctgaagagaaaaatggccaatgtaagtcaactgtatgacctgagatctgaacaatgaggttcattaatgtattagtcagatttctccagagagacagagacaacagaatatgtgtgtgtgtgtgtgtgtgtgtgtgtgtgtgtgtgtgtgtgtgtgtgtatgaggtgggatttattaggggaattggctcatgagattatggaggctgacaagtccttggacaggaggtctgcaaactggagaccctggtatgctggtagcctggctcagtccaagttcaaaggcctgagaactcaggggaccgccagcgttaagtcctgaaatccgaagctagggagtctcgagttctgctgccaggagagaggagggagtgtattccagctccagcagacagatcaacacatttgccttctttctgattttgttctttctgggcccccaacagaatggatggtgcccatccacatcaagggcaaatctcaatgcccacctactccactcagactcacacactaatctcctctagaaacaacctcatagacaaacccaaaaataatgctttaccagatttgaggtatttcttaatccacccaacttaacacttaaaattaaccatcgcaattaagtagtcgcctttaaaaagaaggaggctgggtacggtggctcacgcctgtaatcccagcactttgggaggccgaggcgggcggatcacgaggtcaggagatcgagaccatcctggctaacacagtgaaaccctgtctctactaaaaatacaaaacaattagccgggcatggtggcaggagcctgtagtcccagctacttgggaggctgaggcaggagaatggcgtgaacccgggaggcggagcttgcagtgagccgagatcgtgccactgcactccaacctgggtgacagagagggactccacctcaaaaaaataaaaataaaaataaataaaaagaaggagaagaatcaaaatctgattttttagcactagaaagtctcctaaatcatcctgtagaacttaaggagtctcatctgcaaaaataaatagtagcagttaagttcatgtagcagaaggtgacttccttttgggaagccatccttgactgtttgacgtcacacacagggataccccaagaccaccagaggatcctatgacacctttgtcatagaagcacgtcttcctccatattgtaatttttggtgtttttacatagctactacaatactcctttaggtggtgagtaatcagatttactctgtatcctcagattctagcacaggttagttgataaatttgtgttaaatgagtgactataggctcaattaattcaagaaggcatgtgtcaggtcctttggatgacttcattgcaattcctgagacaaaatatgtaaagaaaatgaagagaatcgggatgggaaggagattgtgtatgggaagtggaggttggggattgtattcttgataaagatctggaaggcagaagctaggactatagaaaagcaagaatattccaccttccaaccatattatttcctccatacaaactaacttattctacccgccaggagctgcaagaaatacagcgagttttgccgctctattctattggttttactgaggtttttgtaggaggcttgtcttttataacacctctgcctctttaggttttgacctactagagcgtgaactgaaaagaatgaatagatgtactagctgggaaaggaacacaagagaattgactgtgtgaaaactgggggtgggaggggaaaatgtgtgtaaataacatccaagtcgattgtgttgcaacacctgtttctaaatacccgtcatcacatactcacctggtggacaggaaaatgatgttaatatcatgtgtgagttgggttgctccctgagctgtttttcctaggcaagaagaaccaaaacagtgggagtagaattatgtctgttagctggaaaaatggaagcccttccagttcaacttttaaaacaatttttctttctttttttttgagacagggtctctcactctgttgcccaggctggagtgccatggtgccatcataggtcactgcagccttgacctttcgagctcaatcagtcctcccgcctcagccttcctagtagctgggactacaggcacgcaccaccacgcccagttaatttttatatttttagtagagatggggtttcaccatgttgcccaggctggtcttgaactcctggactcaagtgatccacccaccttggcctcccaaagtgctgggattacaggcatgagccaccacgcccagccaactttaagaatatttaaaatgagtacctgcacgactcaggggattcctccccagaaaagtacatcttcaggggtttgctgggggtttcactttctcccgagctcaagccttcactttcatcctccttgccttagcaccctcaaatctagcattttaattgtgttgttttggacatattaaaaatattctctggggccatctctagtctctttgtacagaattgcataggccttgagtgtgatctgccccgaccctatttttgcagtaagccctgttatttctagtgtgcaattttgctaaggcaatatgttatggtcagcaacagattattttacagcagaaatatctgtatattttatttcacgtttaccagtatattgtttatatagtaagacttctttaaaaattatagtataggccagtgcagtggcttatgcctataatcccaggatttggggaggctgaggcgggtggatcacttgagcccaggtgtttgagaccagcctaggcaatatagtgaaaccccgtctctacaaataatttgaaaattagctgggcatggtagtgtgtgcctgtaattccaggtactcaagaggctaaggttagaggatcacttgagcccgggaggctgaggctgcagtgggccgtgatcacaccactgcacttcagcctgggtggcagagtgagaacctgtctcaaaaaaaaaccacgaaaaacaaaaaagaatataataatgccttcagaccatttatatgcatcagtaagttttaggtttttataaagcaatatgtgaacctaaaaatatgatatccaatcaaagtgtttcaagtaaatgggtgcaatgttattcaaaataaatattcatcttcaacatgtttttctttcagcttcccaccctatgcgttgcatgaactacatcacaaagttgtactcagaagcaaaaacaaagaggaaggaaaatgtacaacattcaaaattagaagaaaagcacatccaagtaccagagagtattgtgtagtgctctctgcaatggaacatgtgatttcagggttgccgcagtgtcacctcagtggaccagcctgggggaaggagcttaattgctgagacattaataatgacctcttagtgcaatgcaagatggtgtcctcggataatgatctgccccggagctagggcagcaacatgaggaccaaaccatgcacataaagcttgtagtttaaaaaagaaaagcaaaaaaataattatgcctgacactacttcagagcaggaggattctacgaagccttggggatcagggtcagtgtgagcagctaacatcctacctcaaatggaacaggattttttgatgctttgctctaatggaactgtttaaaaaatttttttttctttttaatattttcttctggtcacaaaataaagaaatttgggatgcaaagtacctaaagatctctgatcctaagaagttacttctggccaggcgcggtggctcatgcctgtaatcctagcactttgggaggctgaggtaggcagatcacttgaggtcaggagttggagaccagcctggccaacatagtgaaaccccgtctctactaaaaatgcaaaaattagccaggcgtagtggtgcgcacctgtagtctcagatacttgggaggctgagggtggagaatcgcttgaacctgggaggtggagattgcagtgagtcaagatctcaccactgcactccagcctgggcaacagagggagactctgtctcaaaaaaaaagaagttacttccaagacagacttttaagatgtaaccagcacaaagcaatgtcagggaggagtgatacatgacaataaatgagtcagatgagcaagaaggccccagaacccatgccccaaggcacaaagaggagctcagggtaggcccaaagattcgaattccttagattactaaatcacatgagcggaccttgtctgtcagataagatttttacctggaaattccatgaccaatacatgtgcaaaagaaaatgatgggttgaatttactgattattgacctaatggatggctttttaaaatgttttaataaaaagcagaatagatgtttgtttttctagtggttataccaagttatacttcctgttttcacgtgtgaaagtaacatgggacatgcctttcttttccgatcagtttatttaagctatacagcaaactttggcatttatgtggagcatttctcattgttggaatctgaataaaccaattacaaaataacata

SEQ ID NO: 83 - DNA, 16933 bp, Homo sapiens
gtatagcagaagctttttcacatctatgacacccgctatgtcttggtaaaccctggaagggaaaggaggacaaggttaaaatactgttccgaggacctggtctctccacagcgcaggctggaggtggcagcccgtggaaagccaagttcatccaccatcggagcccaggccaggctgccaaggctaatattcaggacaaagccaggcacaggtcgggaatcctatgaagatgatcatcgtcctgaggtcttccttccagggttgcatccgcgacagaagatggaaagagaaatgggtgagtccctgctaccacaccaccctcaggttgcttttttggctgaacaagaagggtcctcccaggcaggaagggtggggcacagaaacgtgagccaatgtggatgacttggggagggctttgcagttgaatctcctgaaaacagcaagaagtacagacctccgggcattctagactcagattctgtagacgcttccctttggccgagccaagccagggttgctcaggaactggggtccttgagattggattagattggacggaacgacacaggattgcaacgtgctgaactgtgaggaccggggtttagcttgagttccccagtctgtccacgaggtccaagcttgagatcattacggcgaccacatctcaggaggaagataggtcagcaacgcagtgacgtgctggaatagttttgaaatatttgaactattctaatgcaaactcttcttttaatgacatttcacattgcatcttgtgtcattttatttctgtagatgttgtctttccacttgacatttaattggtgtttaatttaagttgcaaatattgtgtatgtatctgagtctagtgtgagaatcactactctatgcctgtgcatcccacatcaagtaacgtttttgagtgagggagctgtgccatgctgaatctgcagcatgccttggacataagcatgtagcttgtcttctccagcttggaggagagtctcagaggaaaggtcttagaggaatgcaaaggtggaggggtcctcataatatggaacaacgacagctctgtatcacccttcttatggaaaaacccagaataactgcccatgtgttctgtgaccttggattgtggaggaacagacggatgtcgattctgccagccactccttccccagtgggcagcacatccttgccccccaaccttcctgggcacctggagttcagatactaggggaatattaatcagggtccaaccaggaaaacagaaacccttctctgcagttaacagagagggaagtaaatgcaggacggtgcccctgcattggatcccagcacaggcaaagaacgttagtggaaagatgatgaaatccaaagaaagcctgtcagttaattattgtaccagtgttaatttttttttttttttggcggatgtgctggggtcgtgtaaagcatgaacattagagggacctggatgaagggcatatgggaactctctgtacctctgcaactcttttgcaagtttaaatttattcccaggtaagaagtgtgtttaaaaaatgaattagtcggccgggtgcagtggctcacgcctgtaatctcagcactttgggatgccaaggtgggcggatcacctgaggtcgggagttcgagaccagcttgaccaacatggagaaaccccgtctctactaaaaatacaaaattagctgggcatggtggtgcgcacctgtaatcccagctactcaggaggccgagacaggagaatcgcttgaacccgggagccaagattgcaccattacactccagcctgggcaacaagagtgaaactcagtctcaaaataaatatataaataaataaataaataaataaatcagtcaacaaatacatatcaaaaaggaaccagtggccacatggaggcaaaggagcatgaggaatcttctgagcagtgaagaaaatcttggatatgttggtggtttcacagctgtcagaattcactgaattgcacagattaagtggatgcagtttgtgtgcaaaggatcctttgataaagctgaataaaaatcactaatgaagacctaaagtgaaaagaggcagggaggataatctaatgcatagaaaccattatgccagtaaaagaagagtcagaagcaggaaagtcattctcaggagccactgtgttttggcctcatgttcaatgctaagtttcaaaacaaatgtagtattccttgcaaccatgagaagttggtgagtgatttgaaatcattcttatgatgaggtggaagcttttggaatctgtacccctgcactttatccttgtcctcatgatttacaaaaccatgaaaataaagctcagttaattcatcatcatcaaggtgagctccaggttcagtattcagcttgaggctggggactccatctttctttaacttttgactgcatagccttcacttagtttttatatctcttaggcattacaaaaaattaggccaggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgtggtggcgggcgcctgtagtcccagctactggggaggctgaggcaggagaatggcgtgaacccgggaagcggagcttgcagtgagccgagattgcgccactgcagtccgcagtccggcctgggcgacagagcgagactctgtctcaaaaaaaaaaaaaaaattaaaaaaaatatatatttttttagatggagtctggctctgtcacccaggctggagtgcaatggcacgatctcggctcactgcagcctccgcctcccgggttcccaccattctcctgcctcagcctcctgagtagctgggactacaggcgcccaccaccacgcccggctaattttttgtatttttagtagagacggggtttcaccgtgttagccaggatggtctcgatctcctgacctcatgatctgcccacctcggcctcccaaaatgctgagaagattacaggcgtgagccattgcacccggcctaaaaaatctttaacatattatattaagcagttttagttggtttattgttattttttagatggattgctgtcttatggactcacagaaaattggattagattggaaggatataccagggactgtaacatgcagaactctttgaggaccagggtttagcttgaattcccctgtctgtccacgagatccaagtttgtgatcattactgtcaccacgtctcaggaggaagactggtcagcaaggcagtgatcatgctggaatgtttttgaaacgtttggactattctgatgcaaactcatcttttaatgacatttcacactacatctcatgtcactatatatgtttttaaatttttaatttttgtgtatacatagtaggtgtatatatttatggggtagatgagatgttttggtacagcacgtgactccctcttagttatgcaaatttctccagcaagtcgttgcccagcagcctacttgaattcctcccctgaaaacggacttttcttttctaccatgtggctagtccgcaaatttttcgaacttttacactttgcttctcttttaaatataaactctacctttaggtaatttctttgctcccacatctgagcctaggttggtacaagaagccatgccacttgaacactttgttgcttagaaatttcttctgacttggccaggcttggtggttcacgcctgtaatcccagcactttgggaggccgaggcgggtggatcacgaggtcaggagatcgagaccatcctggctaacacggtgaaaccccgactctgctaaaaatacaaaaaattagccgggcgtggtggtgggtgcctgtagtcccagctaatcgggaggctgaggcaggagaatggcttgaatctgggaggcagaggttgcagggagccgagatcgcactgcttcactccagcctgggcaacagagcgagactccgtttaaaaaaaaagaaaagaaatttcttccgccagacaccctggcgtggtatctctagggcatggacagaatgcagccacgttgtttgctaaggcgtaacaaaggtggctttcgctctagttccaagtaagatccttatttccagctgagaccttgtcagcctggacttcgctgttcacatcactatcagcattttggtcacaaccatttaatccatctctaagaagtttcaaacattcccttctcttcctgtcttcctccgggccctccaaataacatgaggtctattccgttaacaaatttcaagtgaacaagacgttattgctgacgatgggtcgtatgtggtgcagcagatctctaggcctgtttgttaataactccccatttccccctcctcccagcccccgtaaccaccattccctgctgtgatgttgtgactctggtgactttgcagatctcctgtaagtgacatcatgcagtacttggtctctgcctctgcgtcgcttggcgtgatgtcctcaggtttcgtccgtgttgtcgcccatggcagaattttcttccttgtttaaggctgaatagtattcccctgtgtgtgcaccacattttctatatcaattattctatcaatggacatttagatggttttcacgtcttagctattgcgaatagtgctgcagtgatcaggggagttcagacggctctttgacatactgattttttttttttttttagacagagtcttgctgttgttgcccaggctggagggcaatggtgcaatctcagctcactgcaacccctgccttctgggttcaagcgattctcctgcctcaaccttccaagtagctgtgcccaccaccacacccagctaattttttgtatttttagtagagacagggtttcactatgttggccaggctggtctcgaatttatggcctcaggtgatccacccaccccggcctcccgaagtgctgggattacagctgtgagccactgcgcctggcctgtttcttttaaatacagacccagaagtgggattgctggaccatatggtagctctatttttaattttttgaggaacctccccactgttctctatagtgattgcccaatttttaattcctactgtggtatgcgagggatccagtttctccacatcctcaccaatagtctccttaaaaaaataatatgctttgtaggatatttttaacgtgttaaataccttgtcgggattttagcatagatcacaatattaaaaacttggggaaggatttctatggctcccatttgtaatacaaggaaatgtcagcttctagttttgtaacgtcttgcccaagagctgcgaccgttaacttgtggagttgggacggcgtccaagtcaattggttgcccgacctttattctgccttgtcccatagatttagaaagaggctgacacatctggtaactagtttacggtcatctgcctctaagcgacatttagggtaagcgacatttttcagaaaccaaggccctccctctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctaggtgagtcctggaggcagccgggaggctggaaagggggtcgggaggtctggaaaattccctgctcaagcctgactctagtccagaagattctggggaggaaagtgtcctcctcctcccaagactgccctgctgctctccctggggcctaagtctgatcagagaagatcttgtcctaaaaacaggggcccgggtgtggggatgaggtcagctttaagaagggctgggggagcaggagcctttttggaggaggagactttgggatttatcttgaaaccattttgcagcaagaaggattacatggagacagtgatgtcgaggagggttggcttggtcgttatgaaatgctgaatgccccccagctccatcgagcccccttttgacagcagccccgtaaggagactgggcactgggcatttttctcactggggcttctcttccagtgctctgcctggcccagaccatccacacgcaggagggtaagtcatgccttcgtcccatcttcccagtcccctctgtcaccccaagggcagtgctgggtgggagtgatgttgattcttagagggcctggagagatccctttaaatataccctagattgcaaactcttccaaatgtaaaatgcataaccaaccctcacccagttctctctcgcatcctccacctgtcttattttgcttttcttattttcaaaaattttatttttaattgacaaataattgcaatttgcggggtacagtgtgatattatgacgtatgtacacattgtggaaagattaaataaagctgattaacatatcagccccatcacatacttattgtgatgagaatattttaaatctccttttagcaattttgaaatatacaataaattattatgaactactgtcattctgctgtgccatagatctgaaaaattcactcgtcctggctactcgaaactttgtatcatttgatcagtgtctctcccatgccccgcacctgcagcctccaataaccaccattctactctgcttccgggtgatcaacttttcttagattccacagataagtgagaacgcgcagtaattgtctttctgtgcccggcttatttcacttagcctaacgtcctctggttcatccatgttgttgcgaatgacagaatgtccttccttttttagggctgaataatattccattgcatatacacagcacattctcctcatccattcatttggcggtgggcactcaggttcttgccaggtcttggcggctgtgagtagtgctgcggtcaccctgggagtgcaggcgtcagctccgcacaccgatttccacaatgagaattcaaacccaacacaaccaaggctgagcccggcacttttccccagacgagcccacacttcactcggcagcttcttggcggggaacatgacagtcacaaagggcagactctgaacactcatcctcttctccatcctcctggatgcaccatgtcacccagtcctggtgatttcactctaaatttttctcatctttccctctctcttcatcgacttttcctgcatcacccccaggtgacagcccctctcccctccgtggctccccgaggccggcctcagcctgtccatgccactgctgcctgctcccttcctgaccccagggactggcgatttgcaaaagcacaaccatgaccattgtactttccacagtttttaaattgtattcaaaaattttcatttaatatctcatcgtaagatgaaatctttttttttttttctcagagcccttcccctgtttatcttcagatagaatcagacctgtgcacctctctttggtctggacatgcccattttcccagccacatcctgtccctgtgacctggggctcactcatctctacattcctccaggttctttcgctttctcaaacactccatatgccgctcaatatggtggttcttctcacatgctgattttgaaaaaaaataattcattttaaaaatgaccaatgaggctgggtgcggtggctcacatctgtaatcccagcactttgggaggcggaggtgggtggatcacttgaggtcagaagtttgagaccagcctggacaacatgggggaaaccccgtctctactaaaaatacaaaaattagctgggcgtggtggagtgcacctgtaatcccagctactcaggaggctgaggcaggagaattgcttgaaccttggaggcggaggttgcagtgagctgagatcgcgccactgcactccatcctgggtgacagagcaagactctgtcagttcacagctgcagatttggacaattctttgatcaataccggtcctcccttctggaagtccacctccaaacggcaggcatcctgtgtgtgtttctcacatttgtggaattagcagcccatgaaaaacgtctttaaacagattgataagtaactgagatatggttaaaagaaagaaaaatgaacaaatgggtgggtttggggagatgctggtcaaaggatagaaaatttcgtctagacaggaagagtaagttcaggattgtgcaacacaatgactagagttaatcacaatgtatcatatgcttgaaaatcactaagagggcagattttaaatgttctcaccacaacaattaactacgcaaagtgaggttatattaattagcttgattcagcgattccacagtgtatacctgtatcaaaacatcatgttgtacaccttaaatacatgcagttttaatttgtcaataataaggaatgaatgaagacgggacgagtgaattgaagccctgccagctctctgccccgctcagggattttgctaattttgacacaaccttcctgtttcagggcgtcaaacccgcccttcctcctccaccccaagcccagttgagataaatggggtttttcaagagccttaataagaaggaaatgcaaattaggctgagaagaaagtagaaactatagaggaaaacccagaggtggtgtctccacagagatctgcattagcaatggggacctgtcacgggctgggcatctgctgtgagcagatcagggctgggggcttcaccctcaccccaccagaccctcaaaggagcctggcaacccccgtcccacactcagtcccacccggggaccggccagtgcccttcaggccccagcacaagccatctccagagccctcgcttctctgtcccttgtccttcaccaatgaccctgtcatccccatcctgtgcctccctcccacactctgtccctctggaaagtggccctgggctctgcagcaggcatgaagggctccaggctgctccgacacttcccacatgaccctgagcaaggcccaagttgtgagcaagtctcagggtcctcactgtcaactgggaaaaaactctgcagtgatgagaatcacatgcacgtagaaggtgcaggaggcgtgggaatgttctaaggttgggctgtggtcatggctgcataactctataaaattgctaaaatccctgaattgtgatgctaaaatgacgtgtgtggcatggtgacttcctacagtggacgctgagatcctgctctgcttccctcctagaagatctgcccagaccctccatctcggctgagccaggcaccgtgatccccctggggagccatgtgactttcgtgtgccggggcccggttggggttcaaacattccgcctggagagggacagtagatccacatacaatgatactgaagatgtgtctcaagctagtccatctgagtcagaggccagattccgcattgactcagtaagagaaggaaatgccgggctttatcgctgcatctattataagccccctaaatggtctgagcagagtgactacctggagctgctggtgaaaggtgaggacgtcacctgggccctgccccagtctcagctcgaccctcgagcttgtccccaggtccctggaccctgtcccagctgctgtcctctgtggccaaccttgtcctcctcctgaccccaagccctcccctccccttcttcctctgcacacacctcccctctgccctcacacctgcttaggttcctggagccctggtctcctctggacgccacggatggcgtggacactcagctccagcatctggtgggctcagagctggctctgcttggctgggtggggagtgggttcccagagattagggggcaacccccctacaagaggatgagtgtcttttcacacgggatggatggtcccgcttattcctttccactgagccagaacctgccccaggcaatgtgcttctcctggtgtggttcatctcccactgggcagaacgcagggtccagggatggcccctgaccagggcgggacagtgctttgggaaaacctttggtatgtgaccacatgcacccctgtgtgtgctcagcccgagatgtcctggagtcaaagtccactggagaggatccaacccatcttcatgtccctccaggacctcagcagtcccctgaggtcaagaagagcttgtggtgggaggagcagagggagtgaccagccccagggagaatggggcaagcagcggggctctccccagcctcctgtcccctgccccgttttctcaggagtctcgagacattgtctgggattgcgtgatggtcatgcggcctttggatgggggctcagggtggaggagggcaggttggttgggacgggttctaaatccttctcctgcccctgtttacagaaagctctggaggcccggactccccggacacagagcccggctcctcagctggtcagtagcagggccctcagctggaggggattacaggggaatctgtgctgcggatgctgttccgggtccagccctctgccctgggcttggagtcaaggtctagggaggccacgggaaggcaccgacacccaccaagctctgggaggtcgctaatgctcacagagaccatagcagcaatggtaccgtgattgcaaccttgttccatgccaggaactgtggaaagcacttaatgcaagcaccacttaatgggggaggtactagtctgatcctctaactcctcctcctctctaatatgcaaaacataaattaaagtttcgtgcttaacggcacaaggccatgaaggggcaggggccacccacccgggcagccccaccccagacttccgggctcgcccgagctccacgctgcccccttgtgggcgtggcctcaccattcaccccgctctgcacctgatggagggacttagaactcaccttccaacctgggacacccggagagggacggggctgctcctgttggctctgtgatctccgggggaggcctgaacggtggagtaaggtcccttaagaggaggagggctccacagggaggggacgtagctgtgaacggtgaccaggatgaagccatgaggcttcccttccatctggctctgccctggactctgtgatgggattgaagctgccccaagtccctgggtctcaagttgtccatctccccctgtgatctgtgaccagaaactcccaggggaggacacggggtcataagccattcgcggccccttccccacctgggtttctatccccagagtacgtccttggacctagacccggtgactgcctgtgaggctcgggctgtgagctcaggcaggtgggaccaggggctgaagccacatggggaggtgggaggagcgatgccgtgctccatccggaccccctcagaggctcctgggctgctggggcacagcgggacatgctcctgagtcccgcagacctggttcaagtccagtgtctggtttttattagccttctgtctgcgggaatatcttgcctctgtttctctccctctcttcttctccttccttctctcttctctcaccttcatgcagtgacatataaaggtcacgaggacagaccctcctgcagccagattgctgggttcatggttcaaatcccggtggttctgccacctcctggctctatgcctgacggtgactcacccaaacctcctgtgtcccaaattcctcatgtgaaacagaggcaatagaagagctgtcctggtagaatcgtttagggcagacttgagttcaggtacacacggcgctgacatcagtgctgattagaaaaccccaaaggagggatgctcctattaatactgaggaagtattttgtcctcacagggactgtgccaggcactgaagcctccggatttgatgcaccaagaatgaggagaaatggcctcccgtcttgtgaacttcaatggggagaaatagttagaatgagcaatagaaatgcactgattcccatacatgcatatacagataaaaatatatgatttgcaatgtagaatttcagacctataatttaaattatattatatatgtttacatcataatatatatatatattatatatatattatatatataaggaagataattatataataaaacatgttagtgtatcactacatatgactatagtgtatattatatattatatgaaagatatatttacaatatatagtataataaatttcaagtgttatagttaataaataaatataggtattaatgtaaatatattatctattatgtatacattatgtataactataatagaaaaaatattttatatttaatcataggtttatatcaaatataaattatacattatatattatagtgaatatatgtaacatatattataagttataaatcatatacaattaacattatatacattaaattatatgtatatgtcaagattacataattaaaaatatatttgttatatattatacatttgcataatacatgatacatataactataaataatataaaaactgtaatattgcacatatataatacatatgtaattttaaatggtggcaaatgttatgaagaccaagcccaggaagtcatggtgtagaataacgggtggtgtcctggaccttagaccgtggacgaggcaggagggaaggacattccaagagagaatgtctgcctttcttgaaggatattgaagatgctgcctcagccccgggggaggggagggaccgctgttcctggaagagggacgcttggctcggaccctgggtttgggggagcccctcaggaccccatttagccacctgggaattgggtagtggcgtgcactgtgcagaggagggtgaaggttggaggagatgacgggcgggcctgcaatgcgctgcgtagggagcctgggcggtgccccacacactcgcccgctagctgcagggcttcaggaaagaggagcacatcgggacttggattcttcccacaggagggcgggttacatccccgtcagagggttgccgggagggcagataaaatcagacatgaggattcttgccctctggtgggaacccagaaggaggtcagggagggaaggtctcccttcctcttgttgcgggtggttggtctctgcctagatccgcagagggcagaaattagcgatgtctactacagcttcacgcccaggaaacgcgctgtatctgcaccgtccagtagggatggcatcaggcccgtggggtcactgagtcctggaggtgcagacggtgcagccagcttctcatgccattcaactttggataaatttaaatatcaatagctatgtgtgactctcatgctggacagtagatgtagaaagtttccatcatcacagaagactctgctggtcggtgctggtctagagggagcagtcagggtcctggggagtgaagggagatccccacagtggatgtgggaggactcagagccttctctgtccagctcaggactctaactcctcctccttctgattcctccctcccaggacccacgcagaggccgtcggacaacagtcacaatgagcgtgagtgatgggggccgtggagcatgaagctggtgtgtgcctcttggggaaggagaaagaggtcaggctttggggttgatcagattcctgctctgccaatggcagtctgtgtccctgtgcagaggactccagcactcaggaccccggtggtggaagaaggggataacgatccctgtactgcaggactattatttacctaagatattttatatattagtaagtctatgaaacgcacgtgacgtgtgtgtggtatacagtaggtgctcaataaatgcacactgctgaaatcctgtttctgtctttcttagatgcacctgcttcccaaggcctgaaagctgagcatctgtatattctcatcggggtctcagtggtcttcctcttctgtctcctcctcctggtcctcttctgcctccatcgccagaatcagataaagcagggtaggtctcaggggcagggtggggtgacctgggaagctgtcaggagaggctaggaagaaggtctccttaattcacaccccgactgtccttagggccccccagaagcaaggacgaggagcagaagccacagcagaggtgaggcccctgggaatgactcctggacctccacccagtcctcggccgccaggctgcccctgaggttcacttttatttttcctcttaggcctgacctggctgttgatgttctagagaggacagcaggtaaagggggaggaggagggacaggcctgggatggggaagtggggacttggtgccaatccagatgcaatgtggggggtggggggaagaatctttgggaacattctagaaggtcgtattatacattgggtgcaggatgtcatcggaagctgggggtgggggtctcaggcagatttgccttgcgacatcctccccagaaaactgaccatgtattttctccccaagacaaggccacagtcaatggacttcctgagaaggacagagagacggacacctcggtgagccttcctactagttattaaagtaccccaaatttagcagcttaaaaaaatctcagttccttgggttaggaattcaggagtggctcagctgggcggttccggctcacggcctgtcctgaggttgctgtcgagaggtcgcccagggctgtgtgcatccgaaggctcccgtgggctggaggatccacgtccaagacgctcacttccccggctgtgggcaggaaacctctgttcctctcacaggggcctctccacacagccggcttcccccagagggagggatccaaggatgggtggcagggaggggacagaagcaccatgtcttttggctcagcttggaagtcaggagtcttcccttctgccttgttcattgtcacgtaaaccaaccccaataccctgtgggagggctcttcacacggatgcaatttaggagagggtcctcagggcccatggagatggccgccacagccctccctccccacagcccctcgtctcaccctccaccaggcactccctcaccctgggtctctccctcttaggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacttacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcgccacagatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcatggaggctcacgcctgtaatcccagcactttgggaggctgaggtgggcggatcacgaggtcaggagatcgagaccatcctggctaacacggtgaaaccccatctctactaaaaatacaaaaaaattagccgggtgtggtggtgggtgcctgtagtcccagctactcgggaggctgagggaggagaatggcgtgaacccgggaggcggagtttgcagtgagccgaggtggtgccactgcactccagcctgggcgacagagcgagactccgtcaaaaaagaaaagaaaagaaaagaaagatttttaagaattcagcaaaaactcagccagctctttctatggggcagttgctaatttagttctaggcaaacgtggacacattaaattctcctacaaaccctc

SEQ ID NO: 84 - DNA, 11233 bp, Homo sapiens
tgagcccgcagttcctgagagaagaaccctgaggaacagacgttccctcgcggccctggcacctccaaccccagatatgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacaggtaaggcacgggctccaagagaggccaaaggcaaatgtgatgagggctttagggcacggctgagacgggacacatgtcctgggagggggccgggggtgatggactcaggagaggagctggaccagagcctgagcttccccaggaccgcaccttggatgcccctcctgatcctgcaggcccctcccctcaccagccctgacccacaggcctgacatcctcatcctgcctctgacgctggcattgtggcatgtggggccttatgactccttgttttggggcctgtcctaggcatggccggggtttagcaccatcccaggcctctccccaccagatgccagaagcacccactccacccatgcagtgagacaataacaattatctccacacattgttaaacgtcctggggggttaagtcctccccagttgagagccttaggtctacacaaccccgtgactctctcaggccaggccagggaggaagcacttcctggcgcaaaccaagggcagcagaggcacctgagcctggacagggagactcagcacacggcccctccatctctcatgccctgaggtcctcggagatccacatttagatgctcaaaagacaggagggacctccacgatggtccagaggccgggagggcaggacctacgtgtctggtgcaggccctggtgctccagggaagcccggaggtaggaggtgggacacggtctcttctcctccctgggtgggtctctagggtctctgagcttcagggtttccttcactctgtgcagagggaaccagttcctatagcatgtgggtttgtagtttctctttcgtgctgggttgaggtctccagctcctctccagcccctctccagccccctgtgggtcccacagccctgcccctcctctccctcccacttctctgctcacacaaggagcccaggaaccctctgtctcagagatgctgctgcctctcttgtgggcaaatgaagagagggacagtcggggctgggctgagcctcatttccccacagcgtcccaggccccactgtcaagatacaggctggaggtgctggagttggtgatggtgcaggagggctagtgcgtctctgtgccctgcagtgtcctttaaccctattacaactgaactgactctagccctgtccatggatgctggtttaagaaagggatcaatatacaatggaataatccagtggccacaaacatcccaaatggaaaagtgcaggagacacggggccgattccacctccttggggacctgaagaccaacaactgctccctgagcatcagagatgccaggaagggggatttgaggaactactacttccaggtggagagaggacagataagatggaattacaaaacgaagcagctctctgtgaatgtgacagataaggcacaggctccaggagacaccacagggaaaggtcatgggggtggcagcgaaagcctgggatggggcccctgccctgggagagggctgagggtgaagcgagttgggctcagggcagaagctgaaccagagcctgagcttcccccagggctgtaccatggatcctctgtcctgatcctgagtccccctctcttcaccagccttgacccacaggcccaacatccttatccccggtaccctggagtctggctgcttccagaatctgacctgctctgtgccctgggcctgtgagcaggggacgccccctatgatctcctggatggggacctctgtgtcccccctgcacccctccaccacccgctcctcagtgctcaccctcatcccacagccccagcaccacggcaccagcctcacctgtcaggtgaccttgcctggggccggcgtgaccacgaacaggaccatccaactcaatgtgtcctgtgagtgctgagccaggacgccctggtccctgatgagggggggacgtccctgagggcagaggatggggtcagggctcgacactgggtgctgggtcccagaatctgggctggttgtgggatcaggaggacgctggctccgccttccccatttatgcagctcctggggagacagggccagtgtccccagccctcacagtgatgcaggtctccatgtctttctgtcccagaccctcctcagaacttgactgtgactgtcttccaaggagaaggcacaggtaggatggagccccctccctggggctgggggagcagggccttcagctcagggcagggccaggtccctcctcatcctggactcaccctggtgatatgagactcccttgtagttgaacccaggcctcctccccatccttagcctctgtggccacctgagcacctgtcctcttccccccactcccctcagactcttgcacacacaccctcctcagccctgcagccaggacagggggaaatacatatagcaggagcagcctttgggcctcttatcttccatctcctgaatatgccacctaactcgtctttttattttacccaatagttttgagctacgttcttttggatacatgctataatcacgtgggcaaaaattttaaattcacagtaaaatgtgtccccagaatcaaccagggtctgtccaggctgtcctgagccttggtttgtgcacctggaagatctcagaggtggtttgatgtcagcagtgagactgtttgcaccctcttctagggatgtgtgtgattccactgtctgaatagtctctgattttgtggcatctcctaatggaagatcatggcactaattttatcctacggcacgaacactgcaatgaataatgttgtatctactcccacaaggaatatctaagtgtataggataaattcctaaaagcacattttaccagtgtcatatgttctttctgattttgaaagatatggtgaagttgtcctcaaataaaggtgggcaagtttacattcccaacagtgagcggtgaacataagtatgtccctgcaccagcctacatcactctctgttccattccccagtctcattctgtatccttcctccctgtttcaatcactttgtctctttgaacctccaactttttctctacagcatccacagctctggggaacagctcatctctttcagtcctagagggccagtctctgcgcttggtctgtgctgttgacagcaatccccctgccaggctgagctggacctggaggagtctgaccctgtacccctcacagccctcaaaccctctggtactggagctgcaagtgcacctgggggatgaaggggaattcacctgtcgagctcagaactctctgggttcccagcacgtttccctgaacctctccctgcaacaggagtacacaggtgggtaagggaggggctggaggaggagaacacacctgccccaccctcatgggccacccactgcccctgagcttcaagggggagctcagctctggtctgtgctcagctgtgaggcctggaacttccctgcaacccagggcactgctgtcctcttcctgccaggaaaggtgtgtaaggcaggaagaggggaggagtgggtcttggaggggaggagctggggcctggacaggtgtgtttggggagacacgtgccttgctttccagtgcctggactagggtgacacaagcaaggcactcacttctgggcacacgactaaaaaacaaaaaataaaacaactcagcaagcaagtgaaataatattggatgtgattatctttattaaaaactaaaaattattgcaaaataatttgacagtgaatacaaatcaaaatttcaaatacaggcaggctgtgcttaccactctcatgcctcagtgacctcaggagttgtcccttcctcctccctcccattcttgccctttgtttctgggaagggggattagggtacccaagttgggggccttataggaagtgggaggagaagagacccagttcttggagttggatcaccaaaacaattccaatccatcctcaggcaaaatgaggcctgtatcaggagtgttgctgggggcggtcgggggagctggagccacagccctggtcttcctctccttctgtgtcatcttcattgtgtgagcactgaccctagggagggagggagagtcctgggggagggcggactgggagcaggatccctgaagccagagctggaagggactgcatgggtcaagagcttggggcaagaatgagctcacgggtgcgtggcaagaatttcaagagcgcccttgtctgtggggctccacatctgtggtgaaccttgggccccaccacccaggaggcaggagcctctgttttcaacactggggtctctgggactggaccaccctcctcccacctcagttacccctccagcgccccaacaggaaatacagggcaggggttggtctgcccactgcaccccgatctgaccacactgaaaggctctctggtctcttcactcagagtgaggtcctgcaggaagaaatcggcaaggccagcagcggacgtgggagacataggcatgaaggatgcaaacaccatcaggggctcagcctctcaggtgagtgatatgggcgtctccacacccagcatccagctgggacatctcccacaggatggcctccaggatttctctgcttatcatggccaaaattatctcctcatctcctcctccttcccaccatccagcttctcctgcaggattccccatcttgctgactgcatgacagtccctcctacctactttctctcgggccaggcatggaggaggagttatctcctctctgtcctccctttcttctctatagctccacattcaccaaatcttgtccatttttcctccctaagaatggctagcattgctcccacccccaccaatcctaaactctctcaatgctgaggcctgaggatctctgtcttggacttcctcacctccctgcctcttgtgtcccctgccctgatgggaggaatcattcagaagccatcactgatcagtttctttgcatctggacagctgttcccacccccaacactgtctagagcagaagccagaaaatactatctggaaaggccagataggaaatatttttggctttctggcctacacagtctcattgcagctcctcaactctactgatgtagcaggaaatcagccgtagaccatgtgtaaatgattagctggctgtgtgccagtaaaactttatttataaaaacaagctgtgggtagaatttgtcccaagggctctagtttgacaagccctaacctagagaaaaagcccaaacttcataactgcagccctgcacattctcgtctcttaaacatctacctctctagcagggctggaattagtgtgagatgagtgaggtcctggcctagcatgcaaaatttaagaaggtgccaaaaatctcagtaattgtgatagttttaaaaaaaactcttattttaggtttgggggtacatgtgcaggtttgttacatacataaactctggtcagaggggtttgtggtacagattattttgtcacccaggtcctaagcctagtaccccacagttatttttttctgttcctctctctcctcccaccctccaccttcaagtgggccccagtgtctgttgttctcttctttgtgttcatgagttctcatcatttagctctcactgataagtgagaacatgcagtatttggttttctgttcctgtgttcgtttgctaaggataatggcctccagctccatccatgttcccacaaaagacataatctcattcttttttatggctgcacagtattccatggtgtatttgtaccatattttctttatccattctgtcatggatgggcatttaggttaatttcatatatttgctattgtgaatagtactacaatgaacatttgcttgtatgtgtctttatggtagaatgatttttattactctgagtataaaaccagtaatgtgattgctatgtcaaatgatagttctgcttttagctcttcaggaaattaccatactgctttccacagtggttgaactaatttacactcctgccgacagtataagtgttcccttttctctgcagccttgccagcctctgtgattttttttactttttaaaagtagccattctgactggtgtgagatgatatttcattgtggttctgatttgcgtttctctagtgatcagcgataatgagctttttctcatatgtctgttggccaaaaatgtctgttcatgtcctttgctcactttttaatggggttgtttttctcttgtaaatttgtttaagttccttatagatgctggatattagacctttgcctaatgcatagtttgcaagtattttctcccattccggttgtttactctgttgatggtttattttgctgtgcaggagctcttaagtttaattagatcccatttgtcaatttttgcttttgttgtgattgctttggcatctttgtcaggaaatctttgcctgtttatccagaacgatattgcctacattgtcttccagagtttttatagttttgagttttacatttaagtttttaacccatctcgagttgatttttatatgtggtataaggaagcagtcccactcaatcttctgcatgtggctagacagttatcccagcaccatttattgaatcaggagtcctttccccattgcttttttttgtcagctttgttgaagatcaaattgttgtaggtgtgtggctttatttctgggctctctattccgttccattggtctatgtgtctgtttttgtaccactaccatgctgttttggttactgtagacttgtaatatagtttaaatttgggtaacgtgatgcctccaggttttctttttgcttaggattgccttggctatttgggcacttttttggtttcatatgaattttaaaattgttttttctagttctgtgaagaatctcattggtagtttgatagaaatagcattgaatgtataaatttctttgggcagtatggccattttaatgattttgattctttttatccatgagcatagtatgtttttccatttgtgtcacctttgatttatttgagcagtgttttgtaattctcattgtagagttctttcacctccctggttagctgtatttctaaaaattttattctttttgtggcaattgtgaatgggattgtgttcctaatgtgactcttggcttggtagttcctgatgtatagaaatactagtgatttttctatattgattttgtatcctgaaactttgctgaagttatttatcatttaagaagcttttgggctgggactacgaggttttctagatatagaatcatgcatctgcaaagagggatagtttaaattcctctcttcctatttggatgctctttatttctttctcttgcctgattgctctggccagaatttccaatactacgttaaacaggagtggtgagagagggcatccttgtcttgtgctggctttcaaggggaatgctttcagcttttccatattcaatatgatgttggctctgcgttcaccatagatagctcttattattttgagatatgttcctttaatacctagtttactgagagtttttaacacgaagcgatgctgaattttatcaaaagccttttctgcatctattgagataatcatgtgtttttgtctttagttctgtttgtgtggtgaatcacatttattgatttgtgtatgttgaaccaacatgaagccgacttgatcatattggattaaccttctgatgtgctgatggattcagtttgcaagtattttgttgaggatttttgcatcaatgttcatcaaggatattggcccgaagttttcttcttttgttgtgtcttcgccagattttggtatcaggatgatactggcctcatagaatgagttagggaagagtcagtcttcctccgtatttgggaatagtttcagtaggaacagaaggaggctcagatctgacatttattgtgtgattgaagagccttccaggcagagggaggagcaaagcaaggcccaggcacaggaagaggaaaggagaggagccatgggacatctgtgtgattagacagagggaggcaggactgagagcaggaaatgactttggaggagttgagcctatgtgaattgtgtctgactgcacaggctactgtgagcatttggagagttttgagcagaaggacatgatcagacgagattgggtccgttcagggtggtatagctgtagaccagaagaacatgatcaactttcattttcatgggattcctctggccactgtgtgcagaagagaccgtgtgtgtggcaggggaaggagagagcataggaggtagacaggaggctggtgaacatcccaggcagaaggtggtgttggctggaaccaagatagcagcagtggtagacatgactgtctcccagatgaattctgcagtggaacctactgggatttgttaatgaattggaattagaatgtgagccacagaaagggagcaagaattacttccagatttttgccctgagcagtgggaagaatggaggtgccaatcattgaggctgagaagattgcagaagaaatggatttgggaaagaaaaggaggagttcagattgaataggttgagttttgtgtgtctttggacaagaacgcgggggtttgaattataccactggatcaaagactatagtcaggagaaaggagtgggctgggggtacagatttgggagtcattagcctattgatggcatgaagccaacacagtggataagatcacaaggcaaaggtaaagaagaaaagaacccggggctgctctgatatttaaggtcagggagacctgaagcaattggcaaagaggttgccaagaaggtgaggtggacccagaaaagcatgatgtcctatagttgagtcaagaaggccttctgtgtagggaaggtgagcagctgggtcctctgctgctgaaaagtccaggaaggagaagactgcaaggtggacatttagactcagccacttaagtggtagtcacagtgaccttgatagtagcagtgcttagacttggtatgtgtgtgaatattaatttgagtaatcaagagagaatctggcaagcaaaatcactgacagttccatggagcatcttctgcacaggggagcagcagggaagggctgcgatgaaggaggaccctcccaggcagcctctgtcactctctgctgtgtgagtctgtattagtttcctgtggctgctgtgacaaattaccatgcatttcctggcttccaacaacacacatggattaaagttctgaaggtcacaaccccaaaatgggtgtcactgggccaaaatcaaggcattggcaggcagggctggttccttctggaggctccaggggaggatgcaatttctcaccctttctggcttctagaggcacctgcattccttggctcaagtcccttcctctgtttgcaaggcaagtagcctggcatcttccaatctctctaagccctcctcctttcacttgtaaggactcctgtcattccactgggcccacccaaataatccaggataacctccccatgtcaatatccttaacctagctccatctgtaaagtccctttagcaatgtaacgtaacagattcacaggtttcaggggattagggtatggacattttggggagcagttatacttcttatcagaggatataatttctttgactgagttgtcctccccataccaccgaactgtgagcttcctaagagcaggtgccccatccaaatcaaggccctgtaattctctctcacttagcctcttcctgcccatcttataattcacacatagatattcgtttgtttgacagtcatttttgccaaattccctcaattaaaaagtgagtttcaggaggtcagggccaacacctactgtgtccaccacagtccatccagcacccggatcagggcttcacacacagagggccccagcaggactccaggctttggggtcagaaggaagggactggattgggtcccggcataacagggagtttgggtacgctactttcttcatggagttgttgcgggaagttaataagattaataaacaccaaacaagttgctcaataagtgttaaatattgcaggaaagtataaatgaaggagatttctataaaatgaacgtgggatagaggcaggaactcatgaagtttaattctatacagaggaatatatccgaaccaaccaaccgatcaaacaacttgtgactctccctgccttatcctatttccactgctctgctctgactctcttctctctctccattcagggtaacctgactgagtcctgggcagatgataacccccgacaccatggcctggctgcccactcctcaggggaggaaagagagatccagtatgcacccctcagctttcataagggggagcctcaggacctatcaggacaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtg

SEQ ID NO: 85 - DNA, 16141 bp, Homo sapiens
tagggcctcctctaagtcttgagcccgcagttcctgagagaagaaccctgaggaacagacgttccctcgcggccctggcacctctaaccccagacatgctgctgctgctgctgcccctgctctgggggagggagagggcggaaggacagacaagtaaactgctgacgatgcagagttccgtgacggtgcaggaaggcctgtgtgtccatgtgccctgctccttctcctacccctcgcatggctggatttaccctggcccagtagttcatggctactggttccgggaaggggccaatacagaccaggatgctccagtggccacaaacaacccagctcgggcagtgtgggaggagactcgggaccgattccacctccttggggacccacataccaagaattgcaccctgagcatcagagatgccagaagaagtgatgcggggagatacttctttcgtatggagaaaggaagtataaaatggaattataaacatcaccggctctctgtgaatgtgacaggtaaggcacaggctccaggaaaggccacagggaaaggtcatgggggcggcagggaaaggctgggatggagcccctgccccaggagagggcttagggtgaagcgagttggctcagggcaggagctggaccagagcctgagctccccccagggctgcaccatggatcctctgacctgatcctgagtccccctctcttcaccagccttgacccacaggcccaacatcctcatcccaggcaccctggagtccggctgcccccagaatctgacctgctctgtgccctgggcctgtgagcaggggacaccccctatgatctcctggatagggacctccgtgtcccccctggacccctccaccacccgctcctcggtgctcaccctcatcccacagccccaggaccatggcaccagcctcacctgtcaggtgaccttccctggggccagcgtgaccacgaacaagaccgtccatctcaacgtgtcctgtgagtgctgggccgggacgcctgggtccctgatggggtgagcgtcaagcctggacactgggtgctgggtcccggaatctgggctggtggtggggtcaggaggacactggctctgccttccctgtttatgcggctcctggggacagacagggccagtgtccccagccctcacagtgatgcgggtctccatgtctttctgtcccagacccgcctcagaacttgaccatgactgtcttccaaggagacggcacaggtaggatggagctccctccctggggctggaggagcagggccttcaggtcaggatggggctggcttattcctcaacctggactcactttggcaaacagggatgtccttgtgggtgaactcagggcccctctgtatccttaggccccaaggccacttgttcccatcctcccatcacctcccttggactcccccacacacccccccctcagcctcaaacaagaagagggtggcattcacacagcaggaccaggctttgaggctccttctcatgtatctcctgaatacatctccacccttatctgtttatttctgatagttctgatctaagtacttctggacaggtgataaatgtccatgggcaaaaattcaaattgcagagcaaaggctctcctccgatgcctgcccccctccccagaaccaaccactgtccatccaggctgccctgagtctcggtttgtacacctggaggatctcagaggtggtttgacgtccgtagtgagactgtccgcaccctcctctagggctgtgtgtgagtccactgcatggatggactctgattttgtggcatctcctaatggaagatcacggcactaatttcatcctacggcaggatagaacaatcttgtatctacttccacaggaatatctaagcctgtgggttaagttcctaaaagcaaaatgtagctacattatatgttctttcttattttgaaagataagcccaaactgttctcgatgaagcggggagaagtttacattcccagcagtgagtggtgaaagtgtgtgtttccagaacttcagtctatgtctgtgtgtcagttgctgtcatcagtctctttctgtatccttcctttttctccagatctatgtatctctctgaccctctgtctctttttctacagtatccacagtcttgggaaatggctcatctctgtcactcccagagggccagtctctgcgcctggtctgtgcagttgatgcagttgacagcaatccccctgccaggctgagcctgagctggagaggcctgaccctgtgcccctcacagccctcaaacccgggggtgctggagctgccttgggtgcacctgagggatgcagctgaattcacctgcagagctcagaaccctctcggctctcagcaggtctacctgaacgtctccctgcagagtgagtgcaccagtatgctggggaggggctggagaggagaacacacctcctccacccttagtaactgctgagcgtggaccttcagagaggagctccgctctggtctgtgctcagctgtgaggtctggaacttccctgggacccacagcaccactgtcctcttcctgccagggaagggttgtggggtggggagagggcaggagtggatctcagaggggacaggatggggccggacaggtgtgtttagggagacaagcgcctttctttgcagggctgaactggagtcacacaactgagatacttgctttgagcatcaaattaaaaaaaagaaaaagcccagcaagtcagcaatcaaatgaaatcatattgcaatgcaataatcttttaaaaaaagtaaaaattgaatgcaaaacaaattcattaatggataaaatattaaaattgtgaaaaaaaaccccaaaaggaatggctggcacttgcacgcctcactggcctcaggaagagtctctccatgtcctgctctctctcattcctgttctttgtgtctggaaaggggaagtggaaatagaagtctaggaccctacaggaagtgggaggagaagagacccaattctctatgatatatcacaaaaataactcccatctgtcaacaggcaaagccacatcaggagtgactcagggggtggtcgggggagctggagccacagccctggtcttcctgtccttctgcgtcatcttcgttgtgtaagcatggaccctagagagggagggagggagagccctgggggaggacaggctggaagctggatccctgaagccagagctggagggacctggatgggtcaagagcttggggcaagaaggaggtcacaggtgcatggtgagaattccatgtgggcctgtgtttgaggagctttgagtctgtggcaaaccttggtacccactgtccaggagaagagagcctctgttctcaaccttggggtctctaagactggaccactgctttcccacctcagtcacccctgcagtcccttaataggaaacacatgggggtacctggtctgcccaccgcaccccaatctgaccacactgaaaggctctctggtctcttcactcagagtgaggtcctgcaggaagaaatcggcaaggccagcagcgggcgtgggagatacgggcatagaggatgcaaacgctgtcaggggttcagcctctcaggtgagtgatgtggactctccacagccagcatgtagcctggacacctcccacaggatgacccccaggactaatcagctgggcgtagccaaagttacctcctctctgttcttcctttcttctctgtagccccaaatcacaatgtttggttggtttcctcccctaagaacagcttttattgtctctgctccctatcctgacccttcattgctgaggcctgaggatctctgtcttttgttccctcacctgtctgcctgtctcctctcctttcctgcctggggggactgtccagaagacatcatcgtccagttcctctgcatttgaacagctgttcccccacccctcaataccgtttagagcagaagccagcaaatactatctgtcagggacagatagaaactattttcggcttcatgggccacacagtctcattgcagctcctcaaatctgctgttgtagcaagaaagaagccatataccctgtgtaaacaaatgaatatggctgtgtgccaataaaactattcacaaacataaagagtgggctggatatgactcagatactgtagtttgacaacccctgatctagagtaaaaatcccaaactctatagcctgcagcagtgcacattctgactttttttgtttttttttttttttgttgttgttgtttttgagacagagtcttgctctgtcgcccaggctggagtgcagtggtgcgatctctgctcactgcaacttccaccttccgggttcaagccattctcctgcctcagcctccggagtagctgggactacaggcgcctgccaccacgcccagctaatttttttgtatttttagtagagacggggtttcactgtgttagccaggatggtctcagtctcctgaccttgtgatctgcccaccttggcttcccgaagtgctgggattacaggcgtgagccactgtgaccggccacattctgaccttttaagcacctacctctccactagggcaagaacaagggtgaagtgagtgaggctgttgcctcaagtgcattttttcgtttgtttgtttttgttttttgagatggagtctcgctctgtcacccaggatgtagtgcagtggcacaatcttggcttactgcaacctctgcctcctaggttcaagcgattctcctgcctcagcctcctgagtagctgggattaaaggtgcacaccaccacacctggctaattttgtatttttagtagagacagggtttcaccatgttggccaggctggtctcaaactcctgacctcaggtgatccgcctacctcagcctcctgaagagctgggattacagatgtgagccaccgcgccccatcctcactgtctgctctgactcacttctctctcccatgtctcaggggcccctgactgaaccttgggcagaagacagtcccccagaccagcctcccccagcttctgcccgctcctcagtgggggaaggagagctccagtatgcatccctcagcttccagatggtgaagccttgggactcgcggggacaggaggccactgacaccgagtactcggagatcaagatccacagatgagaaactgcagagactcaccctgattgagggatcacagcccctccaggcaagggagaagtcagaggctgattcttgtagaattaacagccctcaacgtgatgagctatgataacactatgaattatgtgcagagtgaaaagcacacaggctttagagtcaaagtatctcaaacctgaatccacactgtgccctcccttttatttttttaactaaaagacagacaaattcctacctctctgtaccttggtttcctgctctgtaaaacaggaatgagaagccctacttgcaaggttgtggtcaccattccaggagtcacatcccgttagagctcctggcacaggtgtatgccgagcactgatggatcgctgtgctttgaacacaaaggtcctgctgggaacctctcctgattctggtggcaactagtacttatatgtctgtgtcacttgcctgcaaaatagcgattctgcaactttccaggaaataacctcagcctgcaaatcaggtctaggtagcatctggatcctgcccacctcttcagcctcatctgcccaccctgtgactgctaggccgccttactctctgcagtctacgtattgtgcacagtccagtgggaatctttaggacacactgagctctctccgcactgctcacagcccatccatggctcctggatcctgaacctcccatcacatcctcttcgtgacatcactctcccacttcagtccactcctccatcttcaccacttaacccactggtccctctggtcttttccaaatcatttgcaacatgccctgttggttcatacctcagtccttgcacactggggaccctcctcctagaacgccctcctcctgggccttcttctgtctctgtctttgaaaatggagttcaaggattggacttctgggttgagctgagggagagagtgaagcagcagctcatgatctccctcctctaaagccaaacccagggaatgagaaacgtttccaaaggggcacaggatcatctggcaaattaaacaacatgatccaaaaaaatttacctacatgcagcacccgaacgaggaaagggacatctcacaacaatcactttatgcagtagccctgataggaagaaatcaaaggactggaggaagcactaaaacttccctaaatctagactcttgcccatttacggcagcatcaaaaaaccgtaaagtaccaaggaacaattttttaaaaatcatggccgggcacagtgtctcacgcctgtaattccagcactttgggaggccgaggtgggcagatcacgaggtcaggagatcgagaccatcctggctaacatggtgaaaccctgtctctactaaaaatacaaaaattagccgggcgtggtggcgggtgcctgtagtcccagctactcgggaggctgaggcaggagaatggcgtgaacccgggtggtggagcttgcagtgagctgagatcgtgccactgcactccagcctgggagacagagcgagactccgtctcaaaaaaaataaataaataaataaataaataagtaaaaaatcatatccgagctgggcgtggtggctcacgcctgtcatcccaacactttgggaggctgaggagggcaaatcacttcaggtcaggggttcaagaccagcctggccaacatggtgaaaccccatgtctactaaaaatacaaaaattagccaggcgaggtggcgtatgcctgtagtccttgctacttgggaggctgaggcaggagaattgcttgaacccgggaggcggaggttgcagtgagctgagattgtgccattgcactctagcctgggcgacagagcaagagtctgtgtcaaaaaaaaaaaaaaaaaatcctatgctatggtttggatatggtttgtttggccctgccaagcctcctgttgatatttgatgcccagtgttggcggtggggccaaatgggaggtgttcaggtcccgggattggatccctcatgaatggcttggtgctgtcttcaaggtaatgagagagttctcactctgttacttcctgtgagagtttctccaagagctgggtgttaaaaagacattggcacctcccctccccagcccgtgcttcctctcttgccgtattgtctgcacatgcagacttccttttgccttccaccatgagtggaagcttcctgagaccctcaccagaagcaaaggctggtgccaagcattttctatgtggtgcagaactgtgagccaaataaactgtggggggtgcacggcaacatattcaagcttatgtacaaggcatttgaggtcgaggcatggaaaaatactgaggcaccgtgtgcgtgttgtttgtgcatgagattgaaactccttgaccctgaaaacagggcaaggaacggaatgtgtgataaggagcgcggaaagcagcctcctgagactgtagtctgagtgtttttaccaggccatatgtgtctcatgacccgaccgcaaaaggccatctggtggacattttggtttaacaaaccctttcgagaaacacttggcggacggattctggggcggcactctttcagagatgctgctgccgccgcatcccgctcagctggaattgtctgagtgcttcattcttggcgttcactgcagctacaagctgtataaacctcttttctttataaattacccagcctcagatattactctatagcaacacaaatgaactaagataacacggaatgcttctgtactgatgaatatagaacatttttgagagacttaaggaaggcccaaatgaaggaagaaatatatcacgttcatggattagaaggcaaaaatggttaaaatgtcagttgtctgcatattgatttaggtaatccctgtcaaaattcctatatatatataaaatatatgtatatgtgtatatgtatgtacataagtatagatgagtgtatatgtatgtatattgtaaatataagtttatatatatacatatatagttataaattgataagttggttctgaaatttatataaacacataaaaacctagaataaccaaatcattgtgataagaaacacatttagagaaggcagactttaacactagagtaatacagagagtgtggtgtggactagagtacagtctacaaatggacccacacatatacagtcaactgaatagcatcaagtctattcaattgggacaggaaagacttttaataaatgttggtaggtggtcgggcgcggtggctcacacctgtaatcccagcactttgggaggctgaggtgggtggatcacttgaggtcaggagttcaagaccagcctggataacatggtgaaacaccatctctaccaaaaatacaaaaaaaaaaaaaaaaaattagctgggtgtggtggcaggcaactgtaatcccaggtactagggaggctgaagcagaattgcttgaacccaggaggcagaggttgcagtgagccaagattgtgccactgtactccagcctggcgacagagtgagaccccatcttgaaaataaataaataaataaaaaataaatgttagcggaacaagtgaaattagggttggtaaaaacgagtgttgagctgtttctcacatcacacgcaaaaaattagcctgaagcgaatcataaacctaaaagtaaaagcggagactataatgtttgtacaactgtgctgtttgatatggtaaccactagccacatgtggctactgagcacttgaaatgtcctacatttagtgagaaaataatataaaaatctaagtaattaatatttaaaattgattacatgtttccatgtaacggcataatactcatcaatatataataacaatatataatacatgcaatagcttgaataaattttgaaaacatcttgagtcaaagaagccagatgcaaaagaatacatgctctgtagtttcacttatatgaagttcaagaacaggccaaactaatctacaaagacagaaattcataacagtgactgcctcaggttgggagtgggatttggggattaacgtgaatggcacacaggggaactttctggggtcctgggaattttatttctttcttttctttttttttttttttttttttttttttgagaaggagtctagctctgttgccgggctggagtgcagtggctcactgcaacctccgcctccagggttcaagcgattctcctgcctcagcctcctgagtagctgggattacaggcacgggccaccatgcccagctaatttttgtatttttaatagagatgaccaccatgttggccaagaccaccatgttggccaggatggtcttgatctcttgaccctgtgatccaaccacctctgcatcccaaagtgctgggattacaggcgtgagccactgcgcccagccagtcctaggaatagtctatgtcttaactgggatagtaattatgtggttatgaatcaaaacacattgaatcacgcaaataaaatctatgtattttactgtatgtaaatttacctttcatgaaagagaaattaaaaactcttaaatgatgaaagcttttggttccctcttttttattagactagctagtgatctatcaatcttatttgttctttcaaagaaccaactttggggtatactgatcttttgtaggaattttcgtatctcaattttattcatttcagctctgattttggttatttgttttattctgctagctttggggttgacttgctcttgtttttctaattcctctaggtgtaatgttaagttgctaatttgggatctttctaactttttgatatgggtattctggtacattgcatctttactttcctggatgctaggaccaaactggactagagtaaattacgtggttccttctgtcccaaagaaagatgtatttttaactcaggagctacatcagccccatctggctacattaagcatcccagtctcctctgcgtctcatgctggactctatgcaaaagggacagccagcgaaagcattattgatatgtcaatattgagatgtgagaatttgatcctgtcattatgttgttagctggttgttatgtagacgtgattgtatagttgcttcataatgtcagtgggttatacacttaaccacttaacaccactttctgtggtgtcatgtaacattctttcacttctgtgtttggcactcacttaaggacctcttataagtcaggtccggtggtaatgaatttttttcagtttttgtttgtctgaaagggattttatttatccttcgtttatgaagcttagtttggcagggtatgaaaatcttggctgaaatttgttttctttaagaatgctgaatataggccccgaatgtctttggcttatatgatttctgctaaaagctcttctgttagcctgatggggttccctttgtacatgacctgcctcttccttttagctgcattgaatattttttctttcatgtgaaccttagaaaatctaatgactctgtgtctgggggatggtaatcttgtacagtatcttcctggggttctctgaatttcctgaatttatatgtcaacctctctagcaaggttggggaaatttttgtggatgatatcctcaaatatgttttataagttgctgcgtctctctttttccaggattccagtgggccgtaggtttggtctctttatataatcccatatttgttggagggttttgtcattttttttaattctttttttaaaaatttttgtctgattgggttgattcagagaactggtctttgagctctgagattcttttctcagcttaatctattctgatgttaatacttccgcttgtattatgaaatttttgcagtttttcagctctaacagatcagtttgattctctcttaaaatgattattttatctttcagatcttgaatcattttattggatttcctacattccttggactgggtttcgagtttctcctgaatctccgtgatctttgttgccatccagattctgaattctatgtctatcatttcagtcatttcagactcattaagaacattgctggggagatagtgtggtcacttgaaggtaaaatactctggcttttggatgtgtcagatttctttcactggttcttcctcatctgtgtgggctgatgttcctttaatctttgaagttgctgttctttggatagggctctttgcttttatattctctgatgcccttgagggtttcacagtggtataacttgggcttagacaactgcatttgtttctggatgatttcaaggggcccaggctcaactcagcactcctgagctgcatgctctaactacagggacctgggacctggcccatggcttttttttttttttttcctggcccttcaaggttaagcacctcctatgctggaatggccaaggtgttccgggtccactggcaacaacgctccaataggggttgctgacaaagcattttggcagggtggccatgggtgatgggagttcctgcacgtggtgtgcatcagctgcagggtggccgtgggtcttgcaaatctgcttgctaatgttatgcctaagatcacgttataaaagactaacttgtgcctcattctctctctcgctgtctcttgctttctcactttgatgaagctggaggccatgttgtgagctacctatggaaaagcccatggtttcataacaaagctgattgagtagcaaatgttattttccaggcaaaaaaattaagtggtaagttcttctgaatatgcaaggcagaaataattccagtgtttcataaactctttcaagtatgaaagacatatcagccggggtgactctggggagttttttgctttctctgttcctcactgagatctacatggaagggaagggaaaaacactcgtctctaaaaacctcccacctctggcacccataagtctgaagttgcacttatgtgaggaactaccactttgcccctacccactggcttcctgttggggttactcttgtttttccaagccagttcttcccacgccgagggaacttatgatgagacagccccaggaaagtgcctgacacgtattccctgggctgccccttcccttccacatgcttcctgagtgagcacgtccaccttgtggctcagctgtgagccctgccctgatgtctcccccactttctgccccttgagcctcttcttggacatggtgcctccatcccccacccccgactcttcagttatcccagtcaggacccaggacttattccagttgcctcctgttttcaaccaccccatgcatgagtcaggggttcctgtaaacttcacttccccaaaaatgtctgccatcatgcccttcctcctccctccattccctgtctcctcccctctatctgcatggccaggcccttttcggtcttgacgattgctccatttcccacccaacatcccggtctgcagcctctcgcctccatgctgtggccctcgcagcacaagccctgaaaaattttcctgcatccagagctgacactgcctcttccctgctcagggccctctctggttccctggaaccctcagtccaagctgttcagctgatcatgtcccagcacctccaatttccccctggaagaccccacacatatttgcagggcccttcatctgcccggctgtctcatggcctgtgctttttcccctccacctgaggtgcccttagccacctgttaatatgaccaactcccccactagtctcagctcagcctctttccctgcggggtctttcagctttttgaactcctggatttgcattcgtgagtatgtgtcacacagtcaggtgtctcctctttctgtttttgtggggttgtgggagagacagcctctcagctccaccctccccgctctcactgttttcctcactcaaccctgaagaccctgagcaatggcacctcgcttcctgtcctggagggtcagtccctgggcctggtctgtgtgactgacagcaactcccccgcctcactgagctggtctcaggagggaagaacactgaatctctcccagctctcagcaactgggatcctggagctgccccagaaagggactggaggtgaaggcgacctcacctgtgaggctcagcacccactgggctcccagcacatttccctgagcctctctgtgcagagggagctgctggacgggtgctggggcaggcagcctggtcaggtgttgggctgtgagaggggcctagacctaggaacaaaacctcaccctcttctccccactcccaggaagtccctctgggtgcagatgtgcgagtgaagatcaggagggctcccagcccctggttctcacctaatcaaggggcgctcatgggcactggtttttccttcacccgtggcctcacctggggctactactccaggtgagcagggctgctcttttctagggaagccgagggattggcccccgagttccagatggggctgagctgtcctgtcccgcctgagttagaattgaagtggccgatgctaatctgaggccggtgttggctctacaggtgtggaggcccccaggggagcagggctgagaggcctgactgagcccctcctgctcaagacagaactcagatgaggacacccagccctgcgggacagatgcaggacatcactgtcagccatggctcagcccttctgaccactgagatgctgcaacttcccctcctgggagggagcgattgggcaaacacttaccctttgctggaaatctcaaggcacagcacgggtgctcacaatctgaatacagaacgaatgaatgaatgaatgaatgaatgaatgaaatgtctttccttatctcatgtgagagacttgacagttctttcactctccaagtaacatcagcttcccctgtcccagcccagtctgtcctgggcagacaagattaattaagtggctcctgggcagacattggtgcaggagacagggcccaggagacctgtgtgatttgggcaattcgctttctatctctgtccattcatgctgctacaacaaaataccataaactggccagtttataaacaacagaaattcatttctcacagttctggaggctgagaagtccaagaccaaggtgccagcaggtttggtgtctggagacagtttgcttcctcatagatggtgccttttccttatgttctcatgtggtggaagggctgtgcaaattcccctgggtctctcagatgaggggactaatcccattagactaatcccagagtcctcatagcctaatcgcctcccaaatcattataccttctaatactatcacatggggattcaaatttcaacaaatgaattttgaggtgacatattcagaccatagcacttgtcactgtggaccttgatgtcttcctctccgaactgtggaagtgggagtagagggcttgtcagctcccctgggtcatatgtggttcacaagttcctcctttctacagattctgtggcttccttaagtctctccttcccatttttttttctgattttaattgcaaactggggactgtgggaaagagatgggccatggtctagcccttctgaggcaggaggagcatagaccaatggggcaggagcatagcaaagagaattaaaagttggataaagggcagaataagtaaaagcagagagcagaagcaaggtgaggggacgggtgagcaagaagcaagaggcagaagttgagcagccaaaacaaaaagtaagatagagaagtgagcaaggacacccgtggccagcaggatctggaccaaaccagtaaggggcagttcttcagagctatgcatgtgcattagagagaaaaagtatccttaacatgaccctgtatgataatcagctcattaaagttcatgcatatggactgcatattatccatgtacttaaaattatgggatgggtcaaagtaactaagcaacatacttaaccatcaaaaaggcaggcactggccaggcgcggtggctcacgcctgtaatcccagcactttgggaggccaaggtgggcggatcacttgaggtcaggaattcaggaccagcctggccaacctggtgaaaccccatctctactaaaaatacaaaaattagccaggcatggtggcgggcgcctgtagtcccagctaccagggaggcagaggcagaagaatcgcttcaacccaaaaggttgaggttgcagtgagccaagattgtgccactgcactcaagcttgggtgacttcgtccccacctcaccaccaccccttccccccgaaaaaaggcagacactggatagagatttggcagccttgggaagcgaagaaaaacaaaaaaacaaacaaacaaacataaaaagacccaaagtaatgctgatctcacctcatagagatcagttcgctctccctctccaagagtgtgatactgtgcttaataaactgctgcttcttgctttgctgtctgtgtgtgtctcatccaattctttgtttaagacaccaagagcctggaactgcatggcaccatccggtaacacttctgcccactgagatactgcaaatatccttatggggagagagtggctgggcaaggaggaggcgcccaggaggcagattggtctgcaggatgagatactagctgcaaatgcagggattggaggtgagggcggggagtggcttcggacgcccaaacccagcatcttcctctctcaatcgttacagccaaatgatctctaggttatggacaattaggggacagtgtgggctgagcagatcaatgcagttgtatggaagaaaacagactgggattttctatgtatacaacatcttcaggaaaacctacgtgaagttagaattttcaaggcagcatgtgccgatgataaaactacatagaacagcaggaagactattatcattaaagtgaggctaggggctccttcaggagggagcgggggcatggccaataggaaaggggaatgtaagg

SEQ ID NO: 86 - DNA, 49055 bp, Homo sapiens
acttggacgcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggtgagtccccgccgcggtccctggctggggaagagcgtgcctggcgcctggagagggcagggagagagggggacacggcgggggtgcgtggcccgggtcgcctgcggccgggcatgtccgggcaagacgcaccagtcgtcggagtcgggggaagagatgggtccccgggttgggcaggagcgacctgggccgccagggaacagagcgcgcgctccacttggtgtaaattcccgaatccagtgggggagggcgacaaggagggaattcccgagtaagctgcgtgaagccacggagaggtcgtcggactttgattttgttttctttccttactttctgtttctttctctttttctctttcttcctttctttccctcccttccttcctcgctcagttcctgccttaatttctttttcttttgcgccttcgaatgaattcctaaaggcgctcattgcagatcgctttgaacctgcggccggcgaagaactcccctgtggtcgctgcggcccagtggttccgttccgtgcgcgggagtcgtcgcgggcgcagctggagaggccccttcccctccttagcggctgcgcccctacgcgtgcggggccgctcatcgccaatgccattgtttggggttccttgggaaaacgagatttaggagaagggagttgtggcacttggggcctgacctgcttgataatagcagctgcattttggcctgggaagagcctttcttgccacctcttggcaagtatccgtgataatggggaagggacaaagagtcggctttgtagggaacagcatggtgtgctcagcgcctggaactgcgcttggggccaggagaggttctgaatcatcacattttacagaggaagagaccgcagctcagagtggggaagtgtgtgggcctagacctaactcaagactgtacagaggggctggaagggagaggaggaacagtgaaaggaaggtcaagagaatgctggtgttgacctagaagaatgtcagtgtgaagcattggagtttcatgggatattgttacacacctcatgttttcactgtttccgccccacaccacagtatgtccttggtctcacctctgagtggagggaggacctaactgtcctagtgaggagagtgtacaggggcctctgcctccccctcctgctgtggtttctgtgggcctaggtccccagggcatcttgcctctctttgggtggtggatctttggtctctggctgcttttaaagatttttcttagcactggtttgcagtgatttggtttgtttgctctgttgtggggttttttttttatctctataaagaattttttggatttttggctttagactttcatgttctttctacttggaagatttttctgtaaagaaagccacaactgggttgtgttgaatttcttggatttggggttttagagtttatgttctccttggagacttttctgtaaagaaagccacaacagccgggtctggtagctcatgcctgtaatcccagcactttgggaggccgaggcgggcagatcacatgaggtcagggattcgagaccagcctgaccaacatggtgaaaccccgtctctactaaaaatacaaaattagctgggtgtggtggtgggcacctgcaatcccagctacttgggaggttgaggcaggagaatcacttgaacctgggaggcagaagttgcagtgagcagagatggcgccactgcactccagcctgggagacaagagcaagactccaactcaaaaaaaagaaagaaagaaagccacaacagagttatgttgaatttcttggatttggggttttagagtttatgtttttgtttgtttgtttgtttgttttgagatggagtcttgcctctgtcgcctaggctggagtgcagtggtgggatctcagctcactgcaacctctgcctcctgggttcacgccattctcctgcctcagcatcccgtgtagctgggactacaggcatgcaccaccacgcccagcgaactttttgtatttttagtagagacggggtttcaccgtgttagccaggatggtctggctcgtgatctgcccgcctcagcctcccaaaatgctgggattacaggggtgagccaccacgcccagccgagtttatgttctacttggaagattttcagccattatttcttcaaatactctgtctcttctggtgactgagatcttattatatttacgttagaatgttagattttgtatcagagctaacttagtatctgttcttttttttcccccatcattttctatgtttcactttggacatttccctgtgagggctcttcaagttcattgatctgcttctgcagaatctaacctgctgttaatctcatctactgtatatcagatatatattttttgaactttagaagttctcttttggcatttttaatatcttccatctatttcctggtcatctttgtgtttttcttttttgagacagggtcttactctgtcacccaggctggagtgcagtggcacagtcagagttcactgcagcctcaacctcttgggctcaagtgatcctcccacctcggcctcccaagtagctgggaccacaggcacttgcaaccacacctggctaatttttgtatttttagtagagacggggtttcaccatgttgcccaggctggtctcaaactcctgcgctcaaggaatcctcccaccttgtcctcccaaagtattgggattacaggcctgagccaccgtgcgcaacctatgattttggtggtggtgttttttgtttttctgttttttaaatattcttgagtatatttgtaagctttagatgacctgttttaagttatttaatctatcaacaccattatatctgttattacggccactgtttctgttgattacattttttttcctgcccatagggactttttttttcatgcatagtaatttcttattgcttgacattgtgaattttgctttcttgggtaccgaacatcactgtgttctttcaaagtctattgggcattattctggtcacagaaaactgaggatcagtttgctcctctgatactagcttttatctacatataactatataccttgtgttcagttgccttattcaggggctcatttagttaactactaaagttatagtggttgacttctgatggtaactcgccagcaccctggcatgcgttctgtccactgtgggaaggggaacatgcagatctcccagccctgagtggtccacaatctagtctctccttccctgggtggcttcttctcaggcacctagagtcagtctcagcagacactggacatgtcttctgcaaggatccagagtcctccaggcagctgcttctcccagtctctgccctgcacttggcctctgggagttcctgcctgtggttctcaacagagactacagagctctacagggtcctctgcccctgctgtagctggaggctgtccttacgcagtgagctgaggccacagctagtctcactgcatgtgcttggcggcggggacaggagtgattcattcatcaggtagaggaggaaccctttactctgggaaaatctgtgcctgggttggggaaggacaaatgagccctgtgtgaatactgactactccctggagcccacagtctggtggagcaggtgacagcagggacctaaataactatcaggaagcatgaggtcccaccactgtcacctcccccacctccagagtggctgtgctggctccagagatgtcatccctccatatttgactgacagagggaggctgtgcagtcccaaggctccaggtcatggtagtttggccaggataatatggtttgcttaaaatcaacattgagggtaatgatcgtactaatcagagcatgtgtttaaagttctgtgttttaagcactttccatacatattaacactttcagttcacacaacaacctatgcaggaactgtgattatcctgggcagttttaaggatgtgggtgactcagagaggaaagaagaggttactcgggttaatttttgacgagaaatattagcaggttttatgctcaaacttggtgtaaagcaaggagcctgaatcacaggtgggtgagtcacaagacagggaaaccccgccaatggctcatgtccgggaggaggcagggtccctagaattcaatgggacaagaactgaaataagccaaacccctgacctcccttcttcttgttttccttctctctcttaaccatgcccatggacacccccatgagcccatttctgtggcccaacacagctgtgcatctctggccacacgcccattctccctcaatcagagaggcccacggacggcacagcctcgtcctgcacagcagaaagagtgaatggtgatgaatggatctatattatttcaactctcctacattttgtaatcatattacaatattaattcagcagtacctctcttgtttttactcccctcccccattacactggattcctgtctgtctgggattctgtctgtgtgcactctttcctctatgtccactactgtccctgccaccgatggcatttgtcacctctgcctgggcagcccctccagactctttgcaagttcatggactttggggttaatgatggctgtgcctcagctcctgtgaatggaaactgtgctaaggaaaggaagggccgtgccatgttcccgatactccacggctccttgcatatgcggtcgccaggcgcctacatgccttccatgaatgaatgaatgagtaacgtggattctaggaagctgcactaacccagacgttgtgtcctcagcctgctcatagagtgtgttaaacgtgagaggtggggagtgtggcaggcaggctgaggacagaacagaggatctgaatagagtacggaggatcacccaagtccagagtcaccaaggccattgtcaagttttccccggggacatccctcatcagatccacccattaaagatcattgttcacccagtggagagtggactaggtgggtgcactcaggtgtggcctggacagcattcgggatgggtcctagtggttagggtgagggtcaggttgcattatcgtgaaggaggcaagtggcagctgaggcagatctgagggaaatgatgataacgcaggccggtgatgcaatgggtttggtaagaagaggaaagaggtttgtggtggattctagtgtttctaatctgagacttgggtgaggtcattaccaaataagaaagagtaaatgggcataaatggctttaagaattaggaacctgaatgtgctattggagacagtatgggcacgtcattgctcatagacctgcagtacacaaaatgctaaaagatttcaatctgaatagagatgaaatgaaatggaaacatggatttttttttttttttttgagacagtttcactgttgctgcccaggctggagtgcaatggcgcaatctcggctcactgcaacctctgcctcctgggttcaagcgattctcctgcctcagcctcctgaacagctgggattacaggcgcttgccaccacacccagctaatttttgtatttttagtagagaccgggtttcaccatgttggccaggccagtctcaaactactgacctcaggagatccaccgccttggcctcccaaagtgctgggattacaggcatgagccaccttgcctggctgggaacatggatcttaaggaaagaaggaagatcatcaggaatagaaatatgaatgcacatataaagaatgattatttcctcttaatttcttgaaaatattcactatcaagtaatataacactttgtagggtttgtaacatatgaacatgcctgagacaactatagcagaaagaatgagtagtggagatgaatcaatctgtattatttcaagtctcctacattttataatattaccatattaattctgccatacaactcagtaatgaaaaggaatggagtactgatgcatatgaaaatatgaccgaatttcaaaataattatgctgagttaaagaaaccagacagaaaagcatatatagtatctgattccatctatgatatttatagccagaaatggtttaattaaaaaagaagaaggatcttaaatcaacgagctaagtttacaaatgtaggaattagaaaaagaatgaaccaaacctagagttagcattataaaggaaataattattagaagagaaataaataaaacagagaatagaaaaacagtagaggccggatgtgatggctcacgcctataatcccagcactttgcgaggccaagacaggaggattgcttgaagccaggagtttgagaccagcctggatatggcaaaaccctgtctctacaaaaaatataaaaagcagcctggcccgggggagcacacctgtgatcccagttactcgggaggctgaggtgggaggatcacttgagccccggagatgtaggttgcagtgagccaagatcacatcactgcactccagcctgggcaacagagtgagactctgtctcaaagaaagaaagaaaaagaaaaaagaaaaaccatagagaaaatccacaaaaccaacattgattcttcaatactattaattaaactgacagaattcactagtgaattctaacaagcttttaatgaagagctaataccactacttctcaaactctttcaaaaacttgaagagaagggaacctttcttgactctttctgtaaggccagcattgctctgatacccaagcagataaagatattacaagaaaataaagctatatcccagtatccctaactgatgcaaaaatcttcaacaaaatactatcagagagaattcaacagtaccttagatggattatacaccatgaccaagttggatttatttccggaatgcaagaatgtttgaacaaatgaaaactgaacaatgtaatacattgcattaatagaatgaagggggaaaaagacacatgatcatctgagttgatacagggaaagcctctgataaaattcaaagccctttcatgatgaaaacacccagcaaactaagaatagaagaaaacttccacaacatcataaaagccatgtaagaaaaccccacagctaacatcatactcagtgttgaaagacggaaagcttttcctttaagattaagaacaacataaggatatctacccacctttgccactcagcatagtactggaagttctagccaaaacaggcaagaaaaagaaataagagcatctggactgtaaaggaaaaagtaaaataatctgtgttttcagatgatatgatcttactggtaaaaaatccaaaagatttcacaaaaaattaaactgccaaaaataaaataatattaaatttttaaaattttgaaatttattgttgttcagtaaaagacagtacagattgcaatctgggagatttcaaaccaagtggtaagaaacttgccttacagcaggtatagtacaggctataaaggaggatgtattttgacaatttcatgattgacttataaatttatattctttttaaaggcaatcagagctgtttaagctgatttttctatagctgcttgatttaacttcactgaaccatattatgtcatgatgaaggtgtaaaacttatattttgtgggattttttatgattatagctaatgtttcagggatatcaggatgtcttaagttttggctacatggttatgggtaattgccgtggggtatatctaaactgtgtttttaatttttatttagtagtactaaaatgaattcatcaaagaagcggaatacaaaatcaactggaaaagtcaattgcatttctatacactaccaatgaacaattcaaaaaaagaaattaggaaaaaatccatttacaatagtatcaaaaataataaaataggagtaaactcaccaaggaggtggaagactagtacaatgaaaactataaaacattactgaaagtaattaaagaatacaaaaataaatggaaagatatgccatgattatgaattataagactaattatgtcaacatttcctaaagtgatctatacattcaatgtaatctctatcaaaatcccaaggacatttttgcagaaatgaaaaaatgtatcctaaaattcatatggaatttctagggaccagaatatccaaaacaatcttgaaaatgaataaaaatgtagtaggattcacacttcctgattttcaaaacttcctacaaagctgcagtaatcaaaacaggatggtactgacataaaagcagataaatcgatcagtggaatagaatagaggagccagaaataaacactcacatatatggccaaattatttttcacaaggatgccaagactgttgaatggaggaaagggccgtcttttcaatgaagggggctaggagaaccggatatccacattcaaaagaatgaagtgaaccttagcctaacattgtatttaaaaaatagctaaaaacaaataaaagatgtaaatgtaagtgctaaagctatagaactcttgaaagaaaatataggataaaaattctgtgacattggatttggcaataatttcttggatgtgacaccatggacataggcaacaaaagaaaaaataaacattttggacttcttgaaaatcagtaactcttgtgaatcaaaagatactattaactggataaaaaggcaaaacccacagaatgagagaaaatattttaagttatatatctgataagggcttaatatctaaaatatataaagaattcctacgatctaacaaaacaaaaacaacccagttaaaaatgggcaactgatttttataaacatttctccaaagcaaatatacaaatggtcaataagtatatgaaaagatactttaatcactaatcattagggaactgctggtcaaaacgacagagataccatcctatacccatcaggatgactattataaaaaacacacacaggccgggtgcggtggctcatgcctgtaatccccacactttgggaggccaaggcaggcggatcacgaggtcaggagattgagaccatcctggctaacatggtgagaccccgtctccactaaaaaaaaaatacaaaaaaattagcccggcgtggtggcaggcgcctgtagtcccagctacttgggaggatgaggcaggagaatggcgtgaacccaggaggcggagcttgcagtgagctgagatggcaccactgcactccagcctgggcgacagaacgagactctgtctcaaaaaacaaaaacaacacacacacacaataagcattagcaaatttgtagagaagttggaaccctcgtgccctgttaatgggaatgtaaaatggtgcagccactatggaaaacagtatgatagttcctcaaaagtaaaaacaggattagcagatgatccatcattcccacttctaggtatacgtccaaaagaattgaaagcatggtttcaaacagatatttgtacacccacgtttatagcagtattattcacaatagccaaaaagtggaagaaactcaagttggacagatcaatagataatgtggtatattcatacaatggagtattactcagccttgaaaaggaaggaaatactggcacatgctacacaatggatgaacattaaagacatgctcagtaaaatgccattcataaaaggacaaatgaaataggattccacttgaggtacctaatgtagtcaaattcataaaaaccaacagtagaatgttggatgccagcggttgtaaggagggaagaatgggaagatgaaataacttctgaggatggatagttgtgattattgcacaacaacattaataaatgtagtgtcactgaactatgtattttaaaagattaaaagataagtttcatgttatatataatttaccttagttttagatttaaaaaaacagcatttattttagtcactataacaattacacataaaatggaaatattgttgatttaaaaagccaatgcacaagctgggcacggcggctcacacctgtaatcccagcactttgggagggtgaagcgagcagatcacctgagattgggagttcaagatcaccctaaccaacacggagaaaccccatctctactaataatacaaaattagctgggcattgtgatgcatgcctgtagtcccagctactcgggaagctgaggcaggagaatcgcttgaacctgggaggcagaggttgtggtgagccgagattgtgccatggcactccagcctgggcaacaagagtgaaaatccatctgaaaaaaaaaaagccaatacacaattaaaatgggattctaaaacatactcaattaacattaaatatacaggtaagaaggaacaggtaaaaaatagaatggacaaaaattggtaaaattatagaactattttggctatagtaataattacactaactgtaaatccaccaaacactataactcaaaggtagatatggttagaaggatgaaaaagcaagacttaactacataatgtttataagagatggaatttttttttgagacagagtcttggtctattacccaggctggagtgcagtggcgagatgtcagctcactgaaacctcctcctcctgggttcaagcgattctcctgcctcagcctcccaagtagctgggattacaggcatgcatcaccatgcccggctaatttttgtatttttagtagagatggggtttcaccatgttggccagtctggtctcgaactcctgacctcaggtgatctgcccgcctcggcctccccaagtgctgggattacaggcatgaaccattgtgcccagccaagagatggaatttaaaagcaaaatgcaggtatagtaggagcaaatggatgaaaatagatataccattcaagtaataagcctaagaaaactgctgtggctatcttaatatcatatgaggtggattttaaggtaaagaatattataagacatgaaaagggacctttgtagtgttaagagagttaattcatctggtagacataataatcataagatatatgtcctcaataatagagcttcaaaataaatgaagcaaaaatttacccagcactttgggaggccaaggtaggcggattcacctgaggtcaggagttcaagaccagcttagccaaaatagagaaacttgtctctactaaaaatacaaaaatcagccaggtgtggtgtcatacacctgtaatcccagctactggggaggctaaggtaggagaatcacttgaacccaggaggcggaggttgcagtgagccgagatcatgccacagcactctagcctgggcaacagagtgagactccaatctcaaaaaaaaaaaaaaaaaaaattacagaattcagaggaaattataatacactgttctaagcaattaatggaatggtttgacaaaaatattagtaaagtcataaaagggccaggcgcggtggctcacgcctgtaatcccagcactttgggaggctgaggcaggtggatcacaaggtcaggagattgagaccatcctggctaacacagtgaaaccccatctctactgaaaatacaaaaatgagccgggcatggtgggtggtggtgggctcctgtagtcccagctactcgggaggctgaggcaggagaatggcatgaacctgggacgcagagcttgcagtgagccaagattgcaccactgcactccatccagcctgggcaacagagtgagactccgtctcaaaaaaaaaaaaaaaaagtcataaaagatctgaaccaccttgacttaattgacatttataagaggacacatgcatctactgaaaactcattctcttctagtgaagatggtaccctcactcattttatagcccatattctgggctataaaataagtctaagtaaagtctcttttaaaaaagagaactcatatatgttctctgatctcaatgaaattcaattggaaatagataacaatgtctagaaagacctccaaatttggatgctaagcaacacacttataaataatccatggttcaaaggagaaattaaaagctaatacaaaaatatttcaaaatataatgaaggtttaatgcatcaaaacttgtgggaagctattaatatggttctcttttttttttttttgagatggagtcttgctctgttgcccaggctagaatgcagtggcacaatcttggctcattgtaacctccacctccctggttcaagggatcctcctgcctcagcctcctgagtagctgggattacaggcatgccccaccatgcccggctaatttttgtatttttagtagagacagggtttcaccatgttggtcaggctggtctcaaactcctgccctcaaatgatcgcccgcctcggcctcccaaaatgctgggattacaggcgtgagccacacttaacttcacatttcataattcctgagtcttatcaggcaaaaacaagtcctgaaaaaacaaagtaaatctacttattatagtagggcagataatacaaagttgggcattaaggtaatatcgtatttatagttttaaagctgatgactctataaggacagtatgtgcttcagtgaaattataaacatgaaaactctgctttcagttcttttggatacatacccagaagtgggattgctggatcatctggtaattctacttttaattttttgaggaacaaccatactgttcctggaccaaactgagggtcgggctgctatttcttgccacccattaatgagatgccaatgaactgggaagaaagagtttttatttctgtagctggttacagggagaaggcctggaaattatcgccagaccaactcaaaattacaaagtgtttcagagcttatatcctttctaacctatatgtctacatgtaagtgtgcattcatctaaagacataagtgattaacttcttttaatctataactaaggtctgagtcctgaagaccttcctgtggagcctcagtaaatttacttaatctaaatgggtccaggtgctggggtgattaccctgctaaaccatggaggtttggggagttccttcaaacctccaatacccttgtttgtggaggcctggggagtttcttcaaaacccccaataaaacttgtttaatcctaaatgggtcctgttatgaattcctccattattttgtcatgctttaaggcccaggaaaggcctaagcaaaactcttgatgggcttttgttacattccagcctttgtataagggcactggcttttttttttttttttttaagcatttaatagttaacttaagcacttgattagtactgaaacagttgtgatggaggcctgcattagtgaaacctggcctgctacaatccccactgtcaatttgcgcatgatttctatcatgcttgtgtatttatttatcatgagaatcgtagggagatggggtgtcataatctttctggctactttcagctgagagagggtcattgttatggggcaccaaatgcagtactggagtggaggaggttgatttgttcccggtagcactgtctattttaggggcttagagagagtgcctgctgaaacacctagttttcagttcacagggctttaagaaagcaaagcttaggtttcagtgatttccagttagggaaaatggagaaaaaggaaaagaaaaaggaaaaaattgaaaacattttgagacttgcagccagaaaaattagaatttaatccaaactgtagaaaataataaaaactgaaaaacatcgaggaagactagaatttaacaggtgtaactataatttttgaaacataatttttctctcttgtttcccatttttattaaaagacaaatcatggtaggactggtttgctttattatacttggcctaattacttatataccgtgcagcaagaataattattttttacataggcgttttaaatgggctttgatggaactttgttccatagcaggaatctgagataagacctttttaaagccgagcccaaccatggatttataccatcaaatacctatgagttgggtgaattcctctcttcttgaggttccaagataacttggggttcctggcctgtcagaaagtgacattctttacttaccacaggtcagaaaccctgtacagggtctatgtacacaaattatgaggccagtttccaagggctttcttggcttcctaagtcaagtttgattccttaaaggagagcaaagtcaaagccttggtaaaataaccagtttttccaattgtgtcctgttacaaaagaaaacagattcttactgcacttatgcaaataactatattgccataacttaagaatactcacagtttcgaaattctggagaaaatcaggtagagagaaacaaatatgctccaaattttgttcataggagtatactgtacttaaatgttaaaaggtgttaatagctcaaaagaaaagtttccttgcctctgaaaagcaaaacaaaggattagcaacattttaagccgaaagtcaaaaagatcacttcagtctcctattagttcagttcatgcagttaattcctgtcctgtttgatattaatgaacattttaactcttcaagagtcatcaacgtttttcctctattttgatgtcacaatctccaaagttatcagaaacctgcattcaagagcacctgttagagctttacagctgattataaaaccaccttctaaagaggaccaaaacaagacagacaacaattatttatggaggacaaaaggttttagggtagccatagttaaagacacaattgatgacaagggtatctgttacctctgtggcacacaataattttaacataacaattataattattaatgataacatacactaagatatatcagaattataggagtcttccataactttggaacacataccaataatatatttatgcacatacagcccaaagaaagccaaacaccatttcatgtttgacaatgcttcctgtataattttatatcaaataagccacatttcacctttacattagtgtactattaatgttaaatccaatttttaataaaaccttatagacacatttacccaattttaatgtttgaccataaagtaagagttttatagacctttcataactctttacaatttttgttaaacagaaggttagtgctctaagagaaacccattgtgcttttattttaatgctcaatttacagaaaaactggatgatatccctttaattttagccaatacatttacacacagaattgtctttacaattacccttccacagcttgcttaaactttcatttttattttatccaacttaaaacaatcctttaaccttttaatctagtaaaaaatatccacattctcatgcctccttataatctttttaccaaaagtatattttactttccttacacaacttgcatgtaaactgttttttcaatagtcttaaatacacattacattgttaattcttagcaaccttttcttttggtgaaaaccttggtaaatttgggattttaattatatactaggtatggagcctacgacctagacagaaatgcaggtaaggtctgacttattctagcatctagctccatgtgtcctaggccttacctagctgcaaagcaggcaagttgtacagctaagagtcatagtggcattttataaagcatttaggaggcctaatcacctttaaattgtacaacatttcttgcataaatttcctttcataaattctttcacaacttacacagacaatctctgacatgccttgactttctgacttgttctaaacatccctctctttaaacaaccagttaatttactttaggacaagaatttaccatacaggagcccttcttgtataaattctcttttctttaaaactttttgcatagctaggggacatggctaatttcacatgtccccaggccgtatctagaatttaacagtccaaaataaattgaacactttttaagtcaaagaagcattttatgacctaaagcatttagcaaacctagtatttgacctgcataatttagaccaactatttacatttttgaagatacttttaccaataatctttaaaattctccttatttttataactttctgtatatctctcttatttcctggtttcttttaccttgttttatatataacctttaaataagctttgaataagacaacaattagttacccttggccaggcgtggtggctcacgcgtgtaatcccagcactttgggaggctgaggcgggcggatcacaaggtcaggagatcaagaccatcctggctgacacggtgaaaccccgtctctactaaaaagtacaaaaaattagccaggcgtggtggtgggcacctgtagtcccacctactcgggaggctgaggcaggagaatggtgtgaacctgggaggtggagcttgcagtgagcagtaattgtgccactgcactccagcctgggtgacagagcaagactctgtctcaaaaaaaaaaaaaaaaaagttaccctttaaaaaggacacaatctttagaaagaatgttttcctacgatatatttttattagaaaatacccaaataattagatatctgttgtttaatataactttagattctaaattatgacaagtttacttatgagtatgtatcccattacatttatctaattatttattttaatcatttacccagattatatatgaaaactgcgatagttgtcattaaagttaggaaaccaccattgcaaaattatgaccgagacagtgaaaatgatctgacctaactgactccatcttccttctaacctacaaggtattcttgtttattaacttagtttataatttagctttgaaacaaatgtgataacagtcctttcccagaacaaacttccttcatgtctgtggactagactgcttaaggccagaagattagaagttagggtattttggccaggcacggtggctcacgcctgtaatcctagcactttgggaggccgaggtgggcggatcagaaggtcaggagatggagaccatcctggctaacatgatgaaaccccatctctactaaaaatacaaaaaataaccaggcgcggtggcgggcgactgtagtcccagctactcgggaggctgaggcaggagaatggcgtgaacccgggaggcagagcttgcagtgagccgagatcgcgccactgcattccagcctgggcgacagagcgagactccatcttaaaaaaaaaaaaaaagagtattttactaaataattcaagatgtaactatcttcattaaaacaatattaatgtttcatttatttaaaaattacacatgcaaagattattctgtttgcactgaattatagttttgtagcctctatgccagattttgacaccttataatatttggcagagataagtatgaaattgcttgatcaataaatgcaaactaaaatgtatgctggaaactcttaagacatttctaatattactttaccaataatttttaaaaccagcttacttattaaagattttaagtcacataaacttgaaaaagcatttgactagtctttccttttttctgttattcaagtgcttttttctttgagccatttaattagacctcttttgtatatcttcagtagtgaaacatggtgtacacaagacaaatacataagtgtattatgcatgccaatagaagtacattttatagattcgtaagacctcatttttcagtctccctctactgcctaggccagagtacagtggcatgatctctgctcactacaacctctgcctcccaggtaaaagcaattctcgtgcctcagcctcccaagtagctgggattacaggtgcctgccaccatgcctggttaatttttgtatttttcttagagatggggtttcaccatgttggccaggctggtctcgaactcctgacttcaagtgatcagcccgcctcggccttccaaagtgctgggattacaggcatgagacaccacgcccggccttaactggatgtttgagctctgggtggagcccatactgaatcctgggttttcaaaaagggagaattattatgaggctagaccatgtgatgcttttacagtgcacttaaacaattttttcccaaagacatttctaagtgtctaaattacactttttctttaaaaccccagagtagcttctgtttaatagctattaatgaagaaaacagaattcagtcaactgagaagaaaaaaagttttgctcaaaaagataaggccctaggagagagagaaataaaaccaaaaacacgaaggccttttaaaggccttcacgcccccgtgcgcacacacacacatatgcacatacacattttggatgttagcttttaattaagctgactcccaatcattgagcttcaaaaaatctttctccttcccagaggcctctcagcagagatggacccaatacttcccattttcaagtttacatggtatcaaaaggaacaagacagacacacaaacaaatggaaacatttcagaaaaacccaaggggaagtgcactacggcaaaacagactctcaaaactaacgcaaaacctgatatcaaccaaagggaaagtgggtgtatgagccagccctgttgcttcccttggcagtaccggataaatggcttaaccagcccaaatgggaaaacaataggctcctggcctaagatcccattgactcaccctttgagcacgtccgctccttatctctgttcttccccagtagagaaagggacgtgtagatttgcacataaacagccctctggagggtcccctggggaaacctcacctgacagctgctgggatcctcctgaagactgtctcatcgcaagctaccagccgctgaacgcggcactgtccttatcttctggctggcgacttttttgttcccagaccaaactgagggtggggctgcccaataatgagatgcaggtgaatctcgctgcccaataagaagatgcaggtgaatctcgctgcccaataatgagatgcaggtgaatctcactgcccaataatgagatgcaggtgaactggggaggaagagagtttttatttctgtaactggttacaaggagaaggcctggaaattatcaccagaccaactcaaaattacaaagcttttcagagtttatatcccttctaagctatatgcctacatgtaagtgtgcattcatctaaagacataagtgattaacttctttgaatctataactaaggtctgagtcctgaagaccttcctctggagcctcagtaaatttacttaatctaaatgggtccaggtgctggggtgattacccttatcttgtctcctgctaaatcatggaggtttggggagttccttcagccctcccacacacttgtttttggaggcctggggagtttcttcagacccccagtaaaacttgtttaatcctaaatgagtccttgttaagaatttcttcattattttgtcatgctttaaggcccaggaaaggcctaggcaaaactcttggtggggttttgttacatcccagcctttatataagggcactggctttttttagcttttaatatttaacttaaccactcagtcagtactgacacagttgtgatggagggctgagtgaaacctggcctgccacgatactgtttttcccagtgtgtgttttacattcccaccaacagggcacgaaggttccagtttcttcacacctcaccagcacttgttattttccatgctgttgtttttaatatagtagacgttagtggtggtgagcatcttttcatgtgcttatgggccatttgcttatcttctttggagaaatgtctttcaagtcctttgccctttttaaaattttttaaaaatttttattgtaaattaagaaattacggccaggcacagtggctcatgcctgtaatctcagcactttgagaggctgaggcaggaggactgcttgagcccaggcgaacgttcaagaccagcctgggcaacatggcaactcccaataaattgtatgtatttatggggatttatagggtacaaagttatgttatgatttatgaatacaatatggaataattaaatcagctaatatgtccaacacctcaaatacttaacatttttatggtgagaacatttgaaatttattcttttagcaattttgaaatgtacaatatgctgttattaactacattcattgcactgtgcaacagatctcaaaaatcttattcctcctgtctaaccaatggtttgtacctttgattatcatctccccattcccccgtgcccagactctagtaaccaccattctattctctgcttctgagttcagttgtttttttttttttttttttgacacaaaaatttcacttttgttgcccaggctgtcgtgcaatggtgccatctcagctcactgcaacctccgcctcccgggttcaagtgattctcctgccttagcctcctgagtagctgggattacagatgcccaccaccacgcccagctaatttttgtatttttaatagaaacagggtttcaccatgttggccaggctggtctcgaactcctgacctcaggtgatccacaccctaccttggcctcccaaagtgctgggattcaggcatgagccaccgtgcccagcctcgttgttttcaatttcatgtatgaaaacatacagtatttctctttttgtgcctcacttatttcacttagcatgatgtattccaattccatccatgttgtttcaagtgacaaaatttctatctttttaaaggctgaatagtattctgtattgtctacataccacattttctttatccatttatctgttggtggacacaggttgattgcataacttggctgttgtaaatagagctgcaatgaacatggaagtgcagatatctccttgatatactgatttcaaatctttttggtaaatacccagaagtgggattgctggagcatataataattctatttttagttttttgaggaagctccatactgccttctgtaatggctgtactaatttacattcccaccaacagtaagcaagggttcccttttctccatatcctcaccaacacttgttatcgtgcatctttttgataatggccattctgataggtatgagatgatatctcattgtggttttaatttgcacttccctaatgattcgtgatgttgagtttttttttttcaaatatctgttgaccatttgtgtgtcttctactgagaaatgtctactcaggtcccttgcccattttgtaatcagattattttttctctttgaatagaattatttgagttccttatatattttagatattaaccccttatcagatgtatggtatgcaaatattttctcccagtctgtagcttattgcttcactctgttgtttcctttgttgtgcagaaactttttttttttttttttgagatgaaatttcactcttgttgcctaggctggagtgtaatggcatgatcttgactcacggcaacctccacctcctgggttcaagtgattctcctgcctcagcctcctgagtagctgggattaccggtgcatgccaccatgcccagctaattttgtatttttagtagagatggggtttctccatgttgatcaggctggtcttgaactcccgacctcaggttccgcagaaacttcttatgttgatataattccatttgtctatttttgcttttgttttttgcactttaggggtcaaattttaaaaaatgttgcccagataaatgttgtgtagttttagcccctgtgttttcttctagcagtttaatagtttaaggtcatatatttaagtctttaatccattttgagttgatttttgtatatggtgtaagataagggtccagtttcattcttgtgcatatggatatccagctttcctaacaccatttattgtggagacttttttttcccactgtgtattcttggcacttttggcaaaaatcaattgaccatagctatgtggattcatttataggctctgtattttgttccattggtcaatatgtccatttttatacccgtgccatgctgttttaattattattgctttgtagtatagtttgaaatcaggtagtgtgatgcctccagcattgtactttttgatcatgattgccttggctatttgtgtttttttttttttttttttatggttgcatatgaattttaggattgttttctctatttctatgaaaaatgatattggaattttgatagtgattacattgagcctatagattgctttggatagtatggacattttaacaatattagttcttccaagtcatgaacatttattttcatgcatttgtgtctctttccgttttatttgtctcttctgttttgttcattagtgttttacggtttttaacatacaggtctttcacttccttagttaaatttactaatttttttttgtcattgctcttaataggtttgttttcttaatgtctgtttcatatagttcattattaatatatagaaatgctactgattttcatatgttgattttgtatcccacaaccttactgaatttgtttacaaatttctaacagttttttggtggagtcttcagggttttctatacagaagatcatgtcatcggcaaatagacaattttacttcttccttttctatttgaatacctaataattcttttctttttcttgcctaattgctctggctaggacttccagtaccatgttgaaaagaggtggtgagagtgagcatccttgtgttgttcctgatattaaaggaaaagctttcagcttttcactgctgagtatgatattagctgtaagcttgtcatataaggctttttttgtgttgatacattccctttacacctaatttgattagagtttttatcatgaaagaatgttgtgttttgtcaaatgctttttctacatctaatgaggtgatcatattgtttttgtcctgcattttgttaatatggtatatcacatttattgattttcatatgttgaaccatctttgcatcccaggaacaaattccattttatcatggtcaatgattcttttaatgagctattgaatttggtctactggtattttattgaagatttttgcatctgtgtttattagagatattggcctataattttcttttcttacagtgttctattctggctttggtatcaaggtaatgcaagccttgtaaaataagtttggaagtagtccctcctctgtaatttatttgggaaagtttagaaaggattggttttagttcttgtttaaatgttttgctgaattcagcagtgaagccttctgggtcctgggtgtttctttgataggagacttttcattactgattcaatatccttaatcattattggtctgttcggattttccatttcttcatgattcagtattggtaggttgtatgtgtctagaaatttatccatttcttccgggtggttcaatcctttggcatataattgttcataatattttcatatgatcctttgcatttctgtggtatgcattgtaatgtgtctcatttttttttttatttgagacagagtctccctctgttgcccaggctggagtgcagtgtgacaatctcagcttactgccactttcacctcccaggttcaagtgatttttgtgccccagccacccaagtagctgggattacagatgcacacctccatgcctggctttttttttttttttttttttttgtattttattagggacgaggttttgccatgttggccaggctggtctccaactcctggcctcaagtgatccatccgtctcggcctcccaaaatgctgggattataggcatgagccactgcacctggcctcctcattcatttttgatttaatttatttgtcttctttcttttttcttagttagtctagttaaagtttagtgatttcatttattttttcaaaaaactaacagaattttgataatcttttgtatttttttcagtctctatttatttttgctctgatttttattatttcttttgttctgctaactgtgggcttagtgtatcttttcttctatttccttgaggtacaacattaagtcttgtatttgagatctttcttcttttttgatgtaggcgtttattgccatttcctcttaaaactgcttttgctgcatcccatacatttggttatgttatgtttccatttcattttctaatatactcttaaaattcccttttgatttcctctttgacacattggctattcaggagcttgttaccattcaagttctttgttcatttcttaatcacattgttggctttttgttgttgttgttgagttggagttttttatatattttagatattaaccttttatcagatatacaactagcaaatgttttcctcttcctgtgggttgccccttcactgttgatcatcattggatgcacaaaagtttttaatttttacatagtgcaatttatctactttttttcctatattgcttgtgttttggggatcacattcaagaaatcattgccaaatccaaggtcaggaagaatagttcctatgttttcttctaagttttagggttttcacttttatgttagattttggatccattttgagttaatttttgtatacgtgtaagttaaaggtccgaggtcattgttttgtgatgagtcaatgtctagatttcccaagaccatttttaaaaagattgtcctctcaattaaatggtctttatacctttgccaaaaattacttgatcatatacagtcatgcaccacataacaacatttctgtcaacaacagactgcatatgtgatggtggctccatgcaattatgtaacatgctacacaggtttgtagcctaggagcaaaaggctataccatataggccaggtgtgtcataggatacaccatctaggtttgtgtaagtacactcttctgatgttcacacaacacaattgcctaatgaccctttgctcagaacaatgttgagcaatacatggttgtacgtgcaagttcatttctgggctctctggtctatatgtcaggcaccttttaaatcagaagttcactatttaatgtttgatcctgtatcccaattttttaagtttgctatattataacccccatttataaaaatgtgtgtctgtgtgtatgtctgtgtgagagagaataagagaaagagagaaagagagaataggcatacctatggaaaaatagtggaactaaatgagacaaaatattaatggatgctatctttagctgagaatatcacgtgtggtctgtgtattcttgtaaaaactttccttgcccacattttctggaatgaacatgtttagaagagttttgcaggtgtatgttacttggccttccctgaaatatgaagggacaaacaaacactaaaggatgtttgagaggtgagagctgcaagaaagatgagggttctgtttagcttgggtgcctgggctcaagagaatgtgagtggatcctgggaggggtgaggtctggaagccactcatgcccatccctgctttgtccccacaggtctcagctgagtctgctctgatcacccaacaagacctagctccccagcagagagcggccccacaacaaaagaggtccagcccctcagagggattgtgtccacctggtatgttcaagatgggtctctaatccttgcccctcctccccttgtctccatgagcttccagtctgtttcctttgcacttccttgttctttattccacagagaggcattgggtgcctccagttcaaggctctgtccttctggagccttcctgctaggatggtatcaagacacacaaatgaatgagacagccaaagaaactgataggaaccttgagagagaattgagtgggacagagatggggctggtgaggcctccaggcaatggtgactttgggctgacatccggaggagggcagggccagaggttcagagagccaggaagagtgctcctaggagggttccactggaacaattgccagggggcaagagttggagaagatggagcaacagcagggggctgctgtggggagtggagggttaggaagttagagagacacgtggggtcagatcccacacagatgaagctggattttatttcatgagtgatggatgtccctgagaagttttcagcagagggccaccagcatcggatgtacatcttgagtgcccactcctggactgaaccggagcaagacaggaagcaggtggagggccttgagtgtgaggcgctcccctgggatgttatgtggtgtcccgtaaggtcatttgagcccccagagatgcagcaggaacctggcctgaagtgtgcttgactgttgtgttcgcctcgcacttcttcccccttttcccccatgtgtatgagttaggaattgattgctgcatgaaggtttccagggcaggcaagtgtggcaagcagtggcttttaaaatccatttacaaagttgcatttcttttccatgactaagggccacaggaaaggcttgcctgagggcaaaccctcacattgcacatgtgggcttgccaggagcagagcatggagaaggaagaacccagcgtgaagcagacacaaactcatctgtaaatgctcctattgctgtggtccagggtcaagaccaggaagcaggacgggaataggaaggactcaagacatatttggggtgtggatggatgacgtgtggggaatgaggacaatcgaggcaccaaattcaactgctcagggtaacttggcctctgaggggacagtgtgtggcagggctagcagtacacatttggggaccctagcacataggtgatgcttgaagccgctgtcttgagtgtgtccacctggaagaagttgtaaatactgaggaggggcacaactgagcccatgaggatttgaagttggagacgataggccagggagacaggactgcaatgggctgagcaggagcagttggagaacttccatcctagaggagagatggcccttccagccacagggagcaggccatagcaagtgtcaaggactgagatgtggaaactcctcgaaatgtgcatttctcttcctgtgaatgaggtcaagaatctgttcatgacacagacactgtttgtacactggttctcctaggttttcttcactcctagtaagaggttaggttttttttttttttttttttaaatcattgagtcacatgaattcttacagattagggaaattatacattgattgattgattgattgactgattgagataggatttcactctgttgcccaggctggagtgcggtggcaggatcatagctcactgtagcctcaaccacttgggctcaagcgatcctctcacctcggccttccaaagtgttgggattacaggcgtgagccactgcgctgggtccaaaattctaataaaaattcccatataacgccgggcgcagtgactcacacctgtaatcccagcacttcgagaggccaaggtgggcaaatcacttgaggccaggagtttgacaccagcctgaccaacatggcgaaaccctgtttctactaaaaatacaaacattagctgggtatagtggcgtgcctgtagtcccagctacttgggaggctgaggcaggagaatcgcttgaacccgggaggcagaggttgcagtgagctgagatcacgccattgcacttcagcctgggtgacagagtgagaccctgtctcaaaaaaaaaaaacaacaaaaaaaaaattatcatatatctttgcagtcattttgtggtttcctattttgtaattaagtcattgagccacatggacttcattttgtagtaagaggagagtgaggaagacacattattatttgacagccacctttttggttgccccaacactattattaaataatcacgtttttatcagtgacatgaatcactatgattatgtatgatacttacattattaagtaaggtttgtgtaatttggattttttagaatgtctttcaatattaataaaaataattcaggaatcttgtggctagcatataggtgattatggtctattttttgcgtttgtttttactcattctgccactctctgccttttaattgcagagtttaaactattttcaattaacatagttattgacaagaaaagatttgtttctgctcttcagttatttgttttctttatgtcttatatatattttgttcctcccttatcaccttttgaaaaaactttagtttatttcttggcatgtaccattttcactcacttcttttcttttctgcatattttaaaatatattttctgtttttcttaaatatatattttgtgtatatatatttaataaatatatattttgtatatatatatttaataaatatatattttgtatatatatttaataaatatatattttgtatatatatttattaaatatatattttgtatatatttaataaatatatattttgtatatatatttattaaatatatattatatatatttaataaatatatattatatatatatttaataaatatatatttaaatatatacttagtatatatcttaaagatacatatcttaaatatatatatagatatatatatattttttgagacagggtctgctctgtcacccaggctggagtgcagtggtgcgatctcagctcactgcagcctatggctgctgggtttaagcgattttcctgcctcagcctcctgagtacagggagtagccaccatgcctggataatttttgatttttagcagagacagggttttaccatgttggtcaggctgtctcaaactcctgacctcaagtgatccacctgcctcggcctcccaaagtgttgggattacaggtatgagccacgcacctagcctaaaacttattttcttactggtttccttgaagattacaattaccttcttaagtatctaaacaggtagttttataataccggcagaatttcattgcaatccaaatactgtgctcctgtaccactccatctctccagctttctattgttgctgtcatagatcacatccttgcacgttgtgtgaccactgacgtcgatcttaaggacatgtatgtgtatggagcaaggttgacttgtgatggttgattttatgtgtcaacttggttacccagatacttggccaaatattatcctagatgtttctgtgaaggtgtgtttgttgttgttgttttgttgttggttttagatgggattaacatttaaatcagtgggctttgagtcaagcagattacccccttaatgttggcaggtcccatctaatcagttgaaagcctcaatagaaaaaagactgacctccaccaagaaagagggtgttctgccagcaggcagccttcagacctgagctgtgactcttctctgctggcctatcctgtaccttttgaatttgccagcctccacagttatgtgaaccaattccttaagataaatctttatctctctagagcaggggcccctgacccccaggccatggaccagtactggtccgtggcctgttaggaaccaggccacacagcaggaggtgggctgtagatgagtgagcattactgcccgagctctgcatgccgtcaaatcagcggcagcattagacttcataggagcgtgaaccctattgtgaactccacatttgagagatctaggttgcgcactccttatgagaatctaatgcctgatgatctgtcactgtctcccatcacccccagataggaccatctagttgcaggaaaataaactcagggcttccactgattctacgttatagtgagttgtataattatttcattatatgttaccatataatagtgatagaaataaagtgcacaataaatgtaacatgcttgaatcatcctgaaaccatccccatgcccccaactccagtccgtggaaaaattgtctttcaggaaaccagtccctggtggcaaaaatgttggagacccctgctctagagagccctgactaatacagaatttttaaagatttgaaattcttttaaaccatacttgatctccaagtaatggaaataataagattatatttccacctaacataatacagctatcctgtatacaactgaaaacgcactaaccctttctccagaagaggatgcaaagttcttgagtggtgtttactcctttccttgataccctggaacataaatactataaagtgaacaatacttaaatactatgatataaattcaaaatatcttgtgttacataacaaggggataagagaaggaagaaaacacagatattcgcttaacatatatttacacataaacacacacacataacacaataaggaagaaatacttataatgattacagtccttatttccatagctggtcatgtcattgtagctggtatttataagaagcttctttcgctgtgcattctgtattccctgtgccctcactaagcacctcagctggtcatggctctgtgcctggtagagtgaactaacctttattcctgaagggtctgagctataagtggtcctgctttaatagggtcgtggtagttttccattgactttactcacagggcatggtaatactaagagatgccctaaggaatctcctgtattctagacatcctcttccttacgtccattgtggaataacagtccaattttcccttcaatttcccctttgtgttcagaatcagtcaatccagccagcagggtttgtgtaactggttttcgcctgttgattcagaggcatgaggaacccaaagtggccaagtggcagtcttcaagttacacagaatcactgttgtgtctcctcatggaatcattcctccctctgaaactcagagctctagcaaagcataaagcagcaaaaattttgataacaggccactaagggtaatgtggagtggggccattcctgcttccacccctagattcctggacacatgaatcctagcaatggaagaagcaaccgcatgtattggaggataattcagagcatagacagtctcctggagaaccttgttgcagcccttcaaggtactgccacccagctgacattgtaaatgagttttcaaaaagccatatcccaccatcttaccaagccagcagttttgagatggtggggaacatggtaagaccagtaattccatgagcacaggcccattatagtgggcgcttcatttgccatcaagtgagtccctcaatcagaagcaatgctgtgtgaataccatgactgtggataaggcattctgtgagtccacagaggatagttttgacagaagcattgcatgcagggaaggcaagtctatgtgcaaaataagcttctcttccagtaaaaatgctgccccctccatgatagaaatggttcagtgtaataatcaacctgccaccaggtagctggcagactgaccctctgaatggtgctatatcagagactcagtgttggactctgctgcctatagattgggcactcagtagcagctgtagccaggttggccttggtgagggaagtctgtattgttaagcccatacataacctccatccctgccaccatgcacactttgttcatgagcccattgagtgatgacaaggatggctgggaaagaagctgactggtagtcacagaacaggtcatcctatccacctgattattaaaatccttccctgctaagatcactttttgtgaagatatttgtgtcacatggggcacaaatatcttcatggtttttttacccattgagaaaggtctatccacacacctcttccccagacttccttgttatcagttttccttcagagcctctgaccctccagccaaatcattgaccacagctcatgaatcagtatataactacatgtctagccattcttccctcaagcaaaatgaacaaccaggtgtactgctcagagttctgcccagtggcaggatctcttttttttgagacggagtttcgctattgttgcccgggctagagtgcaatggggcgacctcggctcactacaacctctgcctcccgggttcaagtgattcccctgcctcagcctcccaagtaactgggattacaggcatgtgccaccatgctcggtaattttgtatttttagtagagacgaggtttcaccatgttggtcaggccagtctcgaactcctgacctcaggtgatccactcacctcggcctcccaaagtgctgggattacaggtgtgagccaccacacccggcctagcggatttcttttcaccactgtccttcagggacgtcccagacagtggatgtgatgctgcaaacatccacttctaagggttacctgtatgtggtgcagaaccatctgtaaaccttcttctggcaactgaccatagggaattcctcatgaggccataagtgcaggccaggcaaaagaaagtaatattgcaggagtggggatcatgggcacttgggccacttcttcatgtaactttcttgtgccttcagggcctatttaagcccaattttgtatatataccaattacatttgaaaatggaaatggaaactttaggctgtatgtgcccaaacttatggcttggtaggcaaaataacactcagttcacgatgagcagtcaggtcgtagagtaatttggtggcctatggttaaccattcagtctgcactaaggcccagaaacaagccaagagctgtttctcaaaaggagagtagttatctgcagaggatggcaagtctttgctccaaaacctaagggcctgtgctgtggttgacctagagtgggctactaaaggttcaaaacagcattgctgtctgccaccaatacttcaagcaccgttgggtctgctgggtcgtatggcccaagtgacagaaaaatgtctacggcagcctggacctgttgcagagccttttcttgttctgagcaccactcaaaactagcacatttttaggtgacttgataaataggccagagaaacacacccaaatgaggaatatgttgccaccaaaatcaaaataagcacactaggcattgtgtcattttcttggttgtagggaggtgggggtggcagatacaacaatttatcttttatcttagaatatcttagaagagaaggaatatcttatgtgccacatcattcaacaactaggaatttgtttcccagttgttgtccttctactgaggtaaaaggcccttgaaattttgtcagatttatttcccaccccctgacatgcaaatgtcttaccattaagtctagaatagttgctacttcttgctcgtgaggttcaatcagtataatgtcatcagtataatggatcgtcttgtgtgttatcttgtggaagggaaaggccatcaatatccctgcaggccagatgtggtggctcgcgcctgtaatcccagcagtttgagaggccaaggtggctgggtcacttgagaccaggagttctagaccagcctggccaacatggtgaaacctcatctctactaaaaatacaaaaattagttggatgtggtggcacacatgggtaatcccagctacttgggaggctgaggcatgagaatcgcttgaacccaggaggtgcaggttgcagtgagctgagatcatgccactgcactccagcctgagagacagagcaagactctgtttaattaaaaaaaaaaaaatacctgcaaactaaattatgacatagggctgcgagttgatgcatcccggagacaggatagtgagggtatattgctggccttgccaactgaaagcaaactgcttctgggagtctttattgacaggtatgaccaacaaagcatttgccagttcaacacctgcataccagggtaccagggatgtggcgatttgctcaaacaatgaaaccatatctgggacagttataactggaatcaccacctggttaagcgtatgataatccactgtcattcaccaagatccatctgtctttggcacaggccaaatagtcaagttcaatgggcatgtgatgggaatcaccacagatgcatcctggatggtggtaatgatctctgcaatccctccaggaatgttgtattgcttttgtttttttgtgctttacaggcagggtatcactctgtcacccaggctggagtgcagtggcacaatcatagcacactgcagcttgaactcctgggctcaggcaatcctcctgcctcagcttcttgagcagctaagactacaggcatgtactgtcatacctggataattttgtatgtgtgtgtacagatggagtctcactgtgttgcccaggctggtcttaaacccctggcctcaagtaatcctcctgccctgacctcccaatgtgctggaattacagacatgagccaccatgcccatctggtattgcttttgatttactattttttttaagtaaatgcaaatctggtggcttccacctggtcttttccaccataatagtcttcacttcacatgtcagggaatgaaggtggggattgtgccagctgctgagtatgtctattccaattacacatactaaaatgaggaaatcagacaggatgggtgtggggacccactggcccctttctgagatggacttgagcttagtttgagtaatgacaacataacttcaatggtatgcaaacactgtgctcctgtacttctccgtctttcctcctccatcttgttgttatagatcacatccttgtacattgtgtgcccattaacatcaatttgtaattattgttttctgcatttgctctttaaatcatataagtaaataagaggatttacaaaccaaatgtaccataatactgtgctacagactgaattgtgtccccaaaatcatatgttgaagcattaccatccaatgagatggtatttggagatggtgcctttgggaagtaattgggtttagatgaggtcatgagggtggggccctcatgatgggattagtgcctttttaagaaaagacccagacaacttgctctctctcgcttgctcgctctctctctccccccctcttctggtgtgtgcaaggaagaggttacgcaaatgcacagcaagatggtggccatctctagaactatgataaataaatgtctattgtttaagccacttggtctatggtattttattatagcagcctaagtagctgcgtaccagcatttatatttacctaaatagttaccttttccagggttcttttttttttttttttttttttttttttttttttttgagacggagtctcgctgtcgcccaggctggagtgcagtggcgtaatctcggctcactgcaggctccggcccctgggtttcacgccattctcctgcctcagcctcccgagtagctgggactacaggcgcccgccacctcgcccggctaatttttttttgtatttttagtagagacggggtttcaccgtgttagccaggatggtctcgatctcctgacctcgtgatccgcccgcctcggcctcccagagtgctgggattacaggcgtgagccaccgcacccggcctccagtgttctttatctcttcgtatgcctttgagctattatctaatgtcattacattacctcctaaaggattccttttagcatttcacagggcagatctactagtaatgtgctccattacctttcatttatctaagaaggtcttaatttcttcttcattcttgaatgataatgttcctggatatcaaattcttggttgcaggattttgtatgcttgtgtttttgtttcttggcactttaaatatgttacccactcccttctgggctctatggttcctggtgagaaattagctaataaccttattgaggttcccttgtacatactgagtgggccacttgctactttcaggattttctgttggtgttgggcttttgtccatttgactataatgtgtctcagtgtagttctcttttaacttatcctgcttggagatcattgagtttcttggatgtgcagacaaatgttttttaaaagtcttgcacctccttgttaaatatcattcctaaatgttttattcatttttatgtcattgtcaatgaaattgttttcttaatttcctttttggattgttctttgctactgcaaaacttttacgctgaaaactatcaaacattgctgtaagaaattttaaaaaagcaaaataaacaggaagatattccatgttcatagatcaaaatggtgttaaattacccaaagcaatatacagattcaatgaaatccctaccaaaatctcagtggtgttattttaaaaatggaagaacttatattcaaagtcgtatggaattaaaaagacttattgaccaaaaacaatctggtaaaagaaaagcagagttggcgggactcacactttccaattttgaaacatatcctcattccagggcagctttagtccccttttctttggatcattctttgactctatagagattcctcccgttttcttcccatggctgatggtgtgagctttaattttgaaggcttttcccattgttgtatgacttctgctcctggtgtatcttccactggctaggagctcattcagaacaggtattaggacattcttctgtgcattttaaaggtctaagatggcactgtctaatatagtagtccctaggcccatgtgattgccaatcacttgaaatatgtgaggcaggtggatcacgaggtctggagttcgagaacagcctggccaagatggtgaaaccccgtctctactaaaaacacaaaaattagccgggtgcggtggtgggtgcctgtaatcccagttactcgggaggctgaggcaggagaatcacttgaacccaggaggcagaggttgcagtgagccgagatcgctgcactctagcctgggcaacagagcaagactccgtctcaaaaaaaaaaaaaaaaatgctactgcaaattgagatgtgccatgagttaaaatatacgcaggatttgaagacgtactgtgaaaaaaatgctgtaaaatatctcaatgttttatgtggattacatatttaagtgatattatctggggtacattaaattaaaatgcattattaacattaatttcaccccttctcaccttttttaatgtgctgagtgtggatttaaatttcatatgtgggctgggcacagtggctgacacctgtattcctagcaccttgggagtccaaggagagtgaatcacttgagcccaggagtttgagaccagcctaggcaacatggtgaaacctcgtctctacaaaaaaaaagtacactaaaaattaacccggtgtggtggtgtgcacctgtagtcccagctatttgtgggtcggggggagagggagggtccgggaggtcgagggtgcagtgagctgagatcacaccactgcactccagcctgggctatagagcaagaccctgtctaaataaataaataaataaataaataaataaataaataggccgggtgcagtggctcacgcctgtaatcccagcactttgggaggcctaggcaggcagatcatgaggtcaggagatcgagactagcctggccaatacggtgaaaccctgtctctactaaaaaaatacaaaaattagccaggtgtggtagtgtgtgcctgtaatcccagctactcaggaggctgagccaggagaatctcttgaacccaggaggcggaggttgcagtgagccgagatcacgccactgcactccagcctgggtgacagagtgagactacgtctcaaaaataaaaaataaaataaataaatgtgtggcttatatttcttttggcagtgctggtttaaggtgtgtaaatgcagaattgatgaactgaccaagctaggtagaggagatttccctcttttggttccacacatccctgaaagaggagtcccccagccaccactgccagcttctgggaatcctgtggcatttcattcaccggcttttctctcccctcccaggacaccatatctcagaagacggtagagattgcatctcctgcaaatatggacaggactatagcactcactggaatgacctccttttctgcttgcgctgcaccaggtgtgattcaggtacagaacatatggaccccatgcctaaaggtggaatgcggggtgatgacataaaagttgtagctaaaatgggatcaggagacctagattctggtccaccttggtcttcatcataccatgttccatgattttgtctttgagctttttaataaataaaacaggcccggcacagtggctcatgcctgtaatctcaacactttgggaggcatcacttgagcccaggagtttgaaaccatcctgggcaacatgagaaaccccgtctctacaaaaatataaacattagccgggcatggtggcgcgtgcctgtatttccagctacttaggaagctgaggcagaaggatctcttgagcccaggaggccgaggttgcagggagccgagattgtgccactgcattccagcccaggcaacagagcaaaaccctgtctcaataattaattaaaataataataatacagaaattatttgtataatgtatgctacatggtaaggaaatcttttaaactgtcagctgcaagggggtggggccatgagccaggccaagtggacagggctggatctcagcagtggcacaggtctgctttggggccaggctctctcccctgggctctgtgctcctggcaggtgctcggcctcactcacccttcaggttctcaggcctctccctcctccccagcaggctgggccttggggaagtcccccaagggctcctctccttgcagtctctcaggtgatcccttgcacttcccttgctactggccatgcaatctaaacgatgcttgtcccctaaacggtgctttcccctaatctaatgtaataaataatgaactgtggtccttttgtatgactcaacgagtgttagtgacagctgaagggtgggtatcctgaatgagccatgagtgtgctggtgcagaaactggccctcagaactccttggcaaactgagttgagctgagtagcagggtcttggggtggggaggaagggtcaagggacacatcaggaaaacacattcccaaaaccttatgctctgtcgtcaggtgaagtggagctaagtccctgcaccacgaccagaaacacagtgtgtcagtgcgaagaaggcaccttccgggaagaagattctcctgagatgtgccggaagtgccgcacagggtgagacaggagccgggggctcccagtagctccatggaaccccaaaagacccaagtctccttgtacccctgtctctcccctgacagcacccgcaaggggcatccttgaggctgtggctgcccctcctggtccctctgcgtgtcaccacccctgccccctgcagcagcctctttccacccctccccagcacgagtccccttgaccaggctgacttgttcactgaccacagaaggccatgacttggggcccatgataattttaggggcccatgaaatgatttaatttctcttgaaataagaagaatgagtagaatgcagccaggcatatattcatctttataccaattcagcaataaaatgtattttttaatatttttatgcatgcaggggcccataaagacaaaagtgcccatggcccacaaaaggcataataaggccatgggtggagctccttcaagttcccatgaggacctgagcccacccagccggcctcacccctggcccctgatccctcagtaagacctgtcttttccctatttgggttttaggggccaagagtaatttgctcttctctggcccccctagtatttgctgtgattgggggaaatgggcagacagctggggacaagagctcacttttgtggttgactggaagaccggactcatcttgtggccacacgggcttgtgaccttcccctggagtgtgattgctcctaacgcaggcctcccctgcagcccagggaagctcagtgtgtgcccagcacagaaggctcctggaactgcagctctgaccccagagcagggaggccgaggggctgaagtgcgcatgctcagacccttccccagcctcaagaagggagcacagggggacccactgctgacacgaggagactgtccttcccctgacaccttctcagggacactggggagggagggtggctcctctttcatcccacctggccagctttccatcaagagtcccccctctccctctgtgtgtgtacccaggtgtcccagagggatggtcaaggtcggtgattgtacaccctggagtgacatcgaatgtgtccacaaagaatcaggtacaaagcacagtggggaagtcccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtaggtgctggctgagggcgggggcacagggcactctctgccctgccccctcccaccctattcccacagacagaaacgcctgcccctgccccaagtctaagtgcctccagcctggctctatcctcctcctcgtggtcacccccatccccacatcccgtgcaccccccaggaccctggtctcttcagtccctctcccaggtctgggggtccccatatctcccagccaagtccaggagggcagggccagttcctcccatcttcaggcccagccaggcagggggcagtcggctcctcaactgggtgacaagggtgaggatgagaagtggtcgtgggattttttcagccttggtcagagcagaaccagagattttccaagtgtttgtttttactctagttccccttctcatcccccttcctcagggtgtctctgagttgtaaggccccattctgtccccagccccagggctccttgtccagtgtcccagcccccagcccagccctgcgccccactgtcctctgggaggggggtgcttcatgggcccctcccttcctgctaaggagactgcttcttttttaggtggtggtggggaccctgagcgtgtggacagagtgagttgatttctccaggagctgggggctcaggggttcaggaactgcttcctgggacagcagaacctgggtgggtgggtccccattgtcctcatggctgccctgactctctgaagtggcctgggtgctctgggctgactgtgggggacacatggccattttgagcaccacataggctggtgagccctgctgcagcccaggtgacatcctcaccccacagcctgcaccctagggatggggtgtctgcctgagcacagcactgggggcctggccccagcagcgggtcctggatgtgctgagtctgggctgcctgcggtgacctcactgagagggggtggggatgtcaggtgcagctgcatactgaggaccctgcagcgagccctaggtgtggactcctgagtcggctttttgccttcccaatgtctttttccagagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggtgagtgggggacagatcattttgtttcctggcatgctgctcacctgggatttcgtagacagtgggagagggcagtgccttagctctcctggcccaggggaaatggaacctgaaggagccaggggactgcaggggatggagcagctgcactgaggtggtgaccgtgccagtctgcaggacatctgcttcttactccctgtcctgtccttgctgtgtcccccgagcctggagctccacaggcatagagtgggggtcacagggttcattgatgagtgaataaggctgcacagtctccatcgtatgctcctaacagaagtcagtgagcccttgcttgtaacagcaggagttttaaatttactctgaaattgttattacattgaacatatttcaaagttcgtagggcagcttccaaaaagtaggattccaagtcgatgcacaaagggcttttgtattggacacacgcacacaatcagttcatatcaatccatcagttttgatgtgatattgagtaggcaggaaatctgtatatacatttattgttcattgctcgtaagcactgaaagtccttccctcgaacataagatgagactatccagtttcctgcagtgttttatttttaatgatttgatttttaacatacagcaatataatctaaacagaattgaattttcgattcaatataagctgagaaactccctgaattattctgagtctctgtttccttcttccaagcccatttagcaaccaattcttcctttttcccttgcctttgcccttttgccacctcctttgctacatgtcaaatgtttacttttttctctcttcctcttcactcttttttaaaaaaacaaacaaacaaaaaaaaactagatcttatccttgaaaatgtcaaatgtttatatgggcagagatctcttccacctagactgtttctgtttcttccttgcatctgtaccactttctttttaaataaagagaagagattttaaaaggaaacaaatgaacaatgccaatacttcctccatgcttattaatgactttgaagatttttttttttgagacaggatcttgctctatcacctgggctggagtgcagtggcaccatcttggctcattgcaacccctgcctcctgggctcatgtcatcctctcacctcagcttcctgagtagctggaactataggcatgtgccaccgtgcccagctaagttttgtattttttgtagagacgaggtttggtcatgttgcctaggctggtctcgaactcctgaactcaggcaatccaccctccttggcctcccaaaatgctgggattacaagcatgagccaccatgcctggcctgatcattttttgaaagcaggtcacccatagccacacatccaccagagtatgaaaaaacttgatcataccaagagccttctttactctttcccagccttttggcccttcttatttcaggtaactacagtggataatttcttgtgattctttgctaaactctttatgcatataccatctaggtacataaatgcatatgtatttatgtggtattgacatgaaaaggattatatcatgtacaacaccaaacaaaactgtctaatatgttttaatatcttagacagcaaatatgttttcaaaattatttttacacatcttataatttagaattagataaaatttagaattataagattttctctagtacccctcccgcccacatagtcactagactttacaaatattaatttaaattaatacatggttctaggaatgattgacatcctttcaacattcaattttattatcaaagaagataatatttcaagtcaagtgttctattatgactcaatcgagatttgggagtttatttcagataaatttttcctattcctcatcaaagctgtttctttgcattttgggtcttcttgtaagtccattttctaatttattatgtctgctgctacttttcttttctttctttctgagatgggtctcactcttgtcacccaggctggagtgcagtggtacaatcatggctcactgcagccttgaccttctaaggccaagtaagctcggacttaccggcttctgagtagctcggacgacagttttgtgccactacacccagcttattttattttattttattttatttttagaaacaggatctcgctatgtcgcctaggctggtctcaaactcctgggctcaagcagtcttcacacctcagcctcccagagtgctgggattacaggtgtgagccaccatgcctggcctctgctatgtggtttaacattcatcagggctaggtgcagtggctcacgcctgtaatcccagcactttgggaggccgaggcggatggatcatctgaggtaaggagtttgagactagcctggccaacatggtgaaaccctgtctctactaaaaatataaaaatacgataaaataattagctgggcatggtggtgcacacctgtaatcccagctacttgggaggctgaggcaggagaatctcttgaacccagaggtggaggttgcagtgagccaagatcgcactattgcactccagcctgggagacggagtgagactctgtctcgaaaaaaaaaaaaatcatcaagacatattcacttttgagtattacaaattaaaccttggggttttaaaaatatacactcctaatctaaaatattgactgctgtatcggcctccttccgagagtcttgcccctttgtctcctgtcttgttgccagacctttcagaacaatgttctggaagtgacgtgctgcaggtctcagagctggctggtggtcggggtcagtactggactgtaggactcctggctctgaccaggacattccccactatgtgttacaggaaccggcagaagctgaaaggtctcagaggaggaggctgctggttccagcaaatgaaggtgatcccactgagagtaagtgttttgctcctggagatgcagcaggaatggagggaatagggacagggtcctaactgctgtccccagaggtcagagggctcttccagagtattccatgctggaagccgtgggtcctgtgctatagaccatctggaccctaaactgtcttctcccatctcttctccccactctacctcatcctctctgcaccctatcattgaccctaatgactctgtccgtcccctcatcctctctcctcctttgttcagggcctgatgtagcccccgcctgcccctgaggacctcctgaggggctggcctgtcctgcacagcaccactaaccccagtgggctaaggagctcttgacctgtgcctcagcccaatttgcagagctgttgtgtaaactacatacgaatgccaaagacttaatgcaaaaaagagtggaaaatatttcactcataatttttgtatattgattgtatattaaattatattttaaatatattcagtaccatacattaaaatgaatgtcacttgtttctgatgttctttaaaataaggctgttggaaaacatagcctcgtgttcctgaccctgtctatctctgaggacggcgaggtgcatcatgttgcacacacgtctcatttaatccctcatcgtcccgagatctgggcagcattgctcggtctttgggttcacttcttgctcagagtctgtttgcctccacctagctctgccccagccccaggaagtgaggccgagctgggtgaaaacagaggtcccctgtcccaggccctgtgctttccacagatgcagaagtggccgccctgggacctgctcccatgacaagcgcagcccaggcagcctcctccctcctctaagctcccgctgcagccactgtctctccctccctcggactctcacgcactttactttctgcctctgtaacgtccatccatactcccctggtgggttctcagccctgtatgagggctgattctctgacgactttgactccccgcagtgccttgcgtgtgggggaggccaggcagtgtgggcgcgctctctgtggatgggaagcgggtgggcactggagcggcaggtttgcccgcacacggggctctccaggttccccgccttgggttctgggcctgatgtggaatcctctgccctttctgagtcccaactcacctggctgtctctgtggctttctccaccagctctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaa

SEQ ID NO: 87 - DNA, 33711 bp, Homo sapiens
gcaggtgccccgaaaagggggcggggtcaggggtgccctgaactccgaatgcgaagttctgtcttgtcatagccaagcacgctgcttcttggattgacctggcaggatggcgccaccaccagctagagtacatctaggtgcgttcctggcagtgactccgaatcccgggagcgcagcgagtgggacagaggcagccgcggccacacccagcaaagtgtggggctcttccgcggggaggattgaaccacgaggcgggggccgaggagcgctccctacctccatgggacagcacggacccagtgcccgggcccgggcagggcgcgccccaggacccaggccggcgcgggaagccagccctcggctccgggtccacaagaccttcaagtttgtcgtcgtcggggtcctgctgcaggtgagtccccaccgcggtcctgcctggggaaaagcgcgcctggcaccgggagggggcagagagagagggggacgcggcgggggtgcctggcccgggtcacttgtggcggggcatgtccgggcaggaggagcccgtcgtcggagtcggaggaagaacggggtccccggggccaggcaggagcgacccgggcctggaggcagcagagccccctcccgcaggaggctgggcccggggactccaccccgttggctgctgcctggcgcgtctccctcctgcccacacctcacgatgtatcgggaagtttcggaatcgatagagctcaagtgtgtaaacttccaagccaactcccagccacaccagctgcgtgaaggggagcgccattctccccactccctgattccctccccacccccgtccttcttttcttctcttctttttttttttttttttttttttgaaacggagtctctctctgtcgcccaggctggagtgtagtggcgcgatctcggctcactgcaagctccgccttcctggttcaagcgattctcctgcctcagcctcccgagtagctgggagtacaggctcctgccaccacgcccggctaattttttgtatttttagtagtcacggggtttcactgtgttagccaaatccgcccgcctcggcctcccaaagtgctgggattacaggcgtgagccaccgcgcccggccctccatccttcttttcttagacaaattggttaaacacgcagcccggcaggaaaaagtaactttctctcctctgctcgttgtcttccgtttcgagtccactgagcacaccggcagcagtttccttccagccactttcttgcgcatcaacaggtacagggcagcgaattgaccaccacgaggcaggcagccaggagcggggcacgcccttccttcaggaggcagcgtttcctgtgaaagcaatcactcagtctggaaaaatgccaatgccttcagttctctttcaagttcattaaggctctaccaattgttctcatccagattccttctatgttaaggaaaaacaaaacgaaagctaagtacctgaaggataaaccagtcttacaagtgtcaggaaattttacgtgtttttgtttaacaaactaaacaaaatccaggaatccaatagcattttgaaatctccaaataattacagaatttatgttttaaacgtcagtttatgttaggtggaacccacgtttgactcttatttttaatacgcttattaaatggctttctttttgacaggctagtgcgattccaggtggatgtagggctcacctgtatagacaaggtgaaacatctgaatttggtggttttggaaatgtcacagtccgttggtgtggctataaaagaatacttgaggccaggcgcggtggctcacgcctgtaatcccagcactctgggaggccgaggcgggcggatcacgaggtcaggagatcgagacgatcctggccaacacggtgaaaccccgtctctattaaaaatacaaaaaattagccaggcgtggtggtggccgcctgtagtcccagctactcgggaggctgaggcgggagaatggcgtgaacctgggaggcggagcttccagtgagccgagaccacgccactgcactccagcctgggcgacagagggagactccgtttcggaaaagaaaaaaaataaaaaagaaaacttgacgctggataattttaaaagaggcttatttggcacatggttctgcaggctgtacaagaagcatgccaccagcatctgcctctggtgaggcctcaggaaacttccactggtggtgaaggggaaggacagctggattctgcccatcaggggaaggggtggggaggatggcaggaggagggggatgagatccggaagggagacggggaggggccaggttcattctaacaaccaggtgtcatggggaactaagattgacaactcctgggggaatgtgggagggggcggttatggcaccaagcctttcatgagggatccaccccaaaccccaacaggccccaccagctacattacggttcagatttcaacgtgagccctggcagggacaaaggacccgtagcagacaccaaggccttctgccatcccacaggaccctctcatcccaccatccctcagccttcttcctgtgcatttataggcaccttaacttttaaaattctgactgaagaacaaatcgcattggatgttttctatcagtacatgcaagtatctcattctttttaacagcatcataatatttagtgcatgggtgaaacacatggcgtgaaccacagttaattttaatcttccatcccatgggcaattgttaacattatgtcctgcttttgttttttctaattccagcagcattgtagtgagaacccttgtatgtgtcatatgtccatatgtcaatgttccctgaagtatcgggcagccctttagaagaggaatttttaggtacatgagctcatcaatgtagaattttgtttggatattgctaaattgtacttcgggagaagattgtgccagttttactctcacaccaagaatacaaaagtgtggccgggtgcggtggctaacgcctgtaatcccagcactttgggaggccgagacaggtggatcacgaggtcaggagatccagaccatcctggctaacacggtgaaaccccgtctctactaaaaattgaaaaaaattagccaggcacggtggcgggcgcctgtagtcccagctactcgggaggctgaggcaggagaatggcgtgaacccgggaggcagagcttgcagtgagccgagatctcgccactgcactccagcctgggcgactgagcgagactccgtttcaagaaaaaaaaaaaagaatacacaagcgtgcccgtgtccctgcacccttactacatggaactttcattctttgctactctaagaggtaaaaaatgatagacctcaatgttgtattttttgtttcagtgttattagagattttcaaggatccaggaattttttgagactgggagtagatgacctagagactccagattagaccgttggggagggagcagggaagactgcagtcgcacctctgcacttaggaaactgtggtcggctggggccagttcctgccacccgccatgcctgtgaatggagataatgtctctgtcctcagactgtcaggatgacatcagatgagcctggagctgagctcagtttctcaccccaggtcctggctctgtcaatgctggactggcccaatctctgtgccaggtccttccacctcgtctcgtctctctctttatcaaagtaggaaatgagaaattctgatggctctgaagcttagacactcaggctatcagagcccagagattggaggctgaagacagccagggttggccgtgctcctcttcagctctgtgactctgctgtggccccagctccttcctataaactaggtggatataaaagtctgcagcggccctgtgtaaaccacagtggtctgtgttggcagatgtgtgctgtcgtgtgggaggacaaatcacatgctcagggctggtgtcagtcactcaggactctggatccccagagcacctgtcctctacccagcagaggctgcacctgctcccacctgcacctccatactggctctctgagcttggggcagaaggttctaaggaatggggtggagcgccatggggaggggccgtggaggaacagaggagccagacttcaagttaggacaaagatgtcactgcagggccacagcctggcttacctgccacgtttccttccagttgtccttctggtgggcacccggcactggttgcagtttgaagagtgagcaggaaaggtctccatccatgtggctgcagatggctgctcacccagcccctactgagaggcaacagtcccagttctggtcctctgtcctgtatccaggagtgacagggcagcaaggctttagcttccaggtcggagatggggacagtgccatgccctgagcctgtgctgttgggcagttggtgtcacttagtctggaaaaatgccagtgccttcagttctctttcaagttcattaggacaggtgccctggggatccagagtcatgagtgactgacaccagccctgagcatgtgatttgtcctcctacacggcagcacacatctgccaacacagaccactgtggtttataaagggccgctgcagattttatatctgcctagtttataggaaggagctggggccacagcagagtcacagctgaagaggagcacggccaaccctggcagtcttcagcctccaatctctgggctctttgatagcctgagtgtctaagcttcagagccttcagaatttctcaatttctactttgctaaagagagaggtgaggtggaaggacctggcatagagattgggccagcccagccagagactgcacatcttcattcagggtattttcctaacccagggatgtggggattgttgctctcattttgtctggggagaaaatgagatttaggaggaggaagtccccagcatttgggacctggcctgcttgataatagcagctgcctgttggactgggaagggcctcttccggattcccaggcaggtatctgtgataatggggaaaggagaaagggtctgctttgtagggaagagcagggtgcactcggcacctcagacactcgcctgtggccaggaggggatgtgaatcatcacattttacagaggagaggaccaaagctcagagagggaaagtgtgtgcagctcagagggggaacgtgtgtgcacctggccacaggcaagtctgtccagagcactggtaggaatgagagaaactaggaatgaccactttaaaaacttagatgaagagaatctcaaagttaagtcattggagtttgttggtaatatatttgtgtggcttaggtcatgttaagtgcatcacaccctcgcccccatgtctgctgttggtctcagcactgggtggagggagcggggacagtcctgatgaagaggagaggggagcagcaccggctggggtggggcctctgccgctgcctcttcctgtgtggtttttcagggcttaggctgcgcctctcacctggcttgtctgtggggaggagatctttgttctctggctgcttttaagattttctccttaacagtgtggtttcagcacttcgatggtggcaaaaataatctgccggagccatgtctgtagcatttttggtctccccttctgtataatagcagccgtgttttggcttctgcagggctaaagtcctctgagcagctgcttctccacatctctgccctgcacttggcctctgggagctcctagggttccttagcagagtccacaggactcttcggggtcccatccctgtgctgtagcctggaacctgtgacctgaggcggtgagctgaggccaccactgggctcacctcatgggcttggagggaaagtcactcacccaggaagtaggtgatgagcactttactctgagaatgtctgcgcctggtggtggtgggaggacaaatgagccctgtgtcagtcctgctccctgaagcccacagtctggtggaggaggtgtcactagggacctaaataactatcaggaagcatgggggccacctcccccaccccccacctccagagaggctgtgccggctccagggatgccatccctccctacttgactccagcagttgcaaggccccaggtcatggtattggtggcttagaggatgtggtttcattaaaatcaacattgaggggaatgattgtactaacaacagcatgtgctgaaatacagtacttgcgtgtgccaagctctgttcttagcacttcatatgtaaatgaacacacttaatcctcatacaaccagactgtacaggaaccctcattgtctttgttttagacaaacagcatgagactcagaacatttgttcagtagaggggctgggcaggaggatgagcaaccctcggggcagcagcagtgattgggtcactgggttctgctgacctttcccaggggagtatttggtgctttttcatgaggcctgcattcacccagcgctgggtcactgctgggggtacctgagaagtcatgtaaagccacctcttatttccagaatgatagacatgtttagagaagaagtggcttcccccagaccatgaggctggcccgagactacaagacagatggcttgcttcttaacccaggggtctttttataccaaaagaacaaagaaataaaaaagccacgaaagactcaaaggaagcagattttcgaccacagccaacctcagaacaattctgagttgctcattttaagatcaataaggcatttttttagggtgtgtatgcctgagagaggaaatcagtgtgaatatcaaacttacctctgaaacagcctaacacaatgctaatccgagaggaacaaggcaaggaaaccccctggtgaatgactcatctcaggaagaggcagggcagggtcaggagagtctatggaggagaagacctggaacaagacctctctctcttgctctctttctctctctccctctctctctctcacacacacaaacacacacacaacctcacacccccatgagcccaaatctgtgaactgagaacctcacttctctgacctcaccttccatctcccttaatcagacgcccacaaacctcagagttgtgtcccagcatcacttgttttgactgccctccccgactgccttgacttcgtatctgcctaggaacctgcctgtgtggacttttccctctatgtggacctttccctctatgtctaccggtgtccctgccaccagtggcatttgtcacctctgcctgggcagcccctcgtgactcgggttattgatggctgtgcctcatctccctgggaactggaactgtcctaaggaaagggagggtcgtgcctttttcttgataccccacgattccttgcacagcgtttctaccaggcgccgacatgccctccttggatgaatgagtaacatgggttctaggaagcccgcaccaatgcagatgtgacgtcctcagcctttcatagacatgtttcatgtgagaggtgggaagaacagctgaacagaaggctgagcactgtccaggtccagagtcaccaggagctcgttgtcaggttttcacttgctattagtagagatttttttttaaggtactatttttagtgttagaagtgaattcaggccgggcgcagtggctcacccctgtaatcccagcacttcgggaggctgaggtgggcagatcacgaggtcaaggagatcgagaccatcctgaccaacatggtgaaaccccatctctactaaaaatacaaaaattagctgggtgtggtggcatttgcctgtaatctcagctactggggagggctgaggcaggagaatcacttgaaccagggattcggaggttgcagtgagcagagattgtgccactgcactccagcctggcaacagagcaagactccgtctcaaaaaagaaaaaaaaaatgaattcatcagaaggcataataatcataaatgtgtatatgtctaatagtagagctttaaaataaatgaagcaacgctcaaaaggattaaagggagatcatgtcacccccttctcagcaactgatagaacgatcagatgaaaacagtaaaataacagatctgaacattgtcaaccaccttgacttaactgacatttatagagcatatatgcaacatctatgggagattccttctcttctatgaacatggtacttcaccaagatagaccacattgtgaactataaaacaaatctaaatacatttaaaacaaaataatataaaatatgttctctgatctcaatgaaattaaagtgttaagcaataacaatatctagaaggactccaaaaatgtgaatattaagcaacatacttataaataactcatagttcacgaatgaaatcaaagagaattcaaaatatttcttttttttttttttgaattggcttcttgctctgtcgcctaggctggaatgcagtggcgtgatcccggttcactgcaacctctgcctcccgggttcaagtgattctcctgtctcagcctcccgagtagctgggactataggcacctgccagcacgcccggctcatttttgtatttttagtacagatagggtttcaccatgttgcacaggctggtcttgaactcctgacctcgtgatccacccacctcggcctcccaaagtgctgggattacaggcgtgagccaccgtgcctggcctggagtttcttttggggatgatgatgaaaatcttcaaaaattgattttattgatggttatacacttctataaatatatttaaaggaaagaattacatcatatataaagtatatctcagtaaagttcttaaggattaaaagaagaatggtatcaaaatcaatgactcagaggtgtgcattacttacccgtaaaataagtataaattaaactcaaaggtagtaacaacatgacaaggaaataataagactgaaatcaatgaaatagaattcaaacaataaaaggaatcaacaagctaagagttggttctcagaaatgatcaacaaaattaataaaagtaataaactggccggacgagatggctcatccctgtaatcccagcactttgggaggccgaggcaggcgattcacctgaggtctggagtttgagaccagccggaccaacatggagaaaccccatctctactaaaaatacaaaattagccaggcgtggtggcacatgcctgtaatcccagctactccggaggctgaggcaggagaatcgcttgaacccaggagaccgaggttgcagtgagccgagatcacgccactgcactccagcctgggcaacaagagtaaaactccatctcaggaaaaaaaaaaaaaagtaataaaccaaactttaaaagaaaaaaagaacaacagcatgaaataccaatatcaagaattaatgatgggatgttattacaaactctacagccattaaaaggaaaatagtgggatcttatgaataactttatgccaatcaatttgacaacttggattaaatagacaaatttcttaaaaaacactacttagcaaaatagccacaagaaataaagataatttaaatattcctaaagctgtctatgaattggaattcattgtttgttttgtttgtttatttatttatttatttatttagttatgctattttttgagtcggagtctcgctctgtcatgcaggccggggtgcagtggtgcaatctcagctcactggaacctccgcctcctgggttcaagtgattctcctgcctcagcctctggagtagctgggattacaggtgcccaccaccacgcccagcatatttttagtagagacggggtttcaccatgttggccaggctggtcttgaactcctgacctcaggtggtcgcccactttggcctcccaaagtgctgggattacaggcgtgagccacggcgcccggcccccctgctcttccttttctaatttaactttctaatttaaaaaatctcccaattacagaaaagatgcaaaaattatactataccctttactttgaaccacctgagagcaagctacccacagaacgcacatcacccttatacacttgagtggatatttccaacaaataaggacattctcccgtataaccacaatacaatcctcaatatcagacagtaagcatcagtacattactaccagctaatcctcagaccccaatggttttcacttgtctttataatgtaatttattgcacagaaatcctgtcctgaataactatactgctctttcatctttttctgactctagtatttcatgggacattggcaggctgttttgggggacagtttgtaaagtgcctttttaaacctgaagttcattatttaatatttgattcagtatcctgctttttaaaaaatttacacatcacctaaccctcattagtaaaagcgtgtgtatgtctgtgtgtatgtgaacactgcccaatcacaggagaatatccatttttctcaagggtacatgaaacattctccaggacacactatatgttaggccacaaaacaagtcttaatacaattttaaaaattgaaataaaacaaactatcttttccaatcacaataaaaggaaattataaatcaatagcagaaggaaaactggagaatccacaaatatgtgaaaattaaacaacacttttttgctgttttttttttttgagacagtctggctctgtcgtccaggctggagtgcagtggcacaatctcggctcactgcaagctccgtctctcaggttcacgccattctcctgcctcagcctcccgtgtagctgggactacaggcacccgccaccacgcccggttaattttttgtattttttaatagagacgggttttcaccgtgttagccaggatggtctcgatctcctgacttcgtgatctgcctgcctcggcctcccaaagtgctgggattacaggcatgagccactgcgcccggcctaaacaacacattttaaaacaaccaatgggtaaaaaaataaatgaaaagggaaattagaaaatgtcttgggaggctgagctctgtagctcacgcctataatcccagcactttgggaggccaaggtgggcagattgtgggaggccccacccccctcaaaaaagaaagaaaatatcttgagacagatgacaggcacactaaaatctcagaactcaccactaaagaacttatccatgtaacaacaacaacaacaaaaagcagctgtaccctcaaacctatggaaattagaaaaatgtttcaaaagaaaatatcttgagacaaatgaaaacaatataccataagttacaggatatgaaagcagtgttataatggaaaatgatagctgtaaatgctcaccacattaaaagaagaaataaatgaacaatctaccttttacataatgaagtagaaaatgaagagcaaacagctgggcgtggtggctcacgcttgtaatcccaacactttgggaggccgaggtggacggatcacgaggtcaggagatagagaccatcctaacacagtgaaactctgtctctaataaaaatacaaaaaacgtagctgggcatggtggcgggcgcctgtagtcccagctactcgggaggctgaggcaggagaatggcatgaacctgggaagcggagcttgcagtgagccaagatcgcaccactgcactccagcctgggcaacagagcgagactctgtctcaaaaaaaaaaaaaaaaaaaaaaaaaaaaagaggagcaaactaagcccaaaccagcaaaaaatagatcagagataacagaaatagagaatagaaaaactgcagagaaactcaaagaaactgaaagttgacccttaagagagatctataaaatgtacaaacctttacttagatggactaagaaaaaagacagaaaacttaaataaccaaaaccagaaatgaaagaggggacatttaaaacaactttacagaaatccaaaggattataaaaaatactataaataattgcatgtcaacaaactagagcacattgataaaactggtaaattactaaaaacacactacctaccaatattcaatcatgaagaaatagagattttgaacagaactatagtaaggagatagaatccataatccaaaacttcccagcaaagaaaagcccaggaccagttggcttcaatgatgacgtctaccaaacatttaaagaactaacatgaattctcaaattcttccaagaaactgagttggagggaacactttctaactcttcgtgtgggccccgcattaccctgataatatagaagtgatgaaaggaggcctccatgtcttgttcctgatcttggagaaaaaacctttagtctttcactattgagtaggatggtagctgttggcttttcatatgtggcctccaaatgtaagatctataagaattatacaactcttgtaagaaaacagcaattttaccttggggtatatatccaaaagaattgaaagaaagggcataaagagattttgtacacccgtgttcatagcagctttattcacaatagctaaaatgtgaacacaaaccaagtgcccattgacagatgaatggataaacgtaatacatatacacacaatggaaaggaatgaaattccaatgcatggtaccgaatggatggatcgtgatgattttatgctaattgaaatatgacagcctcaagaaaaccataaaatactgtatgtctccatttatatgaagtatgtagagtagttaaattcatagaaacagacagtagaatggtagttgccacaggctgggggcatggggacaaagagacaaagatgagcacaaacaaatggttgagttttagaactgggagaaagatgcaagttctgtctaattttggaggcttgggggaatggaatgtgagattgatcttgtaatgggtgagatctggaagccactcatgccagtccctgctttgtccccacaggtcgtacctagctcagctgcaaccatcaaacttcatgatcaatcaattggcacacagcaatgggaacatagccctttgggagagttgtgtccaccaggtacattctaagactgatctctaatcctttacacctctcttttccttaccctatactatatacaaaaattatctcaaaattcatcaataacattccttttccatgttcttcaagttttctgtttcctacagtttctggttcttctattcaacagatacttattgatcctttgccaaatccaaggttatgaagctttatccccatgttttctcctaagagttttgtactttaactcttgatgcattttcagttaatttttgtaaatggcatcagataagcgtccaactgcattcttttgcatgtggctatccagttgccattcgttgaaatgatgatttttcccattaaatggccttggcatccttgtcaaaaaccaattgaccataaaggtatgggtgtatttttggactctcaattcttttccattgatctatatctgtcctctttccagtgccacacagtcttgtagtgagttttgacatcaggaagtatgaatctttcttttttgttttccttttccagaattattttgtttatgctgggctttttgaaattccatattaattttaggatcagcttgccaatttctaaaatcagctgagtttctcacagggattgtgttgcacctgttgctcagtttagaggttcctggcatcttaacaatgagaagtcttttgatcccaaagcatgagtttttttgatttatttaaatcatctctaatttttaaaataatgtttcgtagtttgcagactataaattttgggttgattttgttaaacttattcctagatatttaatacttttttatgctattgtggataaaaccttttcttaatttcattttaggattcattgtgagtgtatacaaatataattgatttttgtacattgatcttgtattctataaccttgcagaacttgtttgttattcttaatgtttttataatggcttccttaggatttcctctatataagaaaatataatttgcaaatagagaaagttttaccttttcttttccaatctggatgctttttatttctttttcttacctaattgtcctggctagagcctccagtaccatattgaataaaagtagtgaaaacagatatcttttttggagaacatctttcagttgttcaccattaaatataatgttagctgtgggtttttgtagatattctttatcaggttgaggaagttcacttttattcctagattattttgtgatttttatcatgaaagggtgttggagttagtaaaatgctttctctgtgtttttgagataatcatgtgacttttggttttcattctattgatataatttgttacatcaatttattttgggatgttgaaccaacctttcattcctaggataaaacttatttggtcctggtatataattcttttttgttttgttttgttttttgtttttgagatggagtctcactctgttgcccaggctggagtgcagtggcgcgatctcggctcactgcaagctctgcctcccgggttcacaccattctcctgcctcagccttccaagtagcagggactacaggcgcctgccaccacgcccagctaattttttgtattttttagtagagacggggtttcaccgtgttaaccaggatggtctagatctcctgaccttgtgatctgcctgcctcagccttccaaagtgctgggattacagtcgtgagccaccgtgcccagcctataattctttttgtatgcttgtggattcaacttgctagtattttgttgcaaatttttgcaacaatattcataagaatcgttagtctgtagttttctttctttatgaggtccttttctggtcttcatattaagctaattgtattagtccgtttatatggtgctgataaagacatacccaaagctggcaatttacaaaagaaagaggtttaattggacttaacagttccatgtggctgcagaagcctcacaatcatggcagaagacaaggaagagcaagtcacatcttacttggatggcagcaagcaaagagcttgtacaggaaaactccaccttataataaccatcagatatcatgagacttactcactataatgagaacagcatgggaaagacctgcccctgtgattcagatatctcccaccaggtccctcccacaacatgtgggaattcaacatgaaatttgagtgagaatgtatccaaaccctatcacccctggcccctcccacatctcatgtcctcacatttcaaaaccaatcatgccttcccaacagtcccccaaagtcttaactcatttcagcattagctcggaagttcaccgtccaaagtctcatgtgagacaaagcaagtcccttctgcctatgagcctataaaatcaaaagcaagttagttacttcctagatataatgggggtacaggcattggataaatacatccattccaaatgggtgacattgtcgaaaacaaagggctacaggccccatgcatgtttgaaatccagcagggcagtcagatcttaaagctccaaaatgatctcgtttgactccttgtcttacatccaggtcacactgatgcaagaggcgggttcccatagtcttgggcagctccgcccctgtggcattgcaaggtatagcgcccctcctggctggtttcacgtgccggtgttgagtgtctgcagcttttctaggtgcacggtgtataagttatcagcagttctaccattctggggtctgaaggacaatggccctcttttcacagctccactaggcagtgccccagtagggactccgtgtgggggctctgatgccacatttcccttccacactgccctagcagaggttctccatgagggccctgcccctacagcaaacttttgcctgggcatccaggcgttttcatacatcttctgaaatctacgtggaggttcccaaacctcaattcttgacttctgtgcacctgcaggcttaacaccatgtgggagctgccaaggcttggggcttccacctctgaagcaacagcccaagctgtaccttggccccttttagtcacagctggagtggctggaatgtagggcaccaagtccctagactccacacagcacaagaccctggactcctaccaggaaactattttctcctaggccttcgggcctgtgatgggaggggctgccatgatgacctctaacatgccctggagacattttccccattgtcttggggattaacactcagctcctcattacttatgcaaatttatgcagccatctttaatttctcctcagaaaatgggttttcttttctagcacattgtcaggttgcagattttccaaactttaatgctctggttcccttataaaactgaatgccggccaggcgcggtggctcatgcgtgtaatcccagcactttgggaggccaaggcaggtggatcatgaggtcaggagattgagaccatcctggcgaacacggtgaaaccccgtctctactaaaaatacaaaaaaattagccaggcatggtggtgggtgcctgtagtcccagctactcaggaggctgaggcaggagaatggtgtgaacccaggaggcggacttgcagtgagccgagatcatgccactgcactccagcctgggcaacagagcaagactctgtctcaaaaacaaaaaacaaaacaaaacaaaaaaagaattatataccaggaccaagtaagttttatcctaggaatgcaacattggttaaaaacaaagaaacaaacaaataaacaaaaaaactgaatgccttttacagcactcaagtcaccccttgaatgcattgctgcctagaaatttcttctgccacataccctaaatcacctcttcccagttcaaagctccacagatctctagggaagggacaaaatgccaccactctctttgctttctttgctaaaatataacaagagtcacctttgctccagttcccaataagttcctcatctccatctgagatcatctcagcctggactttattgtccatatcactattaggcttttggtcaaagccattcaacaagtctctaggaagttccacactttcccacattttcctatcttcgtctgagccctccaaactgttccaacctctgcctgttatgcagttccaaagttgcttccatattttcaggtatcttttcagcagctccccactctactggtaccaatttactgtattagtttttttttttttttttcgtgctgctgatgaagacattcccaagactgggcaatttacaaagaaagaggtttaattgaacttacagttctacgtggctggggaagtcttacaataatgatggaaggcaaggaggagcaagtcatgtcttacatggatggcagcaagcaaagagagcttgtgcaggaaaactcccccttataataaccatcagatcttatgagacttactcattatcatgagaactgcaagggaaagacctgccccacatgattcaattacctcccattggatccctcccacaacttacgggaattcaagatgagatttgtgtggggacacagccaaatcatatcagtaatattgtccttatacaatgaattggaaagtgctccttcctctgctgtctttaaaaagggtttctgaataattggtattaattcttcttgaaatggttggtatcattcagtggtaaaggcatctgggcctcaactttgtttttctggtgaaaacatatacatgtatttagaattagccagctggattcagtttagatgatcccaattttgttggcaacatccaagacatggtaatcaggagccagtcgaacatatgccttcttctctccatcaggcctaatcagggtgttgaaccttggccacataaacatcatagagcttcttcacaacctgtttgatctggtgcttgttggttttaacatctacaatgaacacaagtgtgttgttgtcgtcttctatcttcttcatggcatactcagtggtcagtggaagcttgatgatagcatagtggtcaagcttgtttctcctgggggtgctctccagagtctcagtatcttgggccaccggaaggtgggtgatgtatggatattctttttttcatggcagtggacacctttctacactgccttcttggccttcaaaacctttgcatcgcttcagctttaggaggggcaggagcttccttctttgctttcagtgccatcttgtgaaaacgacttttctttaggagtagttttgataactaagtcaaaatctttacttgctatatgtctattcacattgtctctttcatcttgattcagtttcagtagtttgtgtctttctaggaatttgcccctttcatccaaggtacctaattttttgttgtacaggtttcatagtattcttttataatttttttatttctatataatctgtagtaatgtgctctctctcatttctgattctaatacagtcatgcctcagttaatgatgggaactcattctgacaagtgcatcattgtgcaaacatcatagagtgtacctccacaaacctagatgatatagcctactgcatccctaggctatgtgatatagcctattgctcttagattacaaacctgtactagtagacaattgtaacacaatgataagtatttgagttcctaaacatgtgaacatagaaaaggcccaataaaaatatggtataaaaggttaaaaaagatgatgtagttgtctagggcacttaccatgaatggagcttgcaggactggatcttgtctgggtgagtcagtgagtggtgagtgaatgtgaaggcctgggacattcctgtacactactatggactttataaacactgtacatttaggctacaccaaatctgtaaatttttttttccttccttcaatattaacttcgtgtaactattttactttataaactttttaatttttaaaactttttcactcgttttaacacttagcttaaaaaacaaaaactgtacagctgtacaaaaaatgttctttctttatattcgtattctataaacatttttgtatttttaacttaaacttttttttacttaaaaatttttttgttaaaaactaagatagaaacacagacattggccgggcgcagtggctcacacctgtaatcccagcactttgggaggccaaggcaggcggatcacgaggtcaggagatcgagaccatcctggctaacacagtgaaaccctgtctctactaaaaatacaaaaaattagctgggcatggtggcaggcacctgtagtcccagctactcgggaggctgaggctgaggcaggataatcgcttgaacctgagaggcagaggttgtagtgagctgagattgcgccactgcactccagcctgggtgacggagtgtgactccttctcaaaaaaaaaaaaaaaaagaaacacagacattaacctaggtctacacaaggacaggttcatcaacatcactgtctttcacctccacatcttgtcgcgttggaggatcttcaggggcagacacacatggagctgtcaactcctatgtcctctgataacaatgccttcttctggaaaactgcatgaggctgttttatagttaccttttttatttgtaagtaggagtacactctaaaataacattacaatgtatagtatcaaaaatacataaatcagtaagtcatttattatcattatcaaatattatatatagaacttcattatatgtgctatacttttaactggcagtgaagtaggtttgtttacatcagcattaccacaaacacctgagtaacgcattgacttatgacattactaagcgataggaattttcctcctccattataatattatgggaccaccgtcacatatgtggttcattgttgaccgaaacgtcatcatgcagtgcgtgactataatttgagtcttattttttccctgtgctaattttttaacacaattagttgtgccaatatatcgatctatttaaagaactagattttgagttcattaatttactctgttgtttttctgttctccgtctcattaatttctgctctaatctgtattattttcttccttctgcttgctttatctatagtttgctcttctttttcgagtgtcttagagtggattattaggttatagattgagatatttcttcttccttaatagacatttaggaaggatatttcttcttccttaatagacaatttctctgtaaacttcagctacgttagctgtatcccataggttttggtatgttgtgtcttcattttcattcgtcttattttctgatttctcttttgatttctttttagaccagttggttatttaggagtgtgctatttaatttttatatagctgtgatgttccccagtttcttcctgctattgatttctaattttattccattgtggtaggagagtgtattttgtattatctctatccttttaagtgtattgaggtttatcttatggccaagcatatggtttattttggagaatgttctatgtgcactttaaaagaatgtgtatcttgttttgattgagtagagtgttttatagacatctgtccagtctagttgttaatagtgttgttcaagtctactactttcttgttgatgttctttctagatttttttggtatgaattcctataggttaaggaaactatgctttgcagtgtggttttcattgcaagtattttctcctactttgttttcatcttagtcaagatttcttccatgcagttttcttcctaattttcatatagttaactttatgcaactttttagtttctcgtgagactgagaaggtcctttctctctccaaacttgtaagaaaaatttctcatgcagtacttgtgtgatttcatactttacagttgacaccttgatagacctagtctctatttccttatagggagagcataagcaagaagctttattatttttcagcagtaaccttagttgccccagcgccattactgaataatcatatttttatcatcgatagtgtcatcatcataacacatcagcaaggaagtttttccttcacagtggcacggtggctcactcctgtaatcccagcactttgggaggccgaggcaggtggatcatgaggtcaggagatcgagaccatcctggtgaaacctagtgaaaccccgtctctactaaaaatacaaaaaattagccaggcgtggtggcacgctcctgtagtcccagctactcgggaggctgaggcaggagaatcgcttgaacccaggaggcggaggttacagtgagccaagatcacgccactgaactccagcctggtgagagagcgagactccatctcaaaaaaaaaaaaaagcctttattatttttcagtagtaaccttagttgccccagcactattactcaataaccacatttttataattggtagtgtcgtcatcgtaacacattatcaaggaagttttttttccacagtttgggttttctaagagtatctttcaatatcagtaaatatgaatcagaggagagggataaataaatgggcactgaaaggggagagtgaggtcacctgaaggggcgaagccctggaggtgaaggtcgagcctccagacatgggctcccgctggcgacagctcctgcaggctgtcacctcagtgcctggagaccctctgcaatccagggcagcatgaggtaggccttctttctgtggatcattctttgactctgtatagggaggaccctttttccttccattttcctcccatggcaggtggcatgggctgtatctgaagccttcccctcatcgctgtattgtttctgcgcctgtttgtaccttctactgaccaagagctcactgagggcagggattaggactttttgtgagtttccagggatgcaggtggcattgccctggtctctaggcctatgtggccattaatcacttaaaacacagccactttgaattgagatgtgcagtgagtgaaaaatacactctgggtttcgaacacttagtattcaaaataaaagaaaatatctcaatgttttatcttgtttacatgttgaaatgctaatgttttggatattttaggtccaaaaagtacattgttaaaattaatttgacctcattctctttttactattttaatatggctctcatagaatttgaattttgcatgtggtttgtattgtatttctgtcagcagcgccagtcagaggtgtgtatagatgcagaattgacgacaagaccaagccaagaagatgggatttctctgtctggggtctactgatggccaaaagaagagtttcctagccaccgccacgatcctctgggaactctgtggcaattcattcattggcttttctctcccttcccaggatctcatagatcagaacatcctggagcctgtaaccggtgcacagagggtgtgggttacaccaatgcttccaacaatttgtttgcttgcctcccatgtacagcttgtaaatcaggtacagaatgtgtggacctcttgtccagaggtggagtgaggggcagtgaggtgggagtggtagccaatgtgagtcagggaaccaagttccagcccaacttggtcttcatcataccctgttccatggttatgtcttaggtccataaaatgaaacagaaagaaatcatttttataatgcatgccacctggtagtgcaaactatcagctccaagagggtaggggcatcattacagcacaaagaaggcctggctgagtggacagggctgagtttcagcggtggtacgggtctgctctggggccacgctccccctgggctgtgtgctcctggcaggttctcaggctcactcagccttcagtttctcaggcgcctccctcttcctcagcaggctgggtttttgggaagtcacccaagggctcctcttcttgcagactctctcacataccatgtgcctcctttgctactgaccatgcgatctaaatggtgctttttccctaatctgatgtaataaataatgaatcatggtccttttgtatgactccaagtgttggtgacagctgaagggtgggtgtcctgtgtgagcccgagtgtgctggtgcagaatctggccctcagaactccttggcaaactgagttgagctgagctgagggggagggagttggggtggtgaggaaaggtcaagggacacgtcagggaaacacattcccaaaaccttgtactctgtcatcagatgaagaagagagaagtccctgcaccacgaccaggaacacagcatgtcagtgcaaaccaggaactttccggaatgacaattctgctgagatgtgccggaagtgcagcagagggtgagacaacagccaaggggctcccagcagcctcaaagaacccacagaagcaaggaaccctaaaaagacccgagtctccttgtacccgtatctatcagccctgaccccatggtgcctccacccccataggtgtccctgagcctgtggcgtctcctgagcctgcaacctgcccctcctggtccatctgcctgtccccacccctgtcccctgcagtggccccttctcacccctccccagcactagtccccttggccaggctgacttgttcactaggcacaggaggccatgacttagggcccacaacagaggtacatgaaatattttatcttgaaatcataagaaaataatggtatagaatccagctggggttatatttatatttaaacaaattgagtcataaaatgtaatttttaatatttgcttttaattcaagaagacagaaatgcccacagcccgcaaaaatcataataaggccatgggtggagctccttcaagttcccatgaggacctgagcccacccagccagcctcacccctggcccctgatttctcaataagtcctgtctttttcctattttggttttggaagcaaagagtaattgctcttctctggtcctccagtgtttgctgtgattgagaggaaccagcagacaggtgggggcgagggctcacttgtactgtgggttaactggaggaaggggctcagcttgtggccacacgggcttgtgatcttcccctggagtgtgattcctcctaacgcaggcctcccctgcagcccagggaagattagtgtgtgcccagcacagaaggctcctggaactgcagctctgaccccagagcagggaggccaagggggtaaagtgtgcatgctcagacccttccccagcctaaacaagggagcatagggggaccccctgcagatacgaggagactatccttcccctgacgccttctcagggacattgggcagggagagtggctcctctttcatcccacctggccagctttccatcaagagtcccccccctccctccctgtgtgtacccaggtgccccagagggatggtcaaggtcaaggattgtacgccctggagtgacatcgagtgtgtccacaaagaatcaggtacaaagcccactggggaagccccagctgcagaggagacagggaccagcagcccgagactcctgtcttttcctgtcttttctcaggcaatggacataatatatgggtgattttggttgtgactttggttgttccgttgctgttggtggctgtgctgattgtctgttgttgcatcggctcaggtaggtgctggctgagggcaagggctctgggcactctctgccctgccttcttctgttcccacagacagaaacgctcacccctgccccaagtcctagtgtctctggccgggctctatcttcctccttgtgatcaccccccatcctcccatcctgtgcaaccctagggccctggtgtcatccgtccctctcccaaggctgggggtcccctcatctcccagccaagtctgggaaggcagggccagttcctccactggtcaggcccatccaggcagggggcagtcagctcctcaactggatgacaagagtcgagacgagaagtggttgtgggatttatgtagctttgttcagagcaaaacacagagcagaaaacagtgatgttccacttgtttgtttttagcctacttccctttatgctccccgctcctgaaggatctcccgagttagcagggcctcatgtggatccccaggcccggggatctttgtccagtgtcccagcccccagcccacccctgcccaacactgccctctaagaaggagtgctgcatgggcccctccctggccactaagggaaccgtcttctcttctaggttgtggaggggaccccaagtgcatggacagggtgagttgatttctccaggagctgggggcatcaggggctcaggaactgcttcttgcccacagtgtagtccaggtgggtgggtccccgtgctctcatggctgccctgagtctctgaagtggcctggatgctgtgcattgactatgggggacacaggcccttttgagcatcatacaggctggtgggccattctgtagccctgtgcttcctacagcccaggtgagacccttaccccacagcctgtaccctggggatggggtgagcccccaagcccagcaccagggcctggccccagcagcaggtcctggatgtgctgagcatggacttcctggagtgacctcactgggagggggtggtggcagcaggtccagccgtgccctacggaccccgtggggagccctgggtgtgggcttctgagttggctctttgccttcctaaggtgtgtttctggcgcttgggtctcctacgagggcctggggctgaggacaatgctcacaacgagattctgagcaacgcagactcgctgtccactttcgtctctgagcagcaaatggaaagccaggagccggcagatttgacaggtgtcactgtacagtccccaggggaggcacagtgtctgctggtgagttggggacaggcccctccaagaccttgtaggcagggggtgaaggccatgcctcggctctcctggtcaaaggggaagtggagcctgagggagatgggactgcaggggacggggctgcgtgggaaaaagcagccaccctcacaaggggacaggcactcttccaaatgtctgcttcttagtccctgtcctgtccttgccatgtcctcagaaactggagctccagaggaatagagtgggggtcacagggtttgttgatgactgaataaggctgcacggtctccactgtgtgctcctacagaagttagggagcccttgctcataacagcagggattttaaatttactctgaaattattattgcattaaacatatttggatctaaatctctgcccaaatttctgcatatggttgtatggaggattccaagaagaagcacaatttccaagtcagcctgtaacagtgctgcttactgtgtacacgcacatacacgcacatgcacacacatgcatgtacacacatgcacacacacatgcacgtacccacacatacaggtacacacatgcacacagccccctagtgttggtttgtaccagttcatgtattttgatttgacattgaagggctttttcttttctttttttttcttttttttgctatttaggaaaacattgttttaaacgaacatttctttgttttcactgtttttgcgtaagatcagtgtcttgtctctcagagtctttatgagaaggcctgctctcctactcatgctttttctcacattcagacagtagattcctaatttcttcttgcccctttttgttctaatattttcaggtgtagaagctttaatttttaaccagtgaaatctgtagatacttttaccttttcattgctcactactgtagaaagaccttttgccaacacaagacgaactcctctaacttcttatggagatatttttttcaatgatgtgatttttgcatataactttataatctaaatggaacttgttttgtgtttcagtgcaaagcgaggcactccctgaattgttctagtcactgtctggtttttccaacccctttgagctgccgattctcccatttccctctgctttgggtccctccttaatcacaggttaaatgctcatctagacaatgatctccttccacctagactgttccattcagttcctttcttgcattagtacccatttattctaaccaaaaatgtaattaaaaaaaaaagaaggcaaacattaaaaaggtcaataatctccagcttgataaggtgctttgacatgaacaaatagtttatatatttaaaatgagaaaatttaaactatcaaaaggtactcagtaagtaaagagagcatcctccactctgcagtgccctgggtctttttcctcaagtaactatgagatatcatttcttgtgattctttgtccaaatctatgcatcagtgtatgtgtatacaaaagacattatattattaacgaatggtccccaaccttttggcaccagggaccagttttgtggaagacaatttttctatggactgggaggtgaagatggtttggggatgattcaagcacattacgtttattgtgtactttatttctattcttatcacattataatatataatgaaataattatacaacttatcataatgtagagtcagtgggagccctgagcttgttttcctgcaacgagatggtcctatctgagggtgatgggagacggtgacagataatcaggcataagattctcataaggagtatgcaacccagatccctgacgtgcacagttcacaatagggtttgcactcctataagaatctaatgttgccactgatctgaccgggtggagctgaggtggtaatgccagcaatggggagtggctgtgagctatgtgggaccagaggtttttcaccatctccatggtgacccaagggggaaagtgatgtgctgcaggtttccgggctggctgatggtcagagtcagtactagactgcaggacccctgactcagaccaaggcattccccactgtgtgttacagggaccggcagaagctgaagggtctcagaggaggaggctgctggttccagcaaatggtgctgaccccactgagagtaagtgttttgctcctggagatgcagcagaaatggtgggaatagggacggtgtcctaactggtgtccccattgctgagagtgctcttccagagcattccatgccagaaactgggggtcctatgctatagaccatcaagaccctaaattgtcttctcccatctcttcttcccactctacctcatcctttctgcaccctattaatgacactagccactctgtctatcctcttctccacctcctctcttctcctttgttgttcaggagaacaacagccctgaggggctgccctgtcctgcatggcaccactgacttcagtgggctaatagctctttatctgtgcctaagcccaatttgcagagctgttgtataaactacatactgattccaaagacttaatgcaagaaagaatggaaaatattccactcattattttgttaccgaaacaccaggtgttgggtctaggtcttggtgctcactgcacagagggccaatcactgagacaattagtattgacaaggaagaatactttcattgagtgctgtaggcaaggagatgggagctcagtctccaattcatgtcccctgatggactaaaactaggggtttatatagtagggataaaatgtaacaatgtgggccgggcacggtggcttatgcctgtaatcccagtactttgggaggccgaggcgggcgaatcacaaggtcaggagatcgagaccatcctggctaacatggtgaaaccccttctgtactaaaaatacaaaaaaaaattagccaggcgtattggcgggcgcctgtagtcccagctattcgggaggctgaggcaggagaatggcatgaacccgggaggcagagcttgcagtgagccaagatagcgctactgcactccagcctgggtgacagagcaagactctgtctcaaaaaaacaaaaaagtaacaatgtgtaagaaaacaggaactagggaggggtaaggaagcaatcaagatgaatgaggggtccagcatcccattggatgtagtgatttgtaagtttcagttctttgatactttgagaggcctgaaggtcatttcctgaaaaaggaactcagataaaacaaatgtaagatttgagctttaagaacagaagggtcaatttctatgtttatcaaaacaacaacaacaacaaaaaaaccttttgatggacatattgggttgatttcagttctccctttctatttatcaatcccacagtcacagagagtctggtcctggatctttctggctgcttcatggttgaggaggggcatcatgggaagcttcacataccatgggtgacctcatggccacccaggaatcaaaggttaatttaatactaaaagattgtgtttcttctgaaacacaatctctctctctcggccccacttccaccaaagacaaattatagcaggaccaatgtacctgcaaaataagtttagttccatatacgtggcctgattacccacacaaagtgcagcaaaaatcactgtccacataggctctcctaagttggctttgctggaacctctcacgaggccattgcaatcaaagccctgagaaaataaccattttatccaactgtgttccattgtaaaagaaaacgttgttattaaccatatgtaagcaaacacattgccatgaattaatagtcacaaataatttaaaaattctagagaaattaggcagagagagaaatatgcctcaaattctgtttacaaaagtatactcaatatacttaaagtatacttaaaggctataaatagcaaagaagaaaaaagttctccagactggaaaacaaaaccaaaagaatcagcaatatttcaaaccaacaaaagccatacgaattatttcagtcctctattagttcagtccactcaatcagctcctgcccagcttcatgtttggttaacaatcacaatctttatgaacacatcagtctttcttctttttttgttttgagacagagtctcactctgtcacccacgctggagtgcagtggtgcaatctcatctcactgcaacctccacctcctgggttctagcaattctcacgcctcagcctcctgagtagctgggaccacaggtgtgcaccaccacatctgggtactttttgtatttttagtagagacagggttttgccacgttggccagtctggtctcaaactcctggcctcaagtgatagacattcgcctgccttggcctcccaaagtgctgggattacagacatgagccaatgcgcctggccacacattggtctttcagttactgcactggaagttttctctgtaatccaatgacaacaatttttaattatatgaaaaatttacttaaaacatcccatttacatttactcaattctttcatttttaagtttatccagattgcttctgaaaattgagatattagacaccatcatttaaagttagttaatttctttgtcagccatttttttaatagccagtgaacatcaggtgctcacctaagagcttcaaagttaaatatatagatattttcaccaataagtcagaagactcagctgttttcattaaaccaacaacattaatttaatcttacttatcaaaagcttgactcaaagatcattttgttttggttgggcttgtagtcttaagtttttgtgccaaactgatatctcaaaatatctagcaaagacaaatataagcccagacaaaaatgtatgctgacaattctgaagacacttctgttttcttattttaccaataattttaaagctgacttgtttagtaaggatttacttaagtcacatgaacttgaaaattgcttggaattatttactttatttatgagtactcttttacttataagtcaatttggtagacacaacatgtaacttaataataaatgtacatacacataaacacatctagacctatatgcacacacaaagatccaatagcttttacctttgaactctctccatgagacagtaatacaaactcaccagtctacaaatatgttcacatggctgaaatttgttagctccaatagataattcagtgaaggttgtgaacccaaattttaggtaaagcagtttccatggcagtttgatttttaaaggccaaacctctgcagactccaaacagcatcgcagagaacaccacctagaaccaactaatcaggcccaatgctgcttagaacagcaacataaaagcctggatacaggaactccatcctactttctcattcagcagcaaacttcagtttccaagcaatattggagccaaacagtattacaaaagaataccaagtttactgaattccaatttcccatgactctagcaaacacatagaaataatcaccaaaacataatacaactgctgcagcaacaaacaagctccaagagtgtccagactgaaacaggcagggtgcttcctctctccattggttaggtttgatcaacctgccaacaaaaattgctttcaaatttctcaaattgagaggagccagtcgtgctgcctggtacccacaaaagacactcacttgccctgaaacaacacacaattacaaacaagcctccaagagtgtccagactgaaaggcagagtgcttccctctcacagtcacttgggcctgttcaacctgcaaatggaaattcctttaaaaatttctcaaactgagaagagcagatcctgctgtctgggcccacaaaggacaatcacctgtctggatgcaaatgtcaaatttcaaaggcagttcttcggaagtaatcaggaatgtggttggggccggctgcagtgggacctgagagagactgaaactcacctccagccaaagttagcggggcaactgcttgggagggcttctgagtctcctggcccatggcagcagagccatgagcaacactttcccagccagggaaccaaaacctgttaccaaaacctcaggggtttggtctaggtcccgctgctcgctgcacagaaagccagtcactgagatgatgagtattgccaagaaggctttaatagggtgctgcagtggaagagatgggagctcagtctcaactgtatctccctgaccaactaaaactaagggtttatataggaggcaagaaatgtaacaatgtgtaagaaagtaggagctagaatggggcaaggaaacaatcaagatgaatgaggggtcccacatcccatcatggtctggatgtagtgatctggtgagtttcagttctttgctactttttttgagatgcttgcaggtctttcctgaggaagtaactcagataaaacaaatgttaagtttccagtcgttaaggaccagaagggtcaatttctgtttatcaaaaaaacctttctatgggacaattgggtcagtttcagtttttgtatactcattgcatattaaattatattttacacatattcagtaccacacattaaaatgaatgtcacttttttctttttatgttctttaaatgaggctgttagaaaacatagcttggtactcctggccccttctatccctgtggatggtggtgtgcagtgctttgcacacacatctcatttcattcaatccctggtagtcctgagatctgggcaggtttgctctgtcttcaggtttgcttcttggtcagggcctgcttgcccccacctagctctgccccagcctcagggagggcagaggtcccctgccccagaccctgcactttccacagatgcagaagtggccaccctgggacatgctcccatgacaagcgcagcccaggcagcccgcatcctctgagctcccgctgcagccactctccctccctccctcgggctctcacccactttgctttctgcctccgtagggtcaatccatcctccccaggtgggttctcagccctctctgagggcagattctctggtgaccttgacgcccgtcagcgccttgggggccacagaggccaggcagtgtgggtgggctctctgtggatgggaggtgggtgggcaatggagcaacaggtttgcccatgcagggggctctccaggttctctccttgggttctgggcctgatgtgggatcctctgccccttctgaactgagtcccaactcatctggctgtctctgtggctttctccacccagctctgatgctgttctttgacaagtttgcaaacatcgtgccctttgactcctgggaccagctcatgaggcagctggacctcacgaaaaatgagatcgatgtggtcagagctggtacagcaggcccaggggatgccttgtatgcaatgctgatgaaatgggtcaacaaaactggacggaacgcctcgatccacaccctgctggatgccttggagaggatggaagagagacatgcaagagagaagattcaggacctcttggtggactctggaaagttcatctacttagaagatggcacaggctctgccgtgtccttggagtgaaagactctttttaccagaggtttcctcttaggtgttaggagttaatacatattaggttttttttttttttaacatgtatacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaaatacaaaaattaactgga

SEQ ID NO: 88 - DNA, 54269 bp, Homo sapiens
gtgctctgagtttttggtttctgtttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgtgagattaagcactatgtatattgctttattcactccccacagcaaccttaccaagcagttcttttccacgtgaaaagatggaggctgggtggagcaaaaggaggtatttagagtcctcagcaagtgagaggcagagctgggatttgaatccagatctgcctgatactgaagtctaggctggttccacctctccggactgctttccagggagtagaagacagatattttaccttagctggctgcttctagaagtctgaccctgctggctcaaaacgactttagttccttgcccagaggctgcgggctgcgggtcaagacatcagtagaaggagggcccagccagagaggctgacatgggcttctactcaccgtcatctctccttccttccaggagcagcccctgggtgcgtccactttctgggcacgtgaggttgggccttggccgcctgagcccttgagttggtcacttgaaccttgggaatattgaggtaagcctgggatttccagaggaggtttgggggaaagagaagtggtgaacgctattactgttccctatctagacaccagtgggccgagtggagcagatgccagttgggaccttcccgccctctctttggttattaatccattattgttccctgtacactggtatgagtggatgggggaagtatttagccaagtttttgagacctgtactcggagctaaaatgcattgtcttcctatagtgcgggaccccacaactgtggaggagccgcaggggatactgggtagtacgcagacattatgcactaaatgacaatggctcacatagtgaaaagttattcttttttatttttttttttgagagggagtcttgctctgtcgcctagcctggagtgcagtggcgcgatctcagctcactgatatctccgcctcccgggttcaggtgattctcgtgtctcagcctcctgagtagctgggattacaggcacctgcttccatgcctggctaatttttttttttgtatttttagtagagatgggggggtctcaccatgttggccaggctggtctcaaacttctggccccaagtgatctacccaccttggcctcccaaagtgctgggattacaggcctgagccactgcacccggctgatttcacatttttagataatatgaccacattataaaaatttatgtatttttatataatgtgaccactagatgaaagcaatatacttaggcttttatttcttggttaagttcctacttattatgaatttactctgcatgccaggaattctaagaatttgcatgtattaactcatttgattctcgtaataaccttcacatgcaggagtcactattacagtgactgtatgaatgaggaaagaaaggcactaacagaattgattttatgttacttaggtcaagattttatgttatttaggtcaaggttaattgtgttgttcaaatcttgtataactctactgcttgtctgtctttcttacccattatcgagaagggaacataaaaatcttacactatgactgtagattgtcaatttctcattttaaattaggatcatttttcctttatgtctgccttatgtgatattagtataatgatatcagttggtacatctttttccatccttatactttcagtgtttcggtgttcttatacttgaaatgtgtctgccgtaagtggtgtattgttcaagtttttcttttattatagaaaaatgtattctggaaggtacttttcttaaaattacagtatttagtccattttcatttaatgtaattgtcaatataattgggctaaaatctactatatttccagttgttttttattcgtggcatcaattcacttttctctactttcttgatttcttttagacgaattaagtaattttagaaagttcaccttactcctttattagcttgttaattatgcatgcttttagtattctcttagtaattgcacttgagttgtactacctaatagtacagccacatgttgtttaaaacagctttactgagatatgattgatatacaacaaatggcatataaagtatataatttgataagttttgacatatgtatgacatatatgacagtcatatagacacactcatatatatattcatgtgccatttcagtcaatgaccgaccacatatatgatggtggtctcataagattataatacggtatttttactgtaccatttctatgtttagatatatttagatatgcaaatacttaccattgtgttacaattgcctacaatattcaatacagtaacatgctttgtaggtctgcatcttaggagtaatagtctagaccatatagcctaggtgtgtagtaggctataccatctaggttttgcataagtacattctatgatgttggcataatgacgaaatcactgacgatgcttttcttggaacttatgcctgtcattaagtgacgtatgactgtatatatttgagtggaactatcactgcagtcaggatagtgaacatatatattacctccaaaatatttcgtatgccctcttgaatcctgtcctcctgcccctccccacccctgctccttttaggcatttagttctgtaaattttctcctagccttgctttagcggcatcccatgcattttgatattttgttttgattttaatttaattcaatactacataatttccttttgatttcttttttgacccatggattatttagagttgtgttatttcatttccaaatatttggggattttccagacatgtttctgttgtccaggccaataacaaattcctgacgccatgaagtcaaagatctaactccccagggggagagttatgcccaagaaccatcggtattttgtgttagtggtcattgccagagtgaattccacagtgtttgtgataaaccctaataattccaccagagggcagcaagccaacatgaaaattctattaaaaagtctttttttagagacaagagtttggctctgccgcccaggctggagtgcagtggtgtgacctcggcttaccgaaccctggccccaccgcagactcaacctcccaggctcaagtgattctcccacttcagctccccatctgcgagtagctggaatataggtgcgcaccaccgcacctagttaatttttgcattttttgtagagatggagtttcatcatgtttcccaggcttgtcttgaactcctgggctcaagctatccatctgcctcggctgcccaaagtgccgagatgacaggcgtgggccactgtgcctggccagacagaagttttcaagtaaagaataaatttagctgaagagcagtgtcaaattatttctatccccaccctcctgaattaaatcttcgtagtctctgattctctttgtcatattcttaaccatttggattcttttcagtgcgtctgtgtttgttccttttccccagtatgacccctttctatttttttttttttttttttttttgagacagagtcttgctgtgtcgcccaggctggagtgcagtggcacgttcttggctcactgcaacctccgcctcccaggttcaaaagattctcccacctcagcctcctgagtagctgggattacagatgcctgccaccttgcccagataatttttgtatttttagtagagatggggtttcaacatgttagccaggctggtctcaaacttttgacctcaagtgatctgcccgcctcggcttcccaaagtgctgggattacaggcgtgagccaccttgtccagacccttttctctatctttatgaaaacatctctccagtagatcttcagagtaaaaaaaaaaaaaaaaaaaggaaaaaagaaaagaaaaaagaaaaagaaaagaaaacatccagcaaggtctcggaggaaaaatagaaaattagaagactggagtgagtcatgttgattttctggtgtaaaatttgtatcgaaaccttacataaatactgaagaattcacaagttgtaaatatacagcttggtgactgattttgatatccagacagtttttttcccacttgcacacactccccgcaagaatgcatgctggtttgtaaagtcattaatttactggtgcatcagtggatggctctgtgtcttctggctttatcttggcccagaaagacaggaattaacgttgagcctagtagtctttggcctttgtgccaaagcagtctgtgggccagccttgtgtagtgatcaagcagtatgtttagatgtcaggcatgacacgggttaaaaagccagctaggggaaaaatgggaagtggcattttgcgatctcatcaaacaatcttgatataaacttagagaacaacctcttggcaaatggagagcagctgtaggtttctgactgaatgtgcaagaagaacgtgaatgaaagagatatactaggtgggagcagtcagggtagacttcctggaggaagtggacagtgttgtgtggattcacactttggagatatcaaagaggaagagtattccaagtgggggtaacaaataacaagggaggcaaaaaagaaaagtatgagggaacaacaggatgttgtcaggaaactaaggctgagctgaaatccaggtgacccagagaagccttgagaaggcttgtggcatcttgtggagcaagtggggaacttgctctgtttgagagaatatgcctggaatatatgggatatcatttaaattttctaaaggttatctacaagataatttcagagaatattcgctcccacctcagcgtaggaaacaatgaaaccctgaaacatttatttatttattttccttgcttttcttttttctttcttttttttttcttgagatggagtcttactctgtcactcaggctggagtgcagtggcgtaatcttggctcactgcaacctccgcctcctgggttcaagcaattctcctgcctcagcctcccgagtagctgggacaataggcatgtgccgctatgcctggctaattttttgtatttttagtagagacggggtttcatcatgttggccagactggtcttgaactcctggcctcaagtaatctgcccgctttgggcttcaaaagtgctaggattacaggtgtgagccactgcacccagtcttttccttactttttattttatttatttatttatttattttttaattgatcattcttgggtgtttctcacagaggaggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatctacaggatcccaaggcagaagaatttttcttagtatagaacaaaatgaaaagtctcccatgtctacctctctctacacagacacggcaaccatccaatttctcaatcttttccccacctttcccccctttctgttccacaaaaccgccattgtcatcatggcccgttctcaatgagctgctgggtacacctcccagacggggtggtggccgggcagaggggctcctcacctcccagtaggggcggccgggcagaggcgcccctcatctcccagacggggcggctggccgggcggggggctgaccccccacctccctcccggacggggcggcttccttactttttaaaaatacgtttgtcttcaactattggatatcttcatctaatttctagtgttttttttggttgttgttggcttatttgatttttactttttggttaataacaaaccttttaaggagttacatagactcttatcagtttacttttctaatttgttttctcctgaattctcagttaccttggattgattgtgctttgggttcatcttgctttttcttagtggctactttcagtttccttcctcttcagtttggcaattttttcccttttcaagcaaggagctcctccctgttgaggcgtcacgggtggcgggcaatccttacccggatcctcccacagcttgctctctggaagctcacactgcaccgtaattatgaaacttttgatattgtccctgatggcttctgatgcaagctgggacagcatttgtctgttgataagtgaaaccaagttcctgagatctggctctcttttgcccttctatccaataccagcaaggccctagtttcagagcattttggggacttatgatcccttctagttacctctgcatctgtgccccttttcccctcaaattagttcatagagatttttgaagcacccatgttactcaaataggcccatttttagcatgtgggaggtaaggcctagatgtgaatccctcataagccaggcagatcaaactgtgtgtatgcatgcagatttggcccaggaacactcttctccttcagggcccattgtctacaaggacagaaaagaattcttaaggccattcactatctcacattttctgttatttttctgtcttttccttttccccctacccacagagaaacattagaatcattgccctttagaagagcagaactatgatgcctcctgtcagggatggaacgaggcattccatgcagatgacaacccaaagagagcaagagtggctctatttatatcagacaaaatcgactttaagtcaaaaactgtcacaagagacattaaagtatattatataatgaaaaaagcatcaatccaccatgaagatataacaattataaatatatgcactcaatatcagagcacctaaatatatgaaacaaacaatgacagaactgaagggagaaatagccagccatacaaaaatagtaggagacttcaacactgtactttaaataatggatagaacattcagacagaagattaataaggaaacaggggacttaaacaacattatagaccaaatggaccgaacagaaatacacagaacgttccaccctacagcagtagaacacacattatcctcaaatgcacatggaactttctccaaggtagatcacaagttgggtcacaaaacaagtctttgcaaatttaagagactgaaatcataccatgtatcttttctgaccatgatggaatgaaactaaaaatcaatggcagaaggaaaaatagaaagttcacaaatatgtggaaattaaacaacacactcttgaacaacaattaggccataaaaataaaaaaagaaattaggaaatatcttgagataaatgaaaagaaaagcacaacatacccaaacttacaggataaaagcagtactaagcaaagaagtactaagaggtactttattgcaatacacatctgcagtgaaaaagaagaaagatctcaagtaaatagtctaacttcgtgcctcaaggagaggagaagaagatgaagaagaagaggaactaagcctaaaattagtgaaggaaataacaaagattagagtaggaaccaagaaaatacagaatagaaaagcaatagaaaaaaaatcaacaaattttttgaaaagaataacaaaagaattggttttttgaaaagataaacaaaatcaacaaatccctagttaggctaagtaagaaagagagaagactcaaataaacaatatcagaaataaaagaggagacattacaactgatgccacagaaataaaaacatgaggctataatgaacaattctattccaacaaactggataatctagaagaaatgaataaattcacaaaaccttccaatctacgatgactgaatcatgaagaaatacaaagtctgaacagacttataactaatgtggaggtttagtcaataatcaaaaatgttccccaaacgaagaagtccaggaccagatggcttcacaggtgaattcttccaaacatctcaagaagaattaatgccagttcttcttaaactatttttaaaaattgaagaagagggcacacttccaaatttattttatgtggccaacattatcccgataccaaagccaaacaaagacaccacaagaaatgaaaactgcaggtcaatatctctgatgaatatacatataaaaactcataacaaaatactagcaaatcaaattcaacagtacatttaaatgatcgtacatcctgactgagtggcatttatccctaggatacaagtatggatcaacatacaaaaataaatcagtgcgaaatggcctattaacagggcaaagatataaagataacatgatcatctcaatagatgcagagaaagcatttgacaaaattcaataccctttcgtgattaaacaatttttcaacaaactggaaatagagtctcaacatcatcaagaccatatataagaaaattttcactgttgagtattatattagatgtgagcttttcatatatgggattcataatatgtttcaaatatattacaaagctatagtaattgaaacagcatgggaatagcataaagacaaacacataggccatcagaagagaagagagagctcagaaataaatccatgcatatacagtgccttagtccattcagcctgctaaaacaaaataccatagactggtggcttataaaacacagaaatttatttttcacagttctggaggctaggaaattcaagatcaagtagctagcagatttgctatctagtgagggcctgcttcttggttcataaatggccatcttctccatgtgtcctcatggaattagggtgatggagcgctctgggatttcttttataaggcactagtcccattcataagtgctctaccttcatgacctaatcacctcccaaaggtcccatctccaaataccaacacataggggattaggtttcaacatatgaattttaggggaaacaaacatcagtctattgcatatactacctaaagcaatctacaaatttggtgtgatctctattaacatcccaatggattttttttttacagaaaaaaacctctgaagtataaaaaggaccacaaatagctaaatcagttttgaggaagaacaaagctagaagcaccatacttcctgatttctaaatatattatactcccatggtcatagcagcactatttacagtagccaagatgtgcaaacaacctaaatatctaggatggggaaagaaaatgtggtagtcacataaaatggaatattatttgccttataaaggagggaaattctataatataagacaacatggatgaatcttgaagacattatgctaagtgaaataagccagtcaccaaaagacaaatactgtatgattctacttacatgtggtatctaaagtagtcaaatttatagaatcaaagagtggaatggtggttgccaggggctggggaggggggaaatgagttgcctgtcaacaagcataaagttttagttaagcaagatgagtaagttctagagatctgctgtacaacattgtacctatagtcaacaatactgtattgtacacttaaacatttgctaagagggtagatctcacttaaatgttcttactacaataaaatataattgataaagcaatagaaaaggattcctatacataggattcctatacataaaaaggtcaatacctaatttccatttaattaaaagcaatgaatagtcaatttacacacaagacaatttctgttattgaggcagctataggatatagaagagatttcccaactcactttgcaaggtgcacatagccttgaatccacaagcataatgtaaataatttacttttaagaaactcagacagaaaaatcctataatcatctcaaaagatcctgacatttctttttgataatttaatgcccctttctgatttttgtcaaatactaggaagctaataggtaaggaaaagtccctaacttgataaaaatacctaccagatgcccaaatcaaaaatcatatgaattaggaagttctggagtgcttctcattaaactcaggaacgtgtaatatcgttattaatgtattgttccaccctgttttggagggcctggccaatttaacaagttaggtgatttgataagttagtttaatacgcataacagcatggctgtcccgaggcatacaggaggcgatgggctgagtcctgactgcagctcccccaaggacctgccacgcatggattatacacaaagtctgttcaagtctgttgagggagtgaagggtcggggggcagcaatcccctgtttggcctgccaggtaaagcctttgtaattgctaatggctgggcctgacagattacacataggattttggcctggagcccaaataattcctaaactccatcctttgatttttcagagcccaagcgagaaacataggctaccccatcatggacctgaatgggttggattttgagggtctctgttaggagccaggttattagtctgcagttacaataaatagaccatggtcaggatcaagatcacttccagcatcgtgtacagattaatatgcctggggtagcttaggtaccagaaaaatccatgtttacagaaatgtttgtttgcagcattcagtggcacaggaacaaaatatttatttgtggggatacatccagcattttgtcaaattcactggggaactgcctgggacaggcatatcaatgaatttagtgacttggaagtcacacagtctattctgtaggagagagagaaggaaggttagattcccacttctccctcctctgtaccctggctcatgggttcataggcgctcacgttgggggaattttccccaaccactgtgacatgggtaagggtagcatcttccgactatcctccagggaggtgggctgtaatctggcctggatcctctgatgactaaaaaaaaaagtttctcttctgtacattgatatccatcccttgaaaataaccaggcaaagcaacaaagccactttatggaaaacattgaattagaagcctcaagttgatagtgattattttttgcaggcaaaaaaatccatgctcagcaccaaagggataactgatgaagagggttactgtctctcatgctttgttttttaatagctaatctaatctctcacctatctgagtctttagaaaggaattgaagggggtggggggcccttgtagggttccccagagagactgaggctgtgcaataaaaggaagcaggtagacagtctgatcaaatatgcagcgcaaatgatgactgcccctttgaggaatgccacactgggaccccagactgttcccctgagatgcatagtccaggccgaggttcttttattccctcctgtcagtcacttaaccctgtccttcaattgtctactaaaacactcaatcatccctgctgcttggaggcgatagagagcatagggcgtccatcatatatgccccatgcttgggcccattgatgtgtggcttgggccacaaatctggggccattatcagatgcattctatgcctgggaatcaaccatctaagatctgaaattgtgtcaccgattgattgacctgacctcacaaggaggttttttatttgtttttgtttttttttttgagacagagtctcactctgtcacccaggttggagtgcagtggctcaatctcactgctacttccatctcccaggttcaagtgattcttatgcctcagcctcccgagtagctggaattacagacacgcaccaccatgcctggctaatttttgtatttttagtacagacagggtttcaccatgttggctagcctggtctcgaactcctaacttcaagtgatccgcccacctcggcctcccaaagtgttgggattacaggcgtgagccactgtccccagccactggacttgataaccatccggagtatcatgaacaaagctagaaatctgagtctggttgcaacctcatcatctgctgcttccacttccttatcatagacccaggggaccaccagtgtagcctgccacggctccaggtttggagtgaggcgtaggttccaggcagctcctgttgaccctgctgctgcaggccaggtcagctgtccttgcccaggtgtgaatcatgggcatgtatctccctgctgggcttccgctttgctgccctttcctggccctttggccagagagagcaggcttttctttctgttgcttttccttgtttgttcttttttttttttttttttttgagacggagtttcgctcttgttgcccagactggagtgcaatggtgcaatctcggctcaccgcaacctctacctcccaggttcaagcaattctcctgcctcagcctcccaagtagctgggattacaggcatgtgccaccatgcccggctaattttgtatttttagtagagacggggtttctccatgttgaggctggtctcgaactcccaacctcaggtgatctgcctgccttggcctcccaaagtgctgggattacaggcgtgagccactgggcccagccatttgttctttctaatttaggcctgttggtggttctggattgcaggcctctttcgttttcagtctggcatgtgtgggaataaaaagacagcccagggcacaaaacagggtgttgttcctgcctctgggtcccccgccagtctgcctctactttccacctctcagggttgtgtgattgtctgttgatttattcccagggtatttaggtgtccttagaggggagaagcagggaaaagtgaatctatgccatcgtgtctcggaactggaagtccacccccatccccacacacactagaattgcagaagaaaaataagatgagaacttgagtgaaaaaaacatattattatgcaatcatcaaatgtttggacagaaagtgttcttagacaacctctagtctaatttctcacatttggaaatctggaagttggactaagacctgaatcgaccaccctcacccccagttcagctgactgactccccagcctgtattctcaccattccacaccaggatctgtcctgaggctttgaaaaaatgtgaactgcatgtcctgctcagatcccaaccctcccacaccactttgctaagagtctgttctgtctgcaaaaatcccaaaagttgtgtcaactggaacgcaaaatgttcttcatttgactttcattgttttttggaattttggggggccagggaggagcaagaaaggagctgcaattgcccttgggtaagatttgcttagaattttaggaagaagttgtctgggcacagtggcttactcctgtaatcccagcactttgggaggccgaggtgggtggatcacgagatcaggagttcaagaccagcctggccaagatggtgaaaccctgtctctactaaaaatacaaaaactagctgggtgcagtggcaggcgcctgtattctgctagggagctgaggcaggagaattgcttgagctggcggggtggaggttgcagtgaaccaagatcacaccactgcactccaggctgggcggcagagtgagactgtctgtctcaaaaaaaaaaaaaaaaaaaaaaaaagaagaattttaggaagaaatctatctgattctagaattatctaggctgttgaggatgtgtgtctggtggccactgggacatcagggtgagacttttcttttaactgcatgtatgtgaattaggttgcttctggagcctactgagagctcactgggtccccatagcatccatgctgaaggcgccttccttctgtctgtgaccttgaccctcagctccacatttccccaggggctgcaggatttctcagaatcctcattagcacaacctatttttttttttttttttcctgaaacagagcctcactctgttgcccaatgcagtggtgtgatctcggctcactgcaacctctgcctcccaggttcaagtgattctcatgcctcagcctcccaagtagctgggactacaagcgtgtgccaccattcctggctaattcttgtatttttttttgagatggagtctcgctctgttgcccaggctggagtgcagtggtgcgatctcggctcactgcaacctccacctcccgggttcaagggattctcctgcctcagcctcccgagtagctgggactacaggtgcccgccaccacacctggctaattttttgtatttttagtggagacagcgtttcactgttttagccaggatagtctcgatctcctgacctcgtgatccgcccgccttggcctcccaaagtgctgggattacaggcgtgagccactgcgcccggccaacttttgtatttttagtagagatgggggtctcactatgtttgtcaggctggtcttggactcctggcctcaagtgatccacctgcctcagcctcccaaattggtaggattacaggtgtgagtcactgtgcctggacagcaccacctattagtgaatgacagccttgacttttgaggctaaaactttccacttctttagtatagtaattaaatctctcgctttttctactatttcggtaattaagcaggtaaagaaaaatatccagaacaatataatagggagtagggcaagaaaatcctgaggaaccacgacctgtgggtggatcgagtgcaggggtccttgagtgtagctggttgcaggaaggccccagcagaagggggctttgatgagcatccaccttgtgtaccgagtgaatgtccgtccagatgaggtgcggatgcagctgacaatggaggcgactgtaatggactatcccaagtagcaacatcatcaatttaggttttcagcctgagtgagactttcagttaatactcaactgaaaacaagatgcaaattttccttcagaaatttgttgaaagtgttttcactttggtactattgatctattaaagggctgagatgcagaggagacaccattgtgtaatttctagtggccgctctttttgtccgttatctgttcactgttctatccatgctgttctgccacacccctttttcacttaccaacacatgttggagattgctctctatcatagcatttcctctcctattctctagcctgcctcttcactctcttaatggtatcatttttctgaaaagaagctcttaattctaaaatggtcctgttggtggttttttccccttatggtcagcactttttgtgtcctttttgagtttttgtctactccaatatcataaagacattctcttaggatttctcataaagttttactgcttccttcttttttgagagagtcttactctgttgcccaggctggagtgcagtgctgcgatcttggctcactacaacctctgcctcctgggttcaagcaattctcatgactcagcctcctgagtagctgggactacaggtgccccccaccatgcccagccaatttttgtatttttagtagaggtgggggtcttgccatgttggtcaggctagtcttcaactcctgacctcaggtgatccacctgccttggcctcccaaagtgctgggattataggtgtgagccaccacgccctggtcaattgcttcctttttatatttagattgactatccatctggatttgaattttgtgtgggtaggaaatcaaggctcattttatttttatatggctatcttgttgatctgtcgttatttactataaagacgatccttttttcacttcacctcattgtcacctttacccatgtatcaagtgagaatagagtgtgagactttaaaaaattaatggattattttttaagaacagtttcaggtttagagaaaaaacagagcagattagctgggcatggtggtatgcacctgtagtcccagcttattcatatgcttatttgccatctgcgtatctttttgtgaggtgtctgttcagacctcttgcccacttttcaatcgggttgttttcttattgttgagtcttaacagattagcttaatcagattggcttcgggaggctaaggcgagaggatcgcttgagcgcgggaggcggaggttgcagtgagttgagatcacaccactgcactctagcctaggtgacagagagagaccctgtctcagaaagaaaaaaaaagaaagagcagaaagtagagagttcccatataccctctgcctcctacacttctcccctccccacactttcccgttattaacatcttgcattagtgtggtacatttgttacaagtgatgaaccaatattgatattgtaggggagggcaaatctgttttccttctacccttctaagttcatggctgagaaccctataacagaagacagattaataagagaaaagtgcataaacatatttaagttttatgtgacatggaagcctttataaggaaatgaagactccaagaagcagttacagtttgatgtaggtttgataaagggtggacagttgtggaggatatgatagagcaaagagtttgaagtaagtgtagtccgctggcagaagcttatcaaggcccgtttgtttagttagattcctctctgtgtccctttgtcttcacagataccaccaggtatagggagggcatctctcacctgagggtcttatgacctggcttcaggagaaggtcagaaaacccttcctgcacatgctgcttttgcaaattccttcaccttaaaatattcaatatgtcattgtgttagtctgttcttgcattgctctaaagagatacctgaggttgggcaatctataaagaaaagagttttaattggctcatggttccacagactgtataggaagcatgatgctggcatctgcttggcttctggggaggcctcaggaaacttacaattatggtggaagacaaagggggagcgagacatctcatgtggctagagcaggggaagcaagagagcggggaggtgccacatatttttaaacaaccagaatatcatgagaattctatcatgcaaacagcactgtggggatggtgctaaactattagaaaccacccccaagatccaatcacctcccaccaggctccgcctccaacattaggaattacaactggacatgagtttgggtgaggacacaaatccaaaccatgtcagtcgtggtgccatattttgtggtagcacgtcctgaatcccatcaataaattattctgaactaaagttccatagtttccattagggttcacttttggtgtacatcctaccggttttgccaaatgaataatgccatgtagaaccgttacaatattgtacagaataatttcactcccctaaaaatcccctgtgctgaacctattcacacttcctcccctgagtccctggcaaccactgtctctatagttttaatcagaatgtcacatagttggaatcatacagtatgtagcctctccagattgccttctttcacatagtaacattcaattaaggctcttccatgcctttgcgtggtttgatagctcatttctttttattgctgaataataatctatggtatggatgtgccacagtttatccattcatttattgagggacatcttggttgcttccaacttttggcagttatgaattatgaataaagctggtataaacattcatgtgcaggtttttgcatggacataaatgttcaatttgggtaaatatctagaaacgtgattgctggatcttgcggtaagcatatgctttggccaggcgcggtggctcatgactgtgatcccagcactttgggaggctgaggtgggatcacctgagatcagcagtttaagaccagtctggctaacacagtgaaacctcatctctactaaaaaaaatacaaaaattagctgggcgtggtggcgtgtgcctgtaatcccagctactcaggaagctgaggcaggagaatcgcttgaacctgggaggtggaggttgcattgagccaagatggcgccactgcactccagcctgggcaatagagtgagactctgtgtcaaaaaaaaaaaaaaagaaaaaaaaatggccaggcgcagtggctcacacctgtaatctcagcactttgggaggcggaggcaggtgtattatttgaagtcaggagtttaacaccagcccgaccaacatggtgaaaccctgtctctactaaaaatacaaaaattagctgggcgtggtggtcatgccggtaatcccagcaacttgggaggctgaggcaggagaatcgcttgaacccagaggcagaggctgtagtgagccaagatcacacttgccgttgcactccagcctgggagacagagtgagactccgtctaaaaaaaaaaaaagcttcatgacaaacttccagactttcttccaaagtgtccgtatgagttttcattcccacgagtaatgaatgagagttcctgttacttcacatccttgccaatgtttggtggtgtcagtgtttcggattttagcaattttggcaaatatgtagtggtatctcactgttgttttaatttgcaattccctaatgacatatgatgttgaacatcttttcatatgcttatttgccatctgtatatgtttttggtgaggtatctgttcagatctcttgcccacttttcaattgggttgtttgttttgttattgttgagtgtcaagagttctttgtatatttttggataacagcatggtttttgtttttgtttttgtttttttttgagacagagtctcgctctgtcaccaggctgtagtacagtggcatgaacttggctcactgcaacctctacctcccaagttcaagcaattctcctgcctcagcctcccgagtagctgggactacaggtgtgtgccaccatgcccagctaatttttgtatttttagtagagacgggctttcaccatgttggccaggatggtctggatcacttgacctcgtgatccaccagtatggttgagttttaagagttctttgtacgcttttgggtaacggtcttttgttttgcaaacattttctcccaatctgtggtttgtctcttcactcttaactgtatcttttgaagggggatctcaaagaacatctggtcccccacaacaacatgtcatgtcaggtgagagatgactcattttctcagaaactaggattttgtgtcatatgttgtaaaccacgaaaagttaattttataacccaccttctagatctactgagaatacgtggtgttatcactaacagttttgaggaaagaaataattgcctaattcattttgtagtgaatgtgttttgttactaccacagatactcttaaaatccacttattatggagggggaaaaaaaaggaattttctttacagaaagtgaggagtgaaacctaatggagaaaatatctgtttcagggaataaccctcccaacatctgatttttttttgttttagacaggggctcgctccgtcccccaggctggagtgcagtgatgcaatcatagctcactgcagccttgaactcctgggtttaagcaatcctcctgcctcagcctcctgagtagctgggaccacaggtgtgcaccaccactgcaccaccacacccgactaatttttttgatttttggtaaagacagtatgttgcccaggctgatcttaaactcctgagctcaagtgatcctcccacttcagcctctcaaagtgctaggattataaatgtgagccactgcacctagcctgatcttttttttttttttttttttttttttttttaagaaacagtcactagtgctgtatgtaggttacagtagctatgtaggcccttcagagtcacttcacttttctgagctttcgtttcttcaacgtcttcctgtctgtaagacacatgctcttctacccctgagaccaaaaaatgttaccagtgaggatctaatgatataaaatagggaaaatgctttaaaactgcacagtgcttaacaaatgcactgttattatatcattaaaagtgactcctgggtggtgggaatggttgcataacgacgtgaatgtacttgatgtcacttaaaactggttacaatggtaaattttatggtatatatattttaccacaattaatacattttaaaagatggttcttgacaattattcttagcgtctgaggtgccccatttcttgggtatgggcatatagtgcctcaagaatattggggatcctcacctcttctatgcccaaacctttaagaaaattctgggccaggcgcagcggctcacagctgtaatccaccactttgggaagccgaggtgggtcgatcacctaaggtcgggagttcgagaccagcctgaccaacatggagaaaacccgtctctactaaaaatacaaaattagctgggtgtggtggcacacacctgtaatcccagctactcgggaggctgaggcaggagaatcgcttgaacccaggaggcggaggttgcggtgagccgagattgcaccattgcactccagcctgggcaacaagagcaaaactccatctcaaaaaaaaaaaaaaaattctggaaaagctaggtcagtgacatgaatattggaatcagagtctaacaaactcaatttcttcctttctaaatccgtggtacggattcatgtctgcagtagtttttctgagaaagcagaaggggtaggtattggcaatcaacaagctgcagagtatgcagattgaggtcagtaactgtaaatgccccatgactgtctgatcattttaataccaaaagaaaaacttaaaatcccagttgctaaaatctttgtcttagacaactctttgagcctctccctacaaggcccagaaaggaatgagatagatgtgaatggaatctgttttcccttcccttgccacgctctggaggaggagtctagggcagtagccaaggccagctgccagtcaaggaaaggggagcggccccgttgaatccacaaaccacaccatcctggcccatgggttatatacaaactcccacattggcaacaaacaaagggcatgcacattcaggggattttgctttcactgtgagtgtttatctttgaagggtgtcacatcaagatgaatgggaagggtgtgttgcagttgagctgaggtttggtctttcttggcttttttagggacacttacaggtccaaatctgctttcagccggctggtggacatggtaggagacacagtagtctcaggaccaggcctccaggtgggagctgagattctagagggtggaaaccacttggagattgagtcaaagcagacctgtcctcattctgtgctgggcaggagccagctctccatgtccctgcagctccagcaacacctccggatctttcagcttccctgggactaaggaccatgcacattattaattctgatataaacagtcacacaggcacatgtctcaagatgagggtgagaagttggttacagcaaatgaagtaataatgatctttgtgcttcacaataggaattcaaccaacctgaggtttataattcacttattaacactttttatttttgttgagacggagtgtccctctgtcactcacgctggagtgcaatggtgtcatctcggctcactgcaacctccgcctcctgggctcaagtgagtctcgtgccttgagtggctgagactacaggcacatgccaccatgcccaactaatttttttgtatttttagtagagatggggttttgccatgttggctaggctggtctcaaactcctggcttcaagtgatccgcctacctcaatctcttcaagcgctgggattacaggggtaagccactgtgcctggccataattcatttatcagtcatatatatatacacacacactgggagaatctagggtcagtgccttacaaatggcacaagttgaagccctgagactcccactcctaccctgctccccccattctcagtactgctcctcagatgcctccagcagatcatccatttctgctaggctgggcctgggtacatgcagggagatgtgtacaggggctaagagcagaaacttttgagtgagacactcctgagttcatgcactggccctgccatttgtcagctaattgatgttgcatttaattgcatcatctgtatgtaagcctaataatttatagccatcttagagatgttgtgagcttaaataacatagtagtgaatatttatttatttgtttatttatttatttagacagggcctcgctctgtcacctaggctggagtgcagtggtgtgatcatagctcactgcagccttgacctcccacactccagttatcctctcacctcagcctcctgagtagcttgagacaacagatgcatgccaccataactgactaattttttaaaattttctgcagagacagtgtctccctatgttgcccaggctggcctcgatctcttgggctcaagcgatcatcctgccttggtcttccaaagtgctgggattactggtgtgagccactgcacccacagcctatttattgagaaatgtggaaggcccaggcactattctaagtgctccagctgttttatctcccacagttttgctcagataggagttccaaagctggagctggaagactcatatttttagaaatgttacagttaattctgaggtgggtcagattgagattcatggctatgcattaatgtttaggtggtgactaaccactcagggttttagagacaaacagaccttattctgtcactcactgactgagcgtggccaagtctttcagcctctctaagcctcagtgtcctcatccataaaatgggaccaatcgtagcatccacttctgagaactgttcagaagtggaaatgagctagtttaggtggctgtgtctggcatacgccaatggtttgataagtattagcttgtgcctttattaggccaactcctttttgttaggtgactgagaaaccaaggaccttctgccctttatgcaccagtcactattagtttaaatttgttgctcttccatccacatgattcattccaaatttgaagtgttggagaaagggagttagtatgtcatagaaaaatctctgtttttggctcagcaggactgagtttgactccatgtaactgtctgagtcttagtttcctcatccataacatgggagaacaataccctgaattagagaattctgctgccagaattagagatagttcatgtcaaggtgcaacatataggtaatgtgttattgctggtgttctggttataaaatgtacaagatgtgaaagcaaaagggcagaaaaccctttttaaaaattcatggctgggcgcgctgcctcatgcctgtaatcccagcactctgccaggccgaggcgggtggatcacctgaggtcgtgagtttgagaccagcctgaccaacatggagaaaccctgtctctactaaaaatacaaaattagccgggcatggtggcgcatgcctgtaatcccagctacccaggaggctgaggcaggagaatcgcttgaacccgggaggcggaggttgctgtgagccgagatggcaccattgcactccagcctgggcaacaagagcgaaactccgtcccccgaacaaaaaattcaaatgggaaagagaggcagatggcagagaacaggggaggggctgggcaccgtggctcatgcctgtaatcccagcactttgggaggccaaggcgggtggatttcttgaggtcaggagttcaagaccagtctgaccaacatggtgaatccccatctctattaaaaatacaaaaattagccgggggtggtggtgggtgcctgtagtcccagctactcgggaggctgaggcaggagaatcacctgaactcaggaggtggaggttgcagtgagtcaagatcgcaccactgtactgttgcctgggcaacgcaccgagactccgtctcaaaaaaaaaaaaaaaatgagagaacaggggagggtctagggctcagagctttggagaacagacctcagtagcaccaacactccaggatcaatgctacaaagacacgggttacaactaaactggagaacatggccaaggatgggaactcagcctgagcagggctgagccgagcagggctaagccaagtagggctgagccagaacacttcctccttttttctgaacaatctacctacatttcagctacagggctggctttacccagtccggcgggagggaggagagggctggtctgtgacttcagtgctgaggtttgatcaaggcaaagggaaacttcctattcccagaccctttgcaagaaagaatggcatattacttgccaccgacaggggttattattactaaatggagtcagtataaatgctttccaataaagcatgtccagcgctcgggctttagtttgcacgtccatgaattgtctgccacatccctcttctgaatggttggaaattgggcatctgttcctttaaacaggaaacatttcttgttcgagtgagtcatctctgttctgctttaggagtaaagtttaccctgcagttccttctgtggtgaagttttctctttctctcggagaccagattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtaaaagaaacttcttcctgggagcctttcccacccccttccctgctgagcacgtggagttaggcaggttaggggactcggagactgcgatggtgccaggaaagggtggagcgggtgagtgcctgttgccaaggtggcctcttcaacaggaaaccacaatatttttgtttcttgacttgctctagaaacagggctgtgggggtggggaagcaacttggatctgcccttctgaggacacctctgggtgctgcctggcccaggtctcctgtgtggtttctctctgagccgttgcctctgactttgctactttttcactctgagcagtctccagttcctctgctacctttttgtcctccaagcttccctgccgcctcgaatgcagatacacggtctccctcctgtggacccgtttggagagtccagaagactttatcaatccacttttttttctttttcatttggccctggggccgacggttaagtactttattctgtcattctgtcgaatcacgatgccctgaggtgcacagccccttccccctcttccgtgtctgaagggtttccttttatctctccacccccacccttgccctcctgccctctctcttgttccccaaagacagttctctaatgttttgatgtggattcgtgaatttatctgtatctttgcaaaatgtatttttcttttgtatgtgtacactgttttttaactatgcgatctcaggcaagtaattcctctgtgcctctgttatctcatcattaaatgattaataatgcctccagaggtgactgtgaggcttgaaggagataatacgcatacatcacttactacacgagttagcaattattattgcatattaatactattggtattttattttgctcattctgtttctatttcttttttatttatttattttttgagacaaagtcttgctctgtcacccaggctgcagtgcagtggtgcaatcacggctcactgcagcctcaacatcctgggatcaagcaattttcccatctcagccttcagattagctgggaccacaggcgcgtgctaccacacctggctaattaaaaaatttttcttcatagagatggtgtctcattttgttgcccaggctggtctcaaactcctatgctcaagggatcctcccaccttggcctctcaaagtgctaggattacatgcatgagccacggtggccatccaggcattgatattatgaggccatcttgacctagccctctctggtgaagagtccttttcagatacttcgttcagtcttctcagctatgagtccctaccctctgaaagcttatattctatttggggaaagacaaaaggcagtttcaaagaagagaggtgtttgattttcttttcctacttttaatatcagaaaacatttcatctaactctcagtatgaaggcaatattttgtttactggtatatccctagagcccaacatggtgagggccccaggatttgcttctttgataagatggtaaacccagctttcagctaacttcatggtttcctcagctacactcatatacaaggatcacctttggtaagatggacttaccatcttaccaaagagtttttgcattttagagttttttctttttagatttttttcattttagaatttttttatttcagagttttttctttttagaggtttttcattttagagttttttctttttagagtttttttttttttttaattttagagtattttaggctgctgagggtggaatctggtgaccttggggccacagagatgctccttggctaaaccaggggctttagctctgaaagttcacagccaccctgagaaccaagatgagagggctctgcagtgtccaatctcaagacctctctgaggtgctccatcaagattcattgaatgaaaaaattaaagtcttaatgatgaacccagaaaaatctttaaatcctaaatatgaaatgaaagtgttcttagttacaatccagtccaacgtccttgttttggaatgtggaaatgaggccccaaaggtaaaatggcccatccaaagtcacagccaggggccagtgctcaggtggccaggtgccctgcgtgcggtctcctggaccaccaggcctttttcctgcagctttagaagctttagaaggcactctgctcactcaggggcaagtggtaagcgctctttcccctctagtgtttgtgactcaggagtttcgaaacaggaagtagagctggctggctgtgcccttccgtccttcattagacgtttgctcttgtcttagatgctcagatggtagtggataggcctgtgacgaaggtgctaccatcgtgagagtaaggtaaggatttgcctctttgttaaggtcagaggggccttttgggaggaaggcctttgattctggagttttctaggctgctgagagtgagatcgggtggccctggggccatggaggtgatcctcgtatgtgagtgtggatggggaaaccatgaagttagtgtaagaggtagcagtccctctgagagccttgccgagggccgtgcagtttccagatctgaaggccattctagcttagactgatgaagtcctaggagcttctgaaatgctgcaagtttaactacttgtataaaggcctcatcctgatcccagtcaaacttgtgaaataatagaagccaaaatttaaatctctactgactttgctgctacagctatcctcccaccaacacacatacccaccaacatacacacttgccaacataaacgcacacacacatacacacaaacacacccatgtggtcctactaattcaattatttattttttaaagaaattaaaaaagactgggcgtggtggctctcgcctgtcatcccagcactttgggaggtcgaggcggtggttcacctgaggtcgggagtttgagaccagcttgaccaacatgaagaaaccccgtctctactaaaaatacaaaattagccgggcatgatggcgcatgcctgtaatcccagctactcgggaggctgaggcaggagaatcgcttgaacctgggaggtggaagttgtggtgagccgagatcgtgccactgcactccagcctgggcaacaagagcgaaactccgtctcaaaaaaaaaaaaaaaaaaaaattaaaaagatacagaacagttcaaaaaacaatataatgggaagactagatagacacaatcagagacctgcacttgtggggttaagaatttacaggtgaagttgcaagtttcattctgtttgaaaatgatgggattatatgttttgctgaggtttggacacctttgctgggttgtttgaatgccgtggctgcagcgccctgttatggacatcatgtgcgtgcagaatggatgtctgtcaggttccggggcagcccgcagtctgaggcagccagcctggattggagggagtggcaatactacctgccggttaggggtttgggcctgagagcgagtggctttcaggttctctcaagcttcggatgagatgcaggtttctgcttccgatggcaaatgcatgttttgctttttagttatcactgcaagagctaggatgctgctagaatattactggaatgattgtgatgagatggaatgtatttacagtttaattgtgacatgtaatacagtggtagaatgggactctggaatgagatgctggggcctagattctagcacttcctttgtgaggctctaaccccctctcctatagtggatttgttaagaacttctgtttttgtggctttgttattataaaattttttgaaatgttgttctctaaaaaagttatgattttatgtttttcttcatgagattctttcactgccttccagctgcaagtagaatgacgtctaaatctttgtgatctgtcactgaagcccttgagtgagacacttaaatctggctgtggctctctctcttactagcttatttccaagccgtgatttttcacaacagaaaaatggggacagtaatagtagtttcttcagaggcttttagtgaaatgaggttaaaaaatatttttatgtttatatggatatatagattacaaacatttatatatcatttatttatatgattattataaacacatatttatatttaaatactttggggcataaatatataaaataataaatatacttatgtaatacaaatagacttatatacatttactatttagcagagattatataaaatatatgtattacatggcaacatattcaaatttacatatgttatatatacatgtggaaaaaaaattgggaaaaggccacaaaatgtgaccaaagaattacttccaaatggcaagtttttaagtaatttttattttctttttatacttctctgtactttctctatgaaacaagtgttacttttactgtttttaggaaccaaaaatacaagtacattgtttaaaaaatactagcttaacaaagtttctagcccataagctagtgcagaaaatctaggtcccataaaacaagaactgccacacgatgtctctccccttacagtgctggatggcccgttgttaatggtgtcataaatcctttgcaagtgactgttttctaggtactatgactagagggatgtgtaacttaagcaaaaaacaaaaaacagaaaaggctgactatcatctgacagtgtatcctggaacacctaggccagagaagaagccacgttagcattttcccttctaaatgtcagttatgatttgatggggaaaccacttaaaaagcattgtcacgttgttgaaaaggtaatgaaatgagtgagatgagatggctatggaggacggagctatgcgccaatcttattatatccaaattcatgtcatctcagccttggattgtattgatttttattatatactgtcagaaaatgctattgaatgtgtaacaagagcctcaaaaaggtttattcattttgacaccataatactacttttaggaaattattctaagaaaataattagaggtattcttaaagatttgcgttttaaagtcatcctaaatgtaatcaggaactggctatgtaaattatagcccatctctaagattaagtgccttacagatattaaaacccatgctgtagaagaaaaactaaagacaggaaagtacttacaatacaagatgtacttaccagtggaaaaatccacttatactacagaaatatgatgtgttcaaatataaggaaaaatgtgtatgcataaaatatttggtaggaaagagtaaaatattactgggcatttatatttggatggtggaattatacataattttaattttcctttttatcttttctgtattgtctaaaatgaatacactaagcattgttatcctcagaaaaaaataattgagggatgggggaaaggaagtcctgctttcatttgattctttggttggttttattctgtaagatgagactttaacagaggttagaatgcattaaaaattgtaaagacagttgacctaatggcactaaacagggttagatctagtttagatcttttccagcatgtgaataagaatggatctttaaataaagattttaactaggtatatgttttagaataagtcatacatgtacatggtaaaaattcaaacagtacaaactgtgcagcaaggtatgggaaataaagcagctctcactgtcacctccacccatcagccttctcacactgcacgcccacatctgtgtgtaattctgcttttctttaacattactgaaggaacttcctgtgcattttttgtcagagctcttctgtgaatacacaaaatatgtactgatcaatacattatgtagatcacgcaggctcaaccacattgatcttcctattctttctagtagccaaatagagttccctggaatatgattaatagcttgcctaaatcttctaatgctgataaacagttgtttctgctctttcgttatttcaaggaatgctaccatgaatagccttatatatggttttgagtatacttgtttaagtgaatgtaggaaaaactcttggaagttaaattgtgggccagtttatgtgaattttatattttgacagagatggctaaattacccacctgtttttttgttttgttttggttttggttttgctttttttttttaagagttggggtcttgctacctggggtcttgccacctggggtcttgcccagggtagacctgaactcctgggccacgttggtttattttactgcattcccagggcctagagcaacgattgacacgtgctagcagtatctattggaaattctggccaacttgcaatagacctgattatttctacactgaacatgtctaagatagctattactattcattcaggaaagcccagacaattatcatgccagcagcctgagacagtagccagtaatagcctggtgtggtagtttgctcctgtagtctcagctactcagcaggctgaggtgggaggatggctctagcctgggaggtggaggttgcaatgagccaagattgcgccctgcactccagcctgggtgacagagtgagaccctgtctcaaaaataaaaataagaataaaaaataaaccagcaaaagtttctgccctcacagagcttccattctagtgagagggtagtttgtcatcaggagggtgacgccggtagggctgggggccagctccctgcagggaacaaacatgatcgcagtggggtgggagtaggggatgagtccccagagcctctgtggtttccatttccacacaaaaaaaccactgctgctgtaatcaggagggggaaaagatttttaaaaattttctttcagggaatggaaggaaaggatatttttgaaagtaagactttgaaaactaaaagttttgggtcacttaaaaactcaaaatctttaggtcactttaaaaatatttaatcttggagctggaggccattattctaggtaattagctgggtgtggtggtgtgtccctgtaatcccaactactaggaggccgaggcaggaggattgcttgaacctgggaggcggaggttgcagtgagccgagatcgcgacactgcactccagcttgggtgacagagcaagactgggtctcaaaagaaaaaaaaaaaacgaaaactaaataccgtatgttctcacttaaaagtgggagctaagctatgaggatgcaaagacatacagagggatataatggactttggggattgatggtggggttgaatgggaggttggtcctaataggtcctagtacgtcccctacttctaagtcttccagtctgtcctttgcactttgaatgttaattccaagttggataatgtcattctcatttttacagtcctttcttagctcctcatcacctccaggacaaagcctaaacccctcgccccatggtaatgcggcccctttgtgacatggtacctggctagagcttcatccctttgtcccatcactctccatcccagacactttgtagttactttattgagctccttgtgcctgcctgaatggacttgaaagttcttacctccatcttttacattaattgtttcctgtaagaattgtgctttctcgcattctccccaaaatcccttccccataggaagcccttctcccaggctaagttaaggtttcttcctctacatccctaccacactctggtcacaaccctctaaccattggcttgttttttttgttttttgtgttttttttttttttgtgagacggagtcttgccctgtcacccaggctggagtgcagtggtgcaatctccgctcactgcaacctccacctcctgggttcaagcgattctcctgccccagcctcctgagtagctgggattacaggcacgtgcctccacacctggctaatttttgcacttttagtagagacggggtttcaccatgttagtcaggctggtctcaaactcctgacctcgtgatccgcctgccttggcctcccaaagtgttgggattagaggcgtgagccaccgcgcccagcccattggcttgtttgtatgtctaccttcctaaacagtaagagggaacttgtctggtgttctttttttctctcctgtgctgacagcacaatgaccagtacctagtagttgcagtagcctttgatgaacaagccagcaaatggtacttttcttccttatctgaacataccatttattttgacttagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggtgggtggaaactcccattgtgggactgggaggtgtgggttgaatggacagcctctgagctgattggggcttttttttgtggtaccctgcctagtgcctgggaacccagcagtgccacaattctaagcttctacagaaagacagtagtgccttgggtggtcctgctaaaggctgtaaaacttagcttctccccaccctagagagagtgggtaaacaaaggcgtgagagagaaaccacattcagtatcacttgggaggctttgggaagatgtcccaccggagccagattaagaaatttaggggccttatatataattctatagaaatgctaagaccataaaataaaaatttatttttcaaagtgaaacattacttagaggtatgctgaagttataatagagtttttctaagtgttctcatttttttcctctcttatcttgatgcctctcgatatccagattgtgtgcttactttgcccatccattgagtaaagcatcatggcttcccaccctgaaatccccctcccacctgcttgcggatggctatgaaaattttcaatgagatttaagggttttctgccacacttaaagactcgaatgactaagttctttacggagctgtaagccgctggcctggcacatacagctaggcagtctccaccgaggctgcccagttcctgtgagcccggctgtatgacagttctaagcttctataggaagacagtggcacgttgggtcatcctgccaaaggctgtaaaactcagcttctccccaccctagggagagtgggtaaccaaaggtgtgagagagaaaccccattcagttacaacttcatgatgctgtgacaagactttaaaaacagaaacacattgtcactttctctctttcaacatctcctattatcggacactacttaaagcaattttagctttgctttcaggaaacttctactgaagtcttcgttctgggcccatttcattgtctctgtttgcttgttgataactatggcatgtgagatggaaagggttcacaaccagggctgacagctgctgtcctctgatggctcagcccatgaatgctctggtctttctattctcagagactattttttgttttgaggcttgactattttttgttttgttttgttttgtttttgagacggagtctcgcttcatcacccaggctagagtgcagtggcatgatctcggctcactgcaacatctacctccagggttcaagtgattcttctgcctcagcctcctgagtagctgggattacaggtgtgtgccaccatgcccagctaattttgtatttttagtaggacggagttccaccatgttggccaggctggtctcgaactcctgaccttaagttatccaccagccttgacctctcaaagtgctgggattataggtgtgagccaccatgcccagccaaggcttgaccattttgattttaagtgaaaaaagagatattctgggccgggtgaggtggctcacgcctgtaatcccagcactttgggatgctgaggagagctgatcacctgaggtcaggagttcaagactagcctggccaacatggtgaaacctcatctctactaaaaatacaaaaattagctgggtgtggcggctcacgcctgtaatcccagctacttgggaggctgaggcaggagaattgcttgaacccaggaggtggaggttgcagtaagctgagattatgccattgcactccagcctgggcaacaagagtgaaactctgtctcaaaaaaaaaaagaaagagatattctgggtatataagtttcctagggctgctgtaacaaagtaacacaaactagcaggtttaaaacagtttttaaaatgtgttttcacagttctggaggcctgagtcagaagtcaagatgccaacagtgttggttcccttttaagaggctccgaggaataatctttttcatgcctttccctgcttcgggtgggtggaggaatcctcagtgctccttgtcttgtagatgaggcacagcagtctctgcctatgttcccttctctgtgtctaaatctccctcttatgagacagtcactggattaggaattagggcccacctaatccagtatggcctcatctttgtgtgtgtgtgtgtgtgtgtgtgtgtgtgtgtgtgtgtgtgtgtgtgagacagtgtctcactacatcgcccaagctggagtgcagtggcatgatctcggctcagtgcaacctccacctcctgggttcaagcaatcctcccacctcagcctcccaagtagctgggactacaggcacccgccaccatgtctggctaatttttgtatttttttgtagagatggagtttcaaaatgttgcccaggctagtcttgaactcctgggctcatgcaatctgcccacctcagcctcccaagttctgggattacgggcatgagccactgcgcctggccagcatgacctcatcttaatgagattttatctgcaaacgtcctgggtccacataaggtcgcattctcatattccagatagacatgaattttggggaagaggggagaacactattcaaccagtacactagatagctttggtttactagcattgtgaagtctttataaggcacttattcattaaggcgccagttagtcctaaaaacccacagccccagaacaaggaaagccgaggggggtctcatcttgtgcccaccatcttggtcctttgaaggttccacttctgccgcatgagctgggctgaagcaaacagccagtgccagacacagtctgtacctttctggcggagggtcgatcatctattaataaggcaggatctctcttaaaatctttaatgtattggcttagagataaaagggtccgggcaatcctgacttactgcttgttcattatcattgaatactagccagaagctaataaatatgctagggtgaccacttaccattataagaaaacactagacattttattttccagttataattgctacctataaaataaagatcttataaactattcaggttcattactaaatggtgatggtacaagaaagcctataggcttcaataatgaggaaagcaaaagggtaaataccttgtaataaaggtgaaagagtcagagtagctttggattagatccaattttggccaaactgaaagctttagataaacacttctagggtagagagtccatgagaagggggataaggcagatggtaatactgagtaatttctgtttctacgccatttttattttcagaattttacttttctaattaaattttaaagtcaacgtgtttttgtattaaaattattttcctttacaccatagtattgaaaggtttgctgacttctaaaacattcctttgttcacctattcgacaagcatattccaagagcctaaatgtgccaatcacataaatgtgataggcatagattaggaaatagtaacacctatcactcattgagcacttagtgtgttgccaaagactgatttaagtacttcacataaacttatttgtgtaaccctcgaaaccttcctatgatgtggttacggataattatcttcagtctatggacgaggaaaaaatgtgtaacatgtctaaagttaacactgctcaaagatagtggaaccaaggctccaacaccaatagcctgggtccgctgagctcaatcattgcacctcacaaccctctgggtttatgaaaataaaaagggtacggacctggccactaggggacttgaacagtttctaaacagacaattattttctgtttttatttttagtgtggtggcatgatcacagctcactgcagcctcaaccttctgggctcaagtgatcctctcacctcagcttctggagtagctgggaccacaggtgcatgccaccacacccggctaatttttaaatgtttttggtagagatggggtcttgctatgttgcccaggctggtctcaaacccctgggctcaagtgatcctccttctgccttggcctcctaatgcgctggaattagaggcatgaaccactgcaccaggccaacagacaattatgtgtgttatcgttttggggttactaagtcatagtggagtgaatgcagctttgaggatgctcaggcaatgcttgagctgattgttcatggatgggcctctgcagatagacaaggggatggggtgtagcggcaccacagaaaggggtgagggcagggcagctgggtgtgtttggcttcaggtcctttcgtgtttgcggtctggtctgtgatagggatgtattcggagactttgtattccagaaccgaatgcttggccgtcttactgaagataatgactgggagaatactgaccagttttgattagggaagtcatgagccaatgtgcattttgaaaagcataatttccaaaaggcaaagcattttgctattgcaacaaaatctccattttacagaaaaaaaaaaaggaaaacaagatttactcaactgaaataaactgaaagaaaagttgatagaactttaaattgttaagggtgggaaagtcggggaggagccagtagacttctgtgtcaccacaccagcctctttccaagggctcaactcataaaccatgccattaactggctttatgttgaagggaggcctttggaatcaagcccactgtgactccatatatcaaatgggaaattatttgggaaaagatttctaaagtgtctccatttcccaccacagggtcatgctctatcagatttcagaagaagtgagcagatcagaattgaggtcttttaagtttcttttgcaagaggaaatctccaaatgcaaactggatgatgacatggtaagacctggtatcttactgagatttagtcctgagacttggttagccagggggcatttctgagaccaaagagaggggtattttggtaaaagcaacctggattctcactttttaactagaagaagaaagttgtcagcacgagtgttacagatgtgattcctttagaccgaagtgctgctcatgttaattattgggagcaaggcagagtcagaggccgggagaaggaggctgtgcagatgcagcccagacccggcagagctgggaaagactgcggtgggtctgagatatttcctccacttctgcagtccccgaaacaacctgggacctgaaactctgtgtgtatattgtgtctgtgtgttgtgtgtgtatttccgtgtctgtgtgtgcctttctctgtgtatagtgtgtgtctgtatttgtgtgtgatatgtgtatctctgtgtgtctctgtataagtggtgtgtgtgtctgtgtatctctgtgtgtgtgttctctgtgtggtatgtgtgtctgtgtgttgtgtagtgtgtattgtatttatgcccctgtgtgtgtatcactgagtatactctgtgtgtgttgtatctgtgtgtgtatgtgcatgtggtgtctgtgtgtgtgtgtctgtgtgtctgtatgtactcaggtctggagaggcaatgctgggggtgaggctgttccccagggtgtcaccatgatgaccgggctgctgtctcaggttgtttcacagtccccaagtaatgcattcgcaggagatttgagcacagggcctggggactgggtgacatctgacatggcttctcctttatcctctcacttctgtctttctgggccagaaaacatggaatcgcttccctagtagcctgctggctgtgagagaccagcagaaactgtcagaaacttgggaagcaagggcaggtccttggttggagaaattggaaattaaaaaaaaaaatctaatctaaaaaccagtagggctcaatccagattcccaactttatttctcctcctcttagaacctgctggatattttcatagagatggagaagagggtcatcctgggagaaggaaagttggacatcctgaaaagagtctgtgcccaaatcaacaagagcctgctgaagataatcaacgactatgaagaattcagcaaaggtagaaacaacctgacagccgggaatcggcaaaacctactctaaaattgaaactgacaaatcgctccatatcacagttgtttctaatcaaatattgtttggggtttccccttttaattcagagagaagcagcagccttgaaggaagtcctgatgaattttcaaatggtaatgcttggagatacattttcaagatttagttaatttactatctggtacctgcatgtgtcctccccacagccttctaccacatgcacatcttaacgtgcctgctctactttttctttttttttttttttttgtgagacagttttactttgtttcccaggctggagagcagtggcaccatctcggctcactgcaatctccgcctcccaggttcaagcaattctcctgcctcagcctcctgagaagctgggattacaggtgcgtgcaccaccacgcctagctaattttgtatttttattagagatggggttttactatattggcctggctagtctcaaactcctgacctcaggtggtctgcctgccttggcctcccaaagtgctgggattacaggcatgagccactgcgcccggccgcacctgctctcctaagacctgtagcccaagctggcaagtttgaaataggtgcagagttagtcagtagtaagtaatttaacatcattttttctatgtggctttttttttctccttgacgtgctgctcatgttatgcactgagtagctggatttaaattatgtttcataattttcttggttaagtcactttctctttcaacaccttctacactaagtcactcctttcaacttcctttcactttttctacctgataagcgaggctgaaccaagagagagagctctcaacgatctccttcaaaattttgattaatcaaatagtctttttttttttttgagacagtgtctcactttgtcccccaggctagaatgcagtgatgcaatcttggctcacaacagcctcgacctcctggactcagatgatcctcttgcctcaaccccctgagtagctgggaccacaggcacaagccaccatgcccggctaatttttgtatgtcttgtagagatggggtttcgctatgttgcccaggctgatcttgaactcctgagctcaagccatccacctacctgggcctcccaaagtgctgggactataggcaattaataaagtattctttctgattagaaaaattatatacactaattgaagattattttaaattcagagaaatttttacaagtccaagaacaccatcactccattcatattatgaatatttttattgtatttttacgttggctctttgtggtgtgtgtgtgtaaaatacattttggatcactcaaatgtattttaaagattaatgtctatgcaggctgtccttccctttcccctctgcctgctgagcctaaggccttaagaatactttaaggagtaaagtactaaatcattaattcatcctgagctagtggctttattaatgagtatctcacaaataccacaaaaattcaacctggccatgtggagcaatataaaattatggcatttcttggtatgtttttctctttggcgaggagacaacttgatcttgtgtttccagaagcatgttaattgccctgcttgcagaatctctctggcttgaaaggagattatattcatggcagtctgtgaattttcattttatttcatttatttatttgagacagagtctcactctgttgcccaggctggagtgcagtagtgcgatctcagctcactgcaaccactacctcccaagttcaagtgattctcctgcctcagcctcctgagtagctgggactacaggtggctaccaccacgcccggctaatttttttgtacttttagtagagacagggtttcaccatgttggccaggctggtcttgaactcctgacctcaagtgatctgcccatcttggcctcccaaagtgctgggattaccggcgtgagcccctgttcccagcttgaattttcatcttaaaaaagaccttatgttgtcctatgtgctacatatttcattaccagtgtacctttcctgccatgtctcattctagatgtgtctcttcgttgtttgcaggggaggagttgtgtggggtaatgacaatctcggactctccaagagaacaggatagtgaatcacaggtagacggaaacctccaaatccttttttttacattacagattctagttatttaatttgttagcttttttttttttttgctgccagataaactgacaaggggcagaaacttactgaaaattttgagaactgtagaaaaaattcacacaaaaaaagttaaaaatgtgacttaatttttaaaatgtgactccttcagttttctatacatttgaattttattttaagacccgagatgaagatactggaatagttggagggtggagggggtaataagcctcctaccaaatcttctagcagccgtgccagcctggatgggggagtggtttggagaaagagtctagcaggaatggaaaaagccaagccttttcctttagcttaatgtttcaaaaatgcttctccttggtgatgaggtgtaagcagcaaactctcacaatctagccatctctgtgtttttgtctcagtgaaccagcagaaacatgtaatttttaggcataataacttctctttatgtaatcaacaatccaccaaatacatcctgacttattagacgatctgctcctcctcatggtaggaagaagaggaaatcctgaatatctgaagtaggcttgagagagattattcactagtgtgggctcctgagaaaattaccagacctctttcatctgaaagtcaaggattaacccaagtaatgtggtactttctaaacagtatagcatgctacaagcattgtccccactgaagagctaaaaacactgtcttaatatcttagtaaatcttagtatctttttccttttttaatgttttattgagacaggggtcttgctacgttgccaagccaggtctcgaactcctggcctcaagcaatcctcctgccttggcctcccaaagtctgggattataggtactagccaccgtgcctggccaaatcttagtgtcttagtatctcagtaaatacacttaatatgcttaataaatacttagaacacaactgtaaataataaaaacttaacatacttggtacaaacttaatcaaatatttaatatcttagagttaacatattaagataacaggttatttgcccaaagtcataaggtgaagtagaggcaggaattgggcttcctagcctggagtccttttctccacctcaaggggctacgcagacctccaactaaatgctgagtttctcggtactgaaacagccctaggagaatgaataggacacagcgccatccctggccagtactatcaggtactacagtttggataccataacctacagtgtagccaggacctccctgaccagcccatctcttcccagcagccaccgtggtcctgagagctgggttaagccatcacctttaaaatcctgggaccacactgtgcaatgcatgaatgggagaccctcagctgttagccacgaagcacagatgagttcagtagacagccaagagaatcacaagtcatggcgtgggggcagccaaagacattcattcattcagtgactcttgattgagctctcacaagttaatacaccgtagtccctggcacagatgttatgaacctcaaggagtcttctgtatagtatgggaagcagaaatgagaacaaacaataatacaatgtgatgacaacaatattaatatatgtgcaaagtgctcaggaggcccaggtattgggacactgactttacaacgatggggcagaagtctgagaggtcctgtgtgaaggaaataggtagaaactagttcttcgaggaaacgaccccgagttggggtggtgcaatggaaagcaagtcctcttactagggagttgtttgtttacatctctagtgtttgacccacagagtcagctcctgggttgggtttttgttttccagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggtacagtagaacccaaaagagaaaagtaaaatatttcttatgcctatttttttttaaatcaaaagggagagaacaaaagctataccaaaagggccatgtttcaagaaaatggatttaaacatatttccctgtggaggtaaagaacattcttatacatttatcagtttcctgctttttttaaaaattaattttttaaataaaagtaatgtatgtataaatataaaatatcaaatcttactaaaagacataatgaaaagcagtaataagctttgttttgaattcagctaaatgcatagcgcttctgtggaatgtattaggcgatgaaattgctgtggtatcaaagttcttatagaggctgcatttttacaggttgggctgttaagtgcagcagaaattgtgggttcttaacagaaatagcattttcaagtattaaatattaaactggttagcaattcttttgctcagccaaattaagctaagatcaagaacttacaagttaaatgaaaaaacaatttgtagtatgtgaatataaaaagtgactacaacaacaaaaaataaaaatcatccatcaccattgagagattaataattttgatttgatcaaagaacttttggaaatagtgtttatcaggcataacatcaattattgatttgttttgcaaatggaggtaagtttagaaaattaatgtagactgattataatcatcaggagtctgtaatggcccctattaacattttttttttttttttgagacaaagtctcactctgttgcccaggctggagtgcagtggtgtgatctcagctcactgcagcctccacctccctggttcaagtgattctcctgcctcagcctcccaagtagctgggactacaggcacacaccaccacacatggctaatttttgtatttttagtagagatggggttttgccatattggccaggctggtcttgaactcctgacctcaagtgatccgcctgcctcggcctcccaaagtgctggaattacaggtgtcagccacctgtacctggtccctgctaacatttgatttgtttatttaagcaaatctaagcctttaaaaaggcacagagattaagtccattgattacatcattcgtcactatgcgcttggtattgaaaaaaatattttggacccttgatttgtattcttttaaaattaaaacatttctattaaaataacatttgcttctatttctggcagctcattttcttataactggcccatgattgactagtctctggtaggcattcgagtctgtgtgtcctgctttttctgttcctgttcttatgttttatgctgaatgagtaaaagtaggagacccagctgcagaagtcatttctcctgagagactcccttctgtcctgcttcagtgccttcagacttgctttacagtcatttttttaatcaacattccacatttccaaaggatcagaatttttttcacagaaccaacacactgtattagtcttgccaaagtgcttccaaatcaacaagggcctattgcatttcagttatttttttctattcctaatgctagactgtattttttcttttttttttttttgaggcagagtctcactctgttgcccaggctgcagtgcaataacatgatcttggctcaccgcaacctctgcctcccaggttcaagtgattctcctgcctcagcctcccaagtagctgggattacaggcatgtgccaccatacccagttaattgtatttagtagagatggggtttcaccatgttggtcaggctgttcttgaactcctgacctcaggtgatccactcgcctcggcctaccaaagtgctgggattacaggtgtgagccactgcacctggctgagactgccttttgactgatgacttatgtttagctctgatgtgctgacagggacaaaatgctggagaaggaataaaaaaggaataatccaacaaggatcaagagaacaggaaaggagacaatagctaatgaaaggtttccaacaatttgggggagttgaaaaaaaagagtcgaggtaattgacttaacagagaaagctacaacctcactgattacagaggggaacacggaaaggaggcaagcctatttacccccacagaatcctggaaaaattcagcaattggaagtacaaagtgtaggtgaggcaatgagcagaaaacaggaagattctttgaaagcctatataagcctatacaatcctctgattcataccttcctctcatagagccagcaactattcttattctaccatcataaggaacaggaagtttgttttctcataaaattgaaccagagaggctctacacttcggtgtgccaggcccagcaaaggaagcaatgaagcattttactgaacacagagagactgaagaaaacctgctggtggcatggagtcagatctctaaaccaacttggttccaagacactggcagcagatacagacttacctctggagaagctgaaagctctagctaaaatacatacagataatgacatctggaggtttcctaatgaaatgatcaggtccccaaccaatcatcttgctatgaaatccctcagagaacaagccacatccacaaacacagagctttcagtcgactttttaatggactaattagtcaatttatgaatggacaaccaaaggtcagcaggcatttgaagaaaggctctaatacgaaagagaggtagcttggtacggtggcgtgaaaatccagcactttgggaggccgaggcaggcgaatcgcctgaggtcaggagttcaagcccagcctgaccaacatggtgaaaccccatctctactaaaaatacaaaaattagccaggcatggtggcaggtgcctgtaaccccagctactacagaggctgaggcagaagaatcacttgaacctgggaggtggaagttgcagtgagctgagatcgtaccactgcactccagcctgggtgacagagcaagactccatctcaaataaataaataaattactagataaatgagaggcaatgcaaacaacaagaaaaacatgaaacagaatatgaatgaaaaaaagataatgttgagaaaaaagcaaccttttttaatgcttaatattggtatttagtattcttagagagttagttaaaggtccatgaaagaacaagatgttatgaaaaagggacagaacaagcaagtctccttgaaaattaaaaatttgagcaccaaaatgaaaaattcaataaagtagaagataaagtctaaggaagtaggataaaaagacaaaaatagaaaataggagtgaaagataagaaaatttgaagctaaatcaaggatgtccaatttttgacaataagagttccagaaagaaaggacagagaaaggggaaatggaactttccaagaacgaaatgacgcaatctccagattgaaagggtataatggattaagattcacttccaaacatatcataccctagaagcttctggaaagagaaaaaagtaagccaaatatgtaaagtatcagaaatggaaagtcttctctctagcaacactgaaagctaaaagactgtgaagaaaggccttcagaattctgaggaaaaatgcttttggaaatagaactctataaactaaagactcatacaggggctcaaaaaatgtacttctcatggttatgctccagcaaaggaaactgataagaaagaggaagtcatagatggaggaaacagggaacctactatggaagagacagagagatgtcccaggagaagagaaattcatctggcctatggaacagccagttggtattacagcagaaggatgcagtgctctggatggaaagttttccaggaagaaataaaaatgagtcagacaagtagcctgaaaatgttgaaagattttggccagatccattgagcacttggagaaaaaacagtgttaagcatataggaaacaaagcagatgaaaaaataatacaattacaagttccaggaaaggcaaaaaggttaataagaaaggaaacataatgaaagaacattatgtttacatagtcttaataatagaaatattactatgggccggaggtggtggctcatgcctacaatcccagcactttgggaggccaaggtgggtgggtcacttgaggctgggagtttgtgaccaacctggctaacatggcgaaaccctgtctctactaaaaatacaaaaattagctgggtgtggtggtgcgtgcctgtagtcccacctgcttgggaggctgaggcaggagaattgcttgaacttggggggcagaagttgcagtgagctgagattgtgacactgcactgtagcctgggtgacagagtgagaccttttctaaaaaaaattaaaaaaataaaaatattactatggattcaaccaaaacttgtaaataattgagtaagagcccaaatgcttattctccataataagaactcaatgcgaaagtctaaaatttataaatgagtaattagcagtgtacccaaattcattacaaaatggagctcaatgtggaaaaaagtggttaaaaactgaaagtggttgccttcatggaatgtgactaggtaatggggagggatagagaggggataaccttttgtataaggtcttctagttctatcttattaattcatatcttttattttgctatacataaataattttgagaaggtttaggataaaataagttggatcttttattcaaaaattgttttgtttttttctgattatgtaaataatataatcatttttaaaattggttcagtagtaagcctaaatgatagcttacccatcttgtaaactagtttactagagaaaacagaccaacaataacactctctcctttctcatttgcttcagggtttgagaatgtttttagctggtggcaataaatattagaagcctgcagaatccagctacgaatatagagggttttgctcttgaatttctggttcaaattcttttttttttttttttttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggcccggcagaagcgcccctcacctcccagatggggcggctggccgggcggggggctgacccccccaccgccctcccggacggggcggctggccaggcagaggggctcctcacttcccagtaggggcggccgggcagaggcgcccctcacctcctggatagggcggctggccgggcggggggctgttccccccacctccctcccggatggggcggctggccgggcagaggggtcctcacttcccagtaggggcggcccggcagaggcgcccctcacctcccggacggggcagccggccggaaggggggctgacccccccacctccctcccggacggggcggctggccgggcagaggggctcctcacttcccagtaggggcggccgggcagaggcgcccctcacctcccggacggggcggctggccaggcagggggctgatccccccacctccctcccggacggggcggctggccgggcggggggctgaccccccccacctccctcccggacggggcggctggccgggcagggggctgaccccccctcccccctcccggacggggcggctggccgggcggggggctgacccccccacctccctcctgggcggggcggctggccgggcagaggggctcctcacttcccagtaggggcggccgggcagaggcgcccctcacctcctggacggggcggctggccaggcggggggctgaccccccacctccctcccggactgggcggctggccgggcggggggttgaacccccacctccctcctggacggggcgactggccgggcagaggggctcctcacttcccagtaggggcggccgggcagaggcgcccctcacctcccggacggggcggctggccaggcggggggctgaccccccacctccctcccggactgggcggctggccgggcggggggttgacccccccacctccctcctggacggggcgactggccgggcagaggggctcctcacttcccagtaggggcggccgggcagaggagcccctcacctcccggacggggcggctggccgggcggggggctgacccccccacctccctcccggacggggcggctggccgggcagaggggtcctcacttcccagtaggggcggccgggcagaggcgcccctcacctcccggacggggcggatggccgaccacccccccccgcctccctcccggacggggcggctggccgggcagaggggctcctcacttcccagtaggggcggccgggcagaggagcccctcacctcccggacggggcggctggccgggcggggggctgaccccccccacctccctcccggacggggtggctgccgggcggagacgctcctcacttcccagacggggtggttgccagacggaggggctcctcacttctcagacggggcggttgccaggcagagggtttcctcacttctcagacggagcggccgggcagagacactcctcacctcccagacagggttgcggcccagcagaggcgctcctcacatcccagacagggcggtggggcagaggtgctccccacatctcagacgatgggcggccgggcagagacgctcctcacttcctagatgggatggcggcggggaagaggcgcttctcgcttcctagatgggatggcggccgggcagagacgctcctcactttccacactgggcagccaggcagaggggctcctcatatcccagacgatgggtggccaagcagagacgctcctcacttcccagacggcgtggcggccgggcagaggctgcaatctcggctctttgggaggccaaggcaggcggctgggaggtggttgtagcaagccgagatcacgccactgcactccagcctgggcaccattgagcactgagtgaacgagactccatctgcaatcccggcacctcgggaggccgaggctggcggatcactcgcggttaggagctggagaccagcccggccaacacagcgaaaccccatctccaccaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatgagagggagagggagacggggagagggagagggagagggagacggggagagggagagggagaggggtcaaattcttatctatcaatgttatgcccactgtgctctccagctgtggtctgtgaattactgtggtataacgtgactgttcaaatttcacttttcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcggtaagttttgcctactcagccctcctcactgttacactaccttccccccctactccatcacactactatctactcatattcagagcctattagaaagtgctatgtgatttagatcacattaacaggtcagagaactgtccaaggggagtggtttccgttcaactctaaatgtctagctgtagatcacatagctgcatttcccaggtcagttacaaagtgggagagtggcaagtgttaacatccttagtttatagatggaaaagctgagatgctttattcctttattcagcacctcaaaggacaatcagggtatcacagagcaggaaaggataggaaagtcatatactccagctctctgtctttaggccaaaacatgactgagccaattcaactagttttggaaatcttccaagaaggcagtaacccaattcaatgtttaaacatcctccaactctgtcaaaagttctataatagcaaaccatcctcaaaacctcttggtgcattatgggagataaatagcaggttccttctagccctgtatttcatgttttgagtatatgaagagtgagaatttcccgtaacttagatcatgaatctaacttagatttcgtaacttagatcatgaatcctgcaaggtttccgcggctagctaccaaggtagaagaagaggttgcctaacaaaaatgctaagagatcctggtgagaagaaggtgggagtagctgcaggagacgttatactttcacttgccttaagtttaattgcatcaaagatgaatccgcagatgcgatgtcaattcgaggcagagagtattggggggcattgaagcaatggggagccaagtaacgtggagaagagtgagagacacacaggtcaggagagaaagaaaccaactctaatactgacaccgaggtttctgatggtcaaaagagttcctgaataaaccaaaagtaagttattaagctctgagacaacccatttaccaggaaagctggggtaggtcttggtttcgcaccttattgtttcaaatgactgatattttgagagaaagaactacagaactatctctgagcacagcagaggagacagttcatcagttgctttcccccacagacagtcacaatattatgtgatgtatttcagaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 89 - DNA, 46526 bp, Homo sapiens
tccctttttgacttaccaaggaaatggagatccaaaggaaagcctgaagcactttgtggcttccacgggttcgtttctaggaagcttttgctttacctggggaaaccccaagctctacagtgagaaagttgtaaattagcctttaggagacgctgtttgtcaaagttatcttaaccctggaaaaggggagggaaaaaggcagataagcagtgatgacatcagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggtatgtaattaacaacccttcttactccagagtctcatgcttgaatcttttcctttgcttcatggcttcgtgttgtagaaacttgcaaaaacttgtcagcaatggcactattttttcttagatttctttgtcatgcctgggaaaacaaaagttaaaaaatccggaagcctccaacatagccttttaccggggcagaaatatgttagctcacagagacaaagtttggtagactcactaaaactagagatcagaattgtcaagaaaccacaaggcaaatgctagatgcggtagaatagaaaggtgtctccaataaaccactcatttgacctcagggctagtagcagggaagatcccctggattatcacattaaaaatgacatttttttgtttcttttaacaccaaaagtaatgtgtatgctcacatatgcataaaatttgagaaattcaattggaagcccagaaggaaatttgtattatctatagttatgtcacctcgatataaccactgtttgttatggaggttttgatttttgctgtgtcttccttcctttatttatttatttatttatttatttatttatctatttatttatttgagacggagtctccctctttcaccctccagcactcaagctggagtgcagtggcacaatcttggcttactgcaacttccgcctcccaggttcaagcaatcctcccatctcagcttcctatgaagctgggaccacaggcatacaccaccaagcccagctaatttttgtattttttgtagagacggggtttcaccgtgttgcccaggcttgtcccgaattcctggcctcacagtgatccacctgcctcagtctcctgaagtgcttctctgattataatgaaatttagtatgtagaataccatagtttatagactagtcagatggaaacattgactcatgtaatttttatcttccttcgctgatttgagcaactcttgtctaaaatcaccctttccttctgaggtctaggaggtttttttgttgttgttttgttttgtttttgaggcagggtcttgctctgtcacccagggtggagtgcagtggcacaatcatggctcactggaacctccatccccggggctcaaatgatccttctgcttcagccctctgagtagttgggaccacaggcgtgcaccaccatgcctggctaatttttgtattttttgtagagatggggttttaccacgttgcccagtctggtcttgaactcctggcctcaagtgatccacccgccttggcctcccaaagtgctgggattataggcgtaagccatgacaccccacctgttccttcctttataaagtattttcttgtttctaaaaatagccaagttctgcatattgactacatacctcaagtgcttatagaataaatagtattacaatgaaaattttatcactgcattgctcctctgattatgatgaaatttagtatagagaatagcatagtttataaactgatcagatggaaacattgactcatgtaatttgtttttttttagtgaaaacaagtttattagagaagtaaagaaacaaaagaatggctactccatagacagagcagccgactcatgtaatttttaacttcctacactgatttgagcaactcttgtctaaaaccaccctttcctcctgaggtctaggatattttatttatttatttttctttttgaaacagggtctcactctgtcacccagggtgaagtgcagtggcatgatcatggctcactgcaacctgtgctccccaggctcaaatgatccttccatcctcggcctcctgagtagttgggaccacaggcatgtgccaccatgccctgataattttttgtatttttagtagagaccaggtctcgccatgttgctcaggcttgaggtctaggattatgccttccctttctgtaagataaaggcctgccctcttacaggtagcagtctgaagttaagatgtaacacacatacctcacggtaccttgctgtctttgggttgatagatcataaggataaccctgcctcccccagattgctttgtgtctaaaacttaaagcatagagccaagtgctatttctgccacgtgctggaaatgaatgtaagggctccaatcaggctaccaggcttgagaaaaattgtgctgtgtccctccatcttaactttctctctctgggaacattttgatttgggagaaatcaaggtgaattgaattccaatataagcaccctccaagtttcctaaaaagtaacttgcaagtgttggggaaaagttttctgggctgttgctttttgaagtagcctcgccgtaatttttatttttcagcacttctaggaaagtctaatgcccagaacggagaaggttgtggtgaggggagggcctgggaagtcagggggccatatgtcctcactctctaactccctgccccacctctctgtccctttcaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttaggtgaggacgggtctgtggtggagatgggaggatctcccatctagtgttcattctggccattgggctttgaaaggaagctgcagttaagatcttttggttatctacctccttggatgataaaccaggagattctaaacctccttctcagcctctgatgctaatgagataagagttgggaggtcagcaaagcttcaagaccaagccctgggcccagaggtggcttccctttgttttgcttctcactagcagtgaagcccacctcagtgtggcagagcccgtgttttccctgcttaccagcggctacacgtgcagatcttctccctcctgggatccactagtctgtctacctgtttcccggggtcttgagaagagagtaatgcatacttggagtgaaataagcaagatgaaaaaagagatgtgtttctggggtagggagggatgtcatttatgccatgtctagttatagaaatttctatatttttgggtgggaatccagaaaggtaaaaacaggcattttgcccaaagaggtaaaatttaggcattggtcttatcatggatgacagcgttttatttttattttgagacagagtctcgctctgtcactcaggctggagtgaagtggcaccatctcagctcactgcaacctccgcttcctgggttcgagcgattctcctgcctcagcctcctgagtagctgggactacaggcacccaccaccacacctggctaatttttgtatttttagtagagacagggtttccaacatgttggccaggctggtctggaactcctagcctcaagtgatccacgcacctcggcctcccaaagtgctgggattataggtgtgagccactgtgccaggctgatgacagtgtttaaaattgttcactgacatagtgtccacatcagagaacctcacgaagaggagcctttggagggtgttttatggtctctgcgattagaacacattaagccttagcggtggaactggcttccagaacctgagttgcccttgagtcagtggaaggaatgatgaattccagaaatccatatttccattctgctggctaaacatctgagggacagtctctgacacataggggtgttagtatgtggatgaaatcctcactgtttctggttgtggattatatctcgaagctggggtagttttcttcccttttcaatatacaaccgactgtaccttggctggcctggggtcctatctaccaagggcctgtaaagtaagcctgaatttcttgatggaatcaggagatgggaaggcatgtcagaattgtgttttatgcctttttttttttaaatatgccttcttagtgtggtgaaaaacagcattagacttggagtcagaaggcctgcttctaccacttactgtgttatctttatttaaacaagtcacttagaaactgaaagttttcattttttgaacctataaatgggattaataattgtctacacatagagttgatcattcaaatgacagaaaacatttatgaaagcacttgattgattatggtgtcctccacaagtgtaaggctttatttgtcattttgggtgtgtgtcttagaaacctgctctacgaactgtcagaaggcattgactcagagaacttaaaggacatgatcttccttctgaaagactcgcttcccaaaactgaaatggtgagtgggtcatacagaatgggtctgtgtgagcactgtcttaatcaatgattagaaagatgctggaaagggtttttagggagatttattttttatgggagacagtatcatacaatggttacgaacattggctttggtgctggatgagcctagattctggtcctgattctaattctaaacccatgctgtgaggccaatgattgaacttttctgagtctctattttcttagacgtaaaattgtgggcaatcgtatgacttccttctaggattgttgggagaattagctggaataatgttcatgaagcattagcatgaggccaatatttggtatagcattcagtaaatgctcacttctgttggaatctgttgtgttttgtttttgtttttgtttttttttgagacgaagtcttgccttgttgcccaggctggagtgcagtggcatgatctcagctcactgcaacctccacctcctgggttcaagccattctcctacctcagcctccctagtagctgggattacaggcatgcaccaccatgcccagctaatttttgtatttttagtacagacagggtttcaccctgttgggcaggctggtctagaactcctgacttcaagtgatctgcctgccttggcctcccaaagtgttgggattacaggtgtgagtcaccgcacctggccttgtccagttttttctttcaagtgccttttaatctgtaggttagatttcctccctgcccccaaatctctttctttttcttaaaatgtatctgttgaagaatctctgggcggttggcctgtggagtttctcacaggctgagttttgctgattgcacactcgtggtgcagtttggcatgttcctctgtcctctgcatttcctgcagactggcagctgaatccagaggcttcatcagactcaggtcagatccgtttggcaagactataggtagtcttgttttttcatcaggaggtacctgattttctctctctttttctttgatattagcaactgttgatgttcaaccattttatatattgaattttgaggggttgcaaaaatggagatattagaatttttttttttttttgagatggagtctcactcttgtcacccaggctgaagtgcaatggcacaatttcagctcactacaacctctgcctcctgggttcaagcgattctcctgcctcagcctcctgagtagctgggattacagcagcctgccactacgcctggctaactttttgtatttttagtagagatagggtttcaccatattggctaggctggtctggaactcctgactttaggtgatccacccgtctcggcctcccaaagtgctgagattacaagtgtgagccaccatacccggccacatattagaattgtatcatttcgttttcccttcatccattatttggttacccagtgatacagcttatatgtgaatccttgattcttttctttcagttattttttttttttttttgagacggtgtctcacttggtcatccaggctggagttcagtggtgtgatcttggctcactgcaacctctgcctcccaggttcaggtgattctcctgcctcagcctcctgaatatctgggattacaagcaggcaccaccatgcctgtctaatttttgtatttttagtagagacagggtttcatttggccaggttggtctcaaattcttgacctcaagtgatctacctgcctcagcctcccaaagttctggggattacaggcatgaaccactgtgctttgcctagttatccagtttttaagttaattggtatcttatcattctctgaaggtgacccattacaaaatatatataaatttaaactcatggatttaaacatatgtgaggtatttcaatctactgcaattattatccttactgaagttcaaactgaggctgggcatggtggctcatgcctgtaatcccagcactttgggagtctgaggtggacaggtcacttgagcctcaggagtttgagactagactgggcaacatgacaaaacccggtctctacaaaaaatacaaaaattagctgggtgtggtggcgtgcacctgtagtcccagctcctcaggaggctgacatgggaggatcgctcgagcccagagaagtcaaggctgcagtgagcaatggctgtgccattgcactccagcctgggtaacagagtgagaccctgtctcaaaaaaatagttcaattgtcccattttttcccaggggatacatcttcagtttggttcctaagtcattttgacatgaccttagtagtctttgatggcttctttactatctggcaaaaatatcccaggttcatcttgtatattttctacccagtcctggaatctctcatttctcccaaaaatcctgacttcttttaatgagagatgtcatttcaagaccacaaactcgatgctggcatgctcattgcttttgagtaaatatatatgcacacactacgtatatacacatatgtatacacacacacacacacatgcacacacacacatgacctaaaggttcagtaattcttggagaattttaaaaatcaggcgattttgttttagggaattcttttttataaaacattgtaaggatcttctgcttttgccgtaaaatttcagtgcccacatttgcagtggtacaaagcaattacctgctcaaatggtagcattataccttaaatacagaatttctcaaagtcagaggagattcctgtagtttgacaagcgctccaggtggttttcataacattctctcccaagttggggcatccgctcacaaattttccagtgtctaggtttatacataaaatgagaccactttttattgttataccccgtcctatgttagggactctctgaacaatatgaggtggcgggtgagggacgagagaaaggtcatttgttaaagcaatctctgatattcgaaacactgagtgttagttttcaaacaagaaaagctggaaaatgtttttttttctcttttgcttgcacaggttctagaactctacttgaaggcatctgtggctacagaattattattattattattattattatttttagacagagtttcactcttgttgcccagtctggagtgcaatggtgccatctcggctcactgcaacctctgcctcctgggttcaagtgatcctcctgcctcagcctcctgagtagctgggattacaggcgcccaccaccacacccagctaatttttgtatttttagtagaggtggggtttcaccatgttggccaggctggtcttgaactcctgacctcaggtgatccacctgcctcagcctcccaaagtgttgggattacaggtatgagccactgtgcctgcccagaattatttttatggtcagaagcattccaaacatttcccccctactaaaatagcttttaaatgatcaaatgcacatgttcatgtggccaaatgatcttgtttttctcagtataacagtaaaaggaaacgtaactgtgcttagctgtggcatggaattgtgatattaccaggtcaaattcaggaaaaccatatttcctctttggattccaaatgatctcagcttttttttgttgggggcggggtggggagatctcattttttgtgtcagaattgtggctgagttacacacctcagataatccaggttgatctgtattggattttgcaatcagaccagcctttggaagtgtgtaaaggacagtctctaagcaacacagatgtttccacaccagggctcagtgaggctgcattatctgcaactgcaattgcaaaagaccttatcacagaaataaattacttacccaccattggaaaagggcctgaacacccctcagccaaaacggaaaggttctaaattcttacagtctctctggggaaacacaaataaccttgcctttgaggggcattctgggctttgtctttgatagctttcatagaaatgtaagcagtatagctggcctacacatatcctgagagatctcacaactgtcaggaaatccgttctcagcacagcaatcagcatacaacattgagtctaaaggaaaccacacctgaacttactctttaacaaaaaagcaaaaaaagaactttcagatgtttgctgctagtatttgccagagtggtgttaaactaatgtccaggtcccatttaagtatgtgcgtgtgtatgtgtgtgatgtactaaacatctaataaacttttagaaagtataatgaatttccgtaattgcttctggaatcacatcttagccctttattcctcctggtaggatgctgtcaagacatgagtttctggcctggcagggtggctcatgcctgtaatcccagcactttgggaggccaaggcaagcagatcacctgaggtcaggagtttgagaccagcctggccaacatggtgaaacccatctctgttaaaaatacaaaaattagctggatgtggtggcatgagcctgtaatcccagctactcaggaggctgaggcaggagaatggcttgaatggaggtggaggttgctttgagctgagattgcactactgcactctagcctgggagacagagtgagagactccatctcaaaataataataataataataataataataatagctgaattgtgattttttgtttcagaaaattctttttcttttaaaatatcaaatataaaattctttcgaaacattttcccctcatttctttggtgtccctcttttgctggcttcctaagcagtatcatttaaagctgtgacttagagttcagtggttaataacatagactttggcatcagattgtaccagctctgccattaattagctttgtgaccttcggcaagttactggaatttctttgtgcctcaattatttcatctttaaaatgtggattataataatatctacttattcagttgttgtgctgttaatatacagcaagcactgtccctgttgcatagagttatatatatatttggtatctggtattaatatagattgtatacagatttgcttggtaatgcctcttcccctacattcctgagcaacttgagggcagatgctgttatatcttatttatcagtgcaaaacctagtgcctactggccatgcagataacatttgagtgagtggataatcaataggcaagtaaatgtaactctattgattctcttgtagacctccctaagtttcctggcatttctagagaaacaaggtaaaatagatgaagataatctgacatgcctggaggacctctgcaaaacagttgtacctaaacttttgagaaacatagagaaatacaaaagagagaaaggtaagtagcttgtgattgctaacttggaccagaccatggaaattcttaaaccaattggccatgcatgatgttttgattatttgttttgttttgttttgttttgaggcagagtctcactcactctgtcacccaggctggagtgcagtggtgtgatcttggctcactgaaacctccgcctcccgggttcaagtgattcttctgcctcaacctcccgagtagctgggattacaggagcctgccaccacgcctggctaatttttgtatttttagtagcgacagggtttcactatgttggccaggctggtctcgaactcctgacctcaagtgatccacccacctcggcctttcaaaatgctgggattataggtgtaagccaccatgcctggcccgtgcatgatgtttactcatcattctgataatattctgctaggaaagccagaaatcttccccttcgttcattcaacacatattggttgagttcatattttgtaccaggcactgttttagaagttgaggatatagcaaagtacagagcaaagctcctgccctcttgcaacttatattccagtgcagggaagtagttttagacaaacgtctttttctgattctaatatgggagtgagagtatagggaattattttaaatgaaataacatgaaaaagaaggcaggatagcatggggtaagagtggactctatagagtcggattgccaggactccacttactagtggtgcagtggtacttttttggcttttctatgtgtcactttccctatctgtaaagtgggcataataattgtacctacctcctaggtttttgtgaggattgaatgagataatttctgtaaaatgcatgtctggcatggagtaagccttctatacatgtggctattatggctctctcagagagaaaagtcataaagacttcacattctcagaaactactatcaaaaaagaactttattttcttgtgtgtgtgtgtgtgtgtgtgtgtgtgtgtgtgttttaagtctgtctgataaaggtagttctgctgtgatattttatacagatagaagcacagggcaaaagtcaaacctggctgccttaccacgtgtcagtacgctaaatatctgtgtttttctgagttcatttctccactgttaagcaagcgctatacataaaaactcatgagtgtattcatgaaacttttatgccacacccttaatttagttcagtgagtgactctagtgtgcaaatttcttggttgaaaatgaaactagctaagaggaaatgtctgtctaagaatttggttaacacagaatgagttgaggagcaaaatatactgttgtcaaactgataaaatctcaaacaataaaatgatgaataaatgcataatttaagttatgaagaataaaaacagttctttctatcatcaaattatcaaatgagaaataaaaagcagaaggttgatatggaaagaatatttgaaatcctcacatgagctctgagtttttttctaaacacattgtcatttttctgtaatgccatatcccatataaagtaaacatagggcaagtggtcatattattctggatatttaaattctaaagaagacacactagtttctatgtagttgattacatttgcctcagtgagtcttgaagactgagctttgttttttttatttttattttttgagatggagtctcgctctgttgcccaggctgcagtgcagtagtgtgatcttggctcactgcaagatctgcctcccaggttcacaccattcttccgcctcagcctcccaagtagctgggactacaagcgcctgccaccacgctcagctaatttttgtatttttagtagagatgggatttcaccatgttagccaggatggtctcgatcacctgacctcatgatcagcctgcctcggcctcccaaagtgctgggattacaggtgtgagccaccgcgcccggcttgagctttgttatttttatttttatttttatttgagctggagtcttgctctgtcgcccaggctggagtgcagtggcatgatcttggctcactgaaacctccacctcccaagttcaagcgattcttctgcctcagcctcctgagtagctgggattacagatgcccgccaccatgcccagctaatttttgtatttttagtagagatggggtttcaccactttggccaggctggtctcaaactcttgacctcaagtgatctgtgtggggattacaggcgtgagccactgcgcctggtccaggactgagctttatatcagcagagttctagttttgatttttcttttctacaacctacctgtgtgtgatctcttttgggtgtcaatcattattgatattttaatattgactttctttagttctaagagtttgagcctaattctgctgttaagatgaaagactaaaggactaaagagtaggtgtgcagactttagacttttctgtaagtgtgtgtgatccaaagtccaagctaggatactggctttatttaaggaccacctggctaactttctaagttgtcttgagccttggtgtttgcttcagtattttttttttcttttttttgagacggactcctactctgtccccaggctgcagtgcagtggggcaatcttggctcactgcaacctccgcctcctgggttcaagcaattctcctgctgctagtcagaaggtgatttttatttttctgtctgtgattttattttcagctatccagatagtgacacctcctgtagacaaggaagccgagtcgtatcaaggagaggaagaactagtttcccaaacagatgttaagacattcttggaagccttaccggtaggttcagtggtgtgctggtcaatgcttaacaaccggctccaccctccaacctcccctccctgccaccccaaaaaagaaaaagagagagaggccccggtttgtaccatttattgtaaatggtctcaccatggtgattgcaagtaaacaacatgatatcaaccagagtgcacattttctgaaaatttaacagttggctgacactagctgactagtgagagctagttagtttgagttctcgctagttagtttgagctgactccccacacccctgagttgctctgaaatggttcctctgttcttatctgtgggatgcaattagagccagctttagggacatataatctatggagcacagggcgtctgatagtaattccacagttcaagtacagagcttttgtttaatgctctgctgttactgctttgaaattcttaatgtattgaacaagaggtttgccaagcatgtagctggccaacccagagggcaagggtttctggtttctgtggtgctcagctctgaaaggatgggtggaaggggaaacgttgggagaatttgcagtctgttcctcaccatgtgatcatgatccttgggagatatgtgacagtcttccctgggatttgtggttcttccagcagacttgggtaatttctttgccaacatctgtcagcatcaatgaagttagcttggtctgggaaatgttttgtttttgttttcaactgtgataaaatacacataacaaaatttaccatcttaatcaattttaagtatacagttcagtaatgttaaataccttcacattgttgtgcagacattaccaccatccatctccagaactttttcatcttcttttagtaaaactttgtacccattaaacaataacttctcattttctccttccctccaacccctggaaaccaccattctactttctctctctataaatttgacttttcagggtacctcatataagtagaaccatacaatatttgttcgtttgtgactagcttatttcacttagtgtaaagtcttcagggttcatccaagttgtagcatatctcagaatttccttcctttttaaaggctgaataatattccactgtgtgtatatacagtaagtcctcacttaaaaggttgatagatttttggaaactgaatttaagtgacagcatactgtataatgtatttatttttatttaaaatttttttttatagagataaggttttgctatgttgcccaggctggtctcaaattcttgggctcaagcaatcctcccgccttatcctcccaaagtgctgagattacagccatgtaccaccacgcccagccacataccatataatgaaaccaattttaccataggctcattgatataaacaagagttggccaggcatggtggcccacacctccaatcccagcactttgagaggccaaggcaggcggcttacttgaggccaggagttcgagaccagcctggccaacatagcgaaaccccatctctactaaaaataccaaaattagctgggcgtggtggtgcatgcctataatcccagctactcgggaggctgaggcacaagaatagcttgaacctgggaggtggaggttgcagtgagctgagattgcatcactgcactccagcttgggcaacagagtgagaccctgtctcaaaaaacgataacaaaaagccctaagagttaagtttctatagcatacagttcgttgtttcacttaaaggcggagttaccaagaacctactgatgactctgagtgaggactcactgtattacattttgttgtccactcatccattgatggactcttgggctgctgccaccttttgactatttttaataacgctgctgtgaatgttggtgtaaaaatatctctttgaaatgctgctttcaattcttttgggtttgtatccataagtggaaatggtggattatatagtcattctattttcaattttttgaggaaccttcattctattttccacagtgactataccattttacatttccaccagctgtgcacacatcctcagcaacacttcctcaccaagacgtattattctctttcatttttgatagtaggcatcctaatggaagtgaggtcctatttccctgtggttttgatttgctttccttaatgactagggctgtcgagcatcttctcatgtgcttttggcgatttgtatatcttctttagagaaatgtctgtccaagtcctttgttcattttctaattcggttgtttgtagaagttttatttttaattcttttttttttttttttgagacggagtctcactctgtcgcccaggctggagtgcagtggcagggtcatggctcactgcaacctctaactcccaggttcaagcgattctcctgcctcagcctcccaagtagctgggattacaggcgcgcatcaacacacctggctaatttttgtattttttaatagagacagggtttcactatgttggccaggctgatctcgaactcctgacctcaagtgatctgcctaccttggcctcccaaagtgctgggattataggtgtgagccaccgtacccggcctttattttttaattctttttttttttttttttttgagactgagtcttgctctgtctcccaggctggagtgcagtggctcaatctcagctcactgcaagctccgcctcccgtgttcacaccattctcctgcctcatccttccaagtagctgggaccacaggcgcccgccaccacgcctggctaattttttgtatttttagtagagacggggtttcaccgtgttagccaggatggtctcaatctcctgacctcgtgatccacccgcctcagcctcccaaagtgctgggattacaggcgtgagccaccgcgcccggcctatattttattcttaaaaattcttttatggcttctttactattgtcatggtctgatatttttacagttacaatttttagatttaaaaataatttcaattttatagaaaagttgcaagaatgtgaataatataaagaatacctatgtactgttttcctagatttacctacctgttgttgatgttttaccccatttgctttattatttttgtgcatttactcacacttgctctctttctccctttctctccacacacacataatttttttctgaactttttgagagtaagttgcatacatcatggccttttactcctaaatattttcgtgtgtatttcctaataataaggatattcttttacagaactataacacaattatcaatgccagtaaagttatgttaatataatacttttatcaaatcaatggtccatattccaattttgtctgttgaacccaataatgtccttgacagtttttaaaccatctagtacaaaattccacataggatcctatataaatgcaacacaaggctgggtatgttggctcacacctgtaatcccagcactttgggaggccgaggtgggaggaccacttgaggccaggagttcaaggtgagcctgggcaacatagtgagaccctctctaaaagaaaataataaaaattaaaaatacaatataatacaatacaatattgtatttagttgtcatgatcctttagtctcctttaatctttttttttttttttttttttttgaaactgagtctcaccctgtcacccaggctgaagtacagtggcatgatctcggctcactataacctccacctcccaggttaaagcaattcttgtgcctcagcctcccaagtatctgagattacaggcatgcaccaccacattcggctaatttttgtatttttagtagagatggcatttcaccatgttggccaggctggtctcgtactcctgacctaagttatctgcctgccccagcctcccaaagtgctgggattacaggcgtgagccaccatgcttggcatagtctcctttaatcttgaacatttccacaacttttatgacatttaatttcctcttttatgccattgagacttttgaagaatgcagtcactcctcccacctttcattaaatagaattttccttatctttggtacatgtggtatttcctcataattagattcaagctgtacgttctggccagaatatcacagaagtgatgtgtctttctcagggcatcccatctggaaatacgtcatgtccatctgcccccctattcgtgatgctaattttgattatttggtcaagatattttctgatattatcactctgcagttaattttatatagttactattttttccccacgcaattaataagcaagtgctggagagacattttaagattctgtaaatatcctgctgcacatgaaaagtttccccctagattgagcgtctgctgatgattcttgtgtgatccagcatttactatgttggttgtaaaacaatgcttttctgactccagtattctctccacattcgtaagttggctctcagcattctactgtaaagaaggaccctcctttctccccaggaaggtgtttttgtttttttaaatgaaggagaccgtggaaactcgccagatgacctgtagctcctggagcttggcaaaggctgggcaaacgcccacctgaagactatgcaggcaatcaggacatgacacagagccgggagaggcctgctcttcggctctgccctgaacctcattcggcaggtggaggtatttaggcatttgagggaatctcagctttgggaggccactttgtaagtgatcttaagagattaagtacatccttaattaaaagaaatggtaacacctccgcctgcttgctgtgagtttattcatttgaattccccatctcccccaatgggaaataacacagaattgcaattatttataaaatcttaaattggcttcttttctctaggaaaatagcccttgattcaattaattccaatcctagaaaagcgcctagatatctgattgaggtattgagggagagaggctgctccccttgattcttttactataatccaattaaagcaacatttatgggccaactccctggccatgggcacagctttgtttagagagttgcaaatccattcccacctccccgctcccccagaagctctttattattttattttatttatttatttttttgagatggagtctcgctctgtcacccaggctggagtgcaatctcagctcaatgcaacctcagcctcccgggttcaaatgattctcatgcctcagcttccctagtagctgggattacaggcacccgccaccatgcctggctaattttttttgtatttttagtagatacaggatttcaccatgttgacttaaggtgatccaccctcctgagtctcccaaagtgctgggattacaggcatgagctattgtgcatggccatcccagaagctctttaaaatgtggttttccagcactgacattttaggattccctaattctaagttaaattgtctgctaaatgtaactcttcccacccactttttcaacttgttttgtgctcagatactgacatgcatgtagaaacacacacacacacacacacacgattctgctcgttgtctttgagaaattcagtggtttctaaaggggcatggctcagctgtggcctctgaagcgctgtggttccgctgacgtgggatgataacttggccacggcacatgcagtagggggatagtcgtggcagtactagaagtgcaaaggggactggggcacagcatctcacgtgttttcacagacttttaaggttggaaggtgtcttaaaagttatctgggcagccctttccctctccatcaaatgatgaataaaataaaacttggtgaaacatctcatgtttcttaagcacctgaggattttttttttaaatttaaaagaacactgccaataattgggctcaatgagaaggaactctcatcgaattttaagcaacatctcctaatatgtttaaaaattaaatttatttttttctcagccccctgcaacttcagcctcccaggttcaagtgattttcctgcctcagcctcctgagtagctgggattacaggcacgtgccaccgcacccagcaaattttttgtatttttagtagagatggggtttcgccatgttggccaggctggtctcgaactcctgacctcaggtgatccacctgcttcagctcccaaagtgctgggattacaggcgtgagccaccgtacccggccaaatcgatttttttgagtgtggcataaggttttcttaaggagaggcatgtctctctatggaggagacctaacacctgcttctttataaggccttattggacccctcttgaaaactatcaaaagaagttgaaagatgattcagtgtggccaggctgtgggacattcactcattcattcattcattcctctctgacatagagacttgagaggtgtcaacagaggatgcaacattctcgggagaagaaaggcagattagaccttaaagcttttttctagtccctgttctggctgactttatcagccaagggaagaacaaatcaaggaaagccagggcctggaggggctgggcagagcctgctgctgtgtctgcattgcccctaatcccagaagactcactcaactgctggacaaaaccagaaggcagtctggccaggcccttgtctgcctcttagaagaaatctaggattctacaggaagggaacagtggcttatgaaaagaaaggcaggaagccttttggaaagtgaagctaagcctcctttgcatttgttcctgcagagctgggggaacagctcttccccaacaccttggtcaggtccccttgggggctttctgctgaaggctgacggctgagagtcatagggggaagggggtgatggtgaatggggaggagggtacagaaaagacagggtcttagactttgttttaattttgtatttaattatataaaacattaatgtatgcccaaggtagtgcatccttgcctctcctccccacctcgattgccatttttatttgttttttgatttatcttattacttttgaaaaaaatccaacgtatatcttccctttattacaaaagaggtagtgcactcaaataccatttcattttgctttctccatatgacagcatcccctggagaagggtatagaggctgtccttggcatcttactccactatgtggacataccacagctttttcaatcacttcctattggtggacattaggctatttccagtccttagtgtaaataatgctgcaatgagtaagtacccttgagcatatgtcacactgtatttttgccagtgcgtctttgtgaaccttctcctttggatggagagagttggttctcttcccatttcctgccaatgaactttcttttttttttttttttgagacagagtcttgctctgtcacccaggctggagtgcagttgcgcaatctcggcccactgcaacctctgcctcccaggttcaagtgattctcctgcctcagcctcctgagtagctgggattactggcatgcgctaccacacccggctaatttttttatttttagtagaggtggggtttcaccatgttagtcaggctggtctcgaactcctgacctcaggtgatccacctgccttggcctcccaaagtgctgggattacaggcatgagccaccgcaaccggcccaatgaccttttctgtggctgtggattagatatctgtccttccctgcatcaagtctagtttttgttcctcatcctaactgtgtgaaattcctatgtttcatgccctcctttcttttttctcagcaggagtcctggcaaaataagcatgcaggtagtaatggtaggtatttctaatgtactttttacaacttagatcggtatggtagggatagacatatttgatatataccaaggaattcaaggtgacttggaagagaagctttataaataatgaataattcattttttattccaattcaaggcaagacattgaatgcatggattgtactaggcttttctatggcagtatggagagggctgggtggtttctgctctgaatgcctagtatagcagattctagggactgcaggcggctgttcttcctccacccttcagaattaggccaccctctgtgcagcagaaacagcccccgcagggctgaagccttcaggccagtagtgacagcagaatgtgcagtctgggtgcgtgtcctctatggagtggttccagatgttgcttcagagggagagaagaagcaagaggagggacttgaggatggtgtgtttagttccctgaatccctgcccagaaaccataaccttaggaaaatattccagaatctgccatcaggttaaactgcttatgaacaaacaggctttggcgaagtctttctgtggtatgtaaagtttgtcacagaccattcctcatttttttttctggaaaattatccttcagagtccaagacacacagctttgctagcaatttgtctttttgcctaacacggaggttgtgtgctatgatgttggtgacattgaccaggtcaccattattaagcacttgtcacatactaggcactgttcagagagatttcagggattatatcatttattcctccattcactggaggtaggtaatactgttattctcactaatgatgaggaaactgagacccatgaaatctagtgctttgcactgcagctaaaaggcaccgcagctaaaaagaagtgaagctgggatttgaacccagctgtctgattccagagcttactctcctaaggccaggctatcccagtgtctatttatgtgagctcaggtgactgcttcacccctctgaagaataaagcagtttctttcagctttacaattctgcggttccaacatttagacgtgacttcccgtggagcattaccttctctcatggtgaggaggaatttataggtgctctgagccactgaagcgtggatcccttttgctgtattttctggtctggggaatatggacttgctcagcctgaggactgacccttagcagtagttaataactaactcatgccccagagacaaggacagagtttggtgggttctactacaaacttcctgtgagtggaaaaagaaaactgtttgatgttacattttcctgttagtgccatgtgacaaataatgcattgctgactttctctctgtgatagagtcttttccagaggaatcagggagttggcaggaacacttcaaagcagtgtgatcctcagtcgatgcccaactggaactttctttttcccctcttttttcttttcttttcttttcttttttttttttttgagacagggcctcactctgttgcctaggctggagtgcagtggtgtaatcacagctcactgcagccttgacccctcggactcaggtgatcctcccacctcaacgtcccaggaagctgggactacaggcaatgtgtcaccatgcccagctaattttttgtattttttttttctagagatggggtctcactaagttgtccaggctggtcttgaactcctgggctcaagcgatcagcccgtcttggcctcccaaagtgctgggattacaggcatgagccaccacgcccagcctccctctttttccttctctagggaagaggtccacctagcctctttatatccagtgacataaatgctgactcaatccaaccatacttgagctggaagccttgagctgatccatgggatcttaattaattccccacccaatccctgccagcagcatagtttccaacccagacaaagcaaaaaagaatgcgaagacacatcagtctctcccatcaggaagggcatggtggctgaatttgtctcaggagggccttgagagaagcataattctccagaattagatgcgaaaattatcagtgaagaaatctaagtgcttggggaagatatttggagtctgagtacctctctttctaggtaacagagccacaaatggtgcaccaagcctggtctccagggggatgcaaggagcatctgctaacactctaaactctgaaaccagcacaaaggtctggatggtttcttttattccttttttaataaaaaaattttttttccaaatttaatcaaaaggacggtttctttaggggctctctccctagggtccagccttcgatgattttaagggctccgagctgtttgtttcagacttgtttctccctctctctgtaattatctctgttcttcccacctttttctgtatcaatcagaagtgactgatccctttgactgtggaggaaatgctgttacactttgagtcatgcataccctttgggttatttctggagaggggtagtttcttttcttatccattgaagccacttgttttctgcttggataaagatgtaccacgatttcaaggatgattttagctgcccagaggctctgctaaagccagctcagctaatttgcaatcacatgctgtttacaatagccttaaaaaataattgcacatgtttttaaattcctactgtgaatatatatatatattgaattttaaaaattgaatatacagccatctttatatacatatgaatatatatcagccatctttatatatatatgaatatatatgtgtatatatatactttatttataagtatactttatatatatatacttatatattaagtgtatatatatatatacacacactcatatatatattcacatatatataaagatggcggtctcactgtgttgcccaggcttgtcctgaactctcaggctcaaggaattctcctgcctcagccacccaagtaccaccatgccagcttgtatattatttttatattcagaaataaaattacaaaagatttcccttttttgaaggcattagatcactccagaaatgaaccatctgaaaaaaatctttgatatttatgttgtctcatgaaatccttgtgtatgctttcttcattcatgttgctaatatgaaagtgaagatgcttttgcataaaccctgggtttgacaatattaaaatatatattccattttcttaactgtcatgattgagcttctccagccaaaccaggtgaagtctgaattttaatcaggatctggcatttcaccttggaattaattagctaattccacactagggccaggatcttgagaactctctgcctctgatactgggagtggcatcctgaaagaaaggaactgtctaatctttagtgcaaatgagatttatcctttgtcctgggctctaggacttaaaaaagaatctttgaaattttattcagatcacaattgtgcagtaaaagtgagttgcagagtagtcagaatccccagtttttcaatatgtgacttcagaaataatgtggcataaataccccaaggggtttagactagagtataaaaacatggttttggacaggcatggtggctcatgcctgtaatcctagcactttgggaggctgaggtgggcgaatcacttgaggtcaggagttcaagaccagcctggccaacatggtgaaactctacctcaaccaaaaatacaaaaattatcggctgggcgcggtggctcatgcctgtaatcccagcactttgggaggacgaggtgggcggatcacaaggtcaagagatcaagaccatcctggccaacatagtgaaaccccgtctctactaaaaatacaaaaattacctgggcatggtggcgggcgcctgtagtcccagctactcgggaggctgaggcagaagactcgcttgaacccaggaggtggaggttgcagtgagctgagatcacgccattgcactccagcctgggtgacagagcgagatgctgtctcaaaaaaaaaaaaaaattatctgggggtgttggtgggcacctgaggcaggtggatcccttgaatccgggaggcagaggttgcagtgagccgagatcgcgtcactcactccagcctgggcaacaagagtgagactccatctcaaaacaacaacaacagcaacaacaaaataacaacaacaacaaaaacatggtttaaacaactggcatggggagatacatcctgctcttcctcacagtggatccattggagtggttggttagaaacatttaaggccctaagataaggattcctactaagtggctctatctattcttcaagagggcagctgtgtacaggatgaatcggaaccacagaggcctctgtgtcattgtcaacaaccacagctttacctccctgaaggacagacaaggaacccataaagatgctggtaagaaagtctggaacagtttatcaaatgcaaattggggatcttaaaattattttttattttcacattttctttctgtgacttttatcttccatatacgtgtaaggatgatatcatgtttctgagcctcttatatatccctggggagtcatcagtctgctaaagagtggcaagaatctttgactattcacaattctgaatagaggagagcatgtactgggggagagcctgctggattggcacgagacaacttgggcgtgagctccagctccaccactaactaggtgtgtgatcatgggagagtcaagagaccttggcttcttcaactgtgaaacaggatgaaacactggccactgccgattctcaggactgttgtgacaacactgggtattacgtgataggagattcattgtaagattttatggttatgaaaataaaaataatccaaagctttaggctatttgctgtgcaaattttgtaactattagcattgtttcagttttttttttctttgagacagagtcttgctctgttgcccaggctggagtgcagtggtgcagtcccagctcactgcaacctctgcctcccaggctcaagccattctcgtgcctcagcctcccgagtagcagggattacaggcgtgagccaccacacctggctattttttgtattttcagtagagatggggttttgccatctggccagactgttctcaaactcctgacctcaagtgatccgcctgcttcggccttccaaagtgctgagattataggtgtgagccactgtgcccggccttgtttcagttcttcattttgttttgcatcattttattatttcccctttctctctctctctctcttttttttttttttttgtttttaaacagagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggtgagagctcttttttttcttccatttgtaattaattagttttatttattttttattttactctcattcaacacctttggtaagggtgagagttctacgttgttctatccatgtacctgttcaaccatctgcctaccctcctgtttatctatttatccatctatccacccattcatctatccatccatctatccacccattcatctatccatccatccatctgtccatccatccatccatccagcaaccttgtattgagtaccagcctggacctggaaaggaagatacagagttaaaaaaagacagagtccttgccctcaggttgcttacaagctagagggatagacaaacaaatagacggggaagggcatccccagctggtaagtgcacattgtgaagtataggtgttatgggaacatgcagaatgagtaccttgcccagatttgaaggatcagaggaggcttctagaaatgacaaatagatgttaggtaaagaatcaggtgaaagatgtgctgggcagagggaatagcatgaacaaaagcatgggggccttttatttgttcgtttatttatcactcactcttacgtcctgagcacctatgtgctatctttggacttctatttgccactgctctgacagcttcccttctgtctctgccacatgctgtcctcttggcacctttagccatacctagaggccatgggctcctccatgaaaacgtctccaaagttgccatctctggcccactcatctctgaattcctgggggcagagaccctgtttcattcaactttatatcctcagcccctgacctgatatattgtgagcttgttaaacatttgctgggccaatgaatgacttgcttgagcctgtctcattaacatcccgctagatatcctacctctgtttagcccttggacctcacattcagcatgcatgtttctgagctcatcttcccagctctctccaggagctcctactcctgaatttccatttgaaggaatggccatagtgctcttctgggaattcaggattggaaccttgagtcaactttgcttttctctcttctttaccagcccctccattctcatcacagacatcagaggctaatgtctatggcttcaggaacaaggcaatatttattgagagcgtactatgtgcttactgtactgggtaccgaactggggacagggggtgcaactgtgtacaagagagacaaaatctgctctccagggagctaaaagtccagtgaaggaaggacagataataaaaatataagtgaatatttaaattattattattttaaaaattcaacaatattaaaaggagacagtatacatgcatgattaagcaatgtgtggttttttttggtactccagaaatttctgttatttttaattgatacttcataactacatatttcagggttataatttgatgtttcaatacatatatgtgttgtataatgatcaaatcagggtagttagtgtatccatcacctcatgcatttatcatttctttgtggtgagaacctctaaaagcctctcttgtagctattttgtaatatacaacaccttactgattgatcgattgatttaaatatgggatctcaccatgttgccgaggctggccttgaactcctaggctcaagcaatcttcctgccttagccttgtaagtagctaggattatatgctcaaaccacagtgcccagctcagaatgccttactgttaaccatagtcaccccactgtgcagcagaacaccagaggttatttctcctatctaattgtaactttgtacccattgactaacctctcatcttcccttccctccttctctctctcatctttgtaattgctgttctaatcactgcttctatgacatcaactttttaaacaaagattccacatgagtgagaacaagcagattttttctgtgtcttgcttatttcactctgggctcattcatgttgtcagacatgtcaggattttctttttttatggctgaatggtattctgtcacgtataaatatcacattttctttatccatatatccatttttggacccttaggttgattccatatcttggctattgtaaataatgctgcagtaaactgggagtgcagatatctctctgacatattgattgcattttctttgtttatatacttagtatggggattgctggatcatatagtatttttatttttcattttatgaggaactggcatactattttccataatggctgtactaattttcaataccaccaacagtgtgtaagtgttcccttttctccagatctttgccaatatgtgttttcttttgtttcctcgataatagccattctaacttgagtgaagtagcatctcactgtgggttttttatttttatttttatttttttttagacaacatcttgctctgtcaggctggagtgcagtggcgcaatctcagctcactgcagcctctgcctcctaggttcaagcaattcttctgcctcagtctcccgagtagctgggatcacaggcatgtgccaccacgcctggctaatttttgtatttttagtagagacagggttttaccacgttggccaggctggtctggaactcctgatctcaagtgatccacccacctcagcctcccaaagtgctggtattacaggcgtgagccacggcgcccagctgtcactgtggttttgatttgcatttccgtgatgattagtgatgttgaggggtggaagcgggtaagtaggaaaactcccaccacaactatagtgctagagtgaagtagggctgagactggggttgggccttccaaggcggaaggaagtcaggggtggaggccaagttgggctgattttcctgctgctgctaagagaaaaccaattaatggaagaaggttgggggtagggttaaggataagtatttgttgaggctctcatgtattggatgatgagaggaatcatgctatagctaaaataaagccaatgtcaccaatgcgattgtatagaattgcttggagggctgctgtgttagcatctgcttggccatgtcatcagccaattagtagaaaagatataattcctacaccctctcatctgataaagagttggaaaatgttgttggcagtaactagaattaatattgtggtgaggaaaataagtaggtatttgaaaaactgattaatgttcagatctgccttcatatatcatattgagaattctataatagatcaagtgataaatagtgctactagaataaacattatggagaattagtctagtttgaagcttaatgagagttttagggtttggattgttattcaatatcagtttgagatgatggtttcttggtctgtacacataaatgttgtgggaatgaggctaatggtgaaagtgcatgcgacagctatttttacatagtatggatatgagttctttttgtgagggttgataaaggtaataataattggtaaggttaaggagattaaggttattatagtaatggaaaaatacatgattattacttttatttggagttgcaccaatatttttggttcctaagaccaatggataactctcatcctctaaaagttgagaaaactatgttgttaggcatggaggcatgagttagcagttcttgcaaactttatcggtaaataagaagttgcggacttctattattagaccacaatctaacattttgattaaactatatttacaaggtataagtcctataataattttaggatttagagatagtaagagaattggtgaaaggtgtatgagtattagtatgttttctcgtgtaaaggaaggtttaatgctgttaatatagtatgttagtgttccttgttgtgttgtgacaagtatatagagggaataaagggctgtgattaatatattaagtcctataagcatgatggtagtgtttgatcaggagaatgaagccgttgttacaaggagttctcctactagattaatagtggggggtagggcaaggttggtgagatttgctgtaagtcatcaaaaggttactagtggaagtaatgtttgacgtcctcgagagagtaatatgattcagctgtggattcacttgtagtttgaatttgctaggcagaatagtagggacgaagtaagtccatggggaattatgaggataattgcactggtaaaacttcagggggtttgaatgaggatagccacagtaacaagtaccatgtggcttacggaggaatgtgcaataagtgactttagatcagtttgtcgtagacagatggagcttgtcataatatgcctcataaggataatatcaggaaaggataggctatatgttctgtcagagggctgaggatgagggtaagtcgcattttgtgtagccgcccaattttaggagcactgctgcaagtactattgagccagccttaggtgcttatacatgggctttgggaagtcataggtgaagtcagtataggggtatttttactatgaaggccattatacatgccaatcacatgagattgttggatcaggagattggtagttcttgatattaaatgttattattatcatgctcagtgagcctaggatattttgggcataaataagtgtaataagtagggggagggatcccactagtgtgtaaaataagagatatgtacctgcattgaggcgttctggttggttaccccatcgggtgataataattaagatagggataagtgtagcttcaaagagaatataaaatataattagttctgtggctgtaaatgctatgattagaaaaatttgtagggaaattaatatggaaatacagggttttttccataggggtgattcactggagaggtggtactggcttgctatagttataagaggtagtagtcaggctgttaagattagaaggggtgatgttagcggatcagaggagaaagttaatgagaagttgaatagattgtcgttgaattagttaaagaataatagggcaatgaagctggtgattaggctgtgggtagccatattgattcaaattgtataatttttagagagtcatgttattggtagtagtataattgtaggaatagttatttttagcattgaagtaaatttaggttatgtatgtagtctaagccatatatgttggaaattgaaagtagcaaagcaaggcctaccctggctttgcaggcagcaaatactggtagagtaatgggtattacatttgctagggtgaagtgtatatttaaagctataagggtatttactatgaataatgataatattattccttctaggcataggagggatgatattaggtgggactgatagactaatacccccagaagtgatatgataaatgctaatatgatacttatgtaaatagagggcatttggtaagtatgttctatcataatctaatgaaatcatttattttgccttaaactacttatttttttcttatacctgtggaccatttgtatgtcttcttttgagaaatgtctgttaaagtcttttgcccatttttaaatggggttatttgtttttttgctgttgagttatttaagttccttatgtattctaaatattaactccttgtgagatgtataatttgcaaatttttttcctattttgtaggttgtctcttccctcggtttttttttttttttttttttttttgccgtgcaaaagggttttaatttgatgtaaactcatttgtctatttttgcttttgttgtctgtgcttttgaagtcttgttttaaaaatccttgcccaacccaatgtcatgatatgtttgccctgttttcttgcagcagcttcatagtttcaggttttacatttaagtcttacacattttgagttggtttttgtttatggtgagaggtaagtggttagtctcatttttctgtgtatggatattcaattttcccagcaccgttttttgaagagattctcttttacctattgtgtgttctgggcacctttgtcaaaaatcagttggctgtaggtgtgtgaatttatttctgggatctatattctgttctattgatctatgtgtctgtttttataccactaccatgctgttttggtaactctagatttgtagtatattttgaagtcaggtggtgggatgcctccagttttgttctttttgctcagcattgctttcactatttggggtcttttgtggttccatatacattttagggtttttttccctatttatgtgaagaatgtaatttttttgtttgtttttgttttgttttgttttagagatggggtcttgttatgttgtccaggctagacttgaactcctgggctcaagcaatcctcccacctcagactcctgagtagctaggactacaggcatttgccactgcacttggcttgtcactggtattttgatagggactgcattaaatctgtaggtcaccttgggtagtatggtcattttaacaagattattcttctaacccatgaacacgagatatctttccatttatttgtgtcctcttcactttctttcatcaatgttttatagttttcagtgtttaatatttaagttaatgatattttaattgtttaatatttatttaataattttattattcaattattatttaatattaatttaaataatatttaaattaataagaaaaaattagccaggtgtggtggcatgcacctgtagtcctagctattagggagtctgaagtgggaggattgcttaagcccagaagtttgaggctgtagtgaactacaatcgcattaccgcattctagcctgggcaacagagcgagatcctgtctctaacaaaaagaggcaatttcaggaagtgatccctgccatgaacaaatcaaaacaggataatggtagtttcttggtggaggtaatatttcaggtgagactaaatgataagaaggaaacagacacaggaagatttgggaatagagagcaggtgcaaagcaagatgcagggattgagagcaggtaagggcctgcatcccttccctgaaaaatagtgatagttaaggatgaggggatgagagtagtcatactaatactaaaaatgatggtcagcagaacagtgtagccagtgttctaagtgcttgacccaatatacatcctttaatgctctcggcaacccctaagatggggactgttatggttcctattttagagctgggaaaaccgaggcatggagcagtgagtaaccagcctaagagcacacaatgaatgaatgatggagccacaatttaaaattgaatgtgttttcagaacctgtgcttgcttccagtgatatgtattgcctaccctgagaacgttctgctaaatgctatatgtcctgcaagcccaggctcaaatgctaccatctgcatgaagccttctctctccctcccaaccagaaatgcattctcctctgaacttgcagtggaaccttgacctttcatttggtgttgaccacattctgccttgtgttatgaatattgtgtatatgccatcctcggtaaatgtttcatatctgcattctaagtggttaacttcaggaattgtgtcatgtctatctttgtatctctcccaagactacagatagagagggcattgttggtatctgtggcatctgctgcatatttgttgatctaagacctggtacatggtacctggtgtcttttctaagacctggtgtgtggtttctacctcctgactgaaaaaagtttcttctctgggccaggcacagtggctcatgcctgtaatcccagcactttgggaggccgaggtgggtggatcacctgaggtcaggggttcgagaccagcctgggcaagcaatatggtgaaaccccatctttactaattagccaattgtggtggcaggcacctgtaatcccagctactcgggaggctgaggcatgagaatcacttgaatccaggaggtggaggctgcagtgagctgagatcacaccactgcactccagcctgggcgacagagtgagactccgtaaaaaaaaattttgttttcttctttgttgcagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcacacaaagcctgtttggttgtctcttcacaaggacgcgagtgaaacctccttcatcaggagcatttggggtttgatgtttaagttttgggcctctggtgtatttcatatttctgttttgctagaacttagtgcttgtgcaaggttaaattctagaatcaggaaacgttgtttttaggggccttcagcaagcacttcggaggtccctggacgtttacagctgtgagtcgtggatctacccagacatcagaacatagtcatccttggctcattcctcctccgtaggaggggtacacagttggtagagtgtgccctccaagatttcgtgaaacattatgcttgtctgtatttgtgtgtgcatgtctgcgtgaattttgagttcaggaataacaggtgatttgatcacagctatttgacagtggtgatagtcattgtatgccaagatgtttatgaggggaataggtagattgagtgaggttcatgtatattttgcctagttgtactcacctacaagagctgtaattaaatgtttctctctttccccttcctctcttttattcattcttttttttttttttttgacaaagtctcgctctctcacccaggctagagtgtagtggtgtgatcttggcttactgcaaccttcgtctcctgggttcaagcgattctcctgcctccgcctcctgagtagctgggattacaggtgtgcaccaccatgcctggctaattttcatatttctagtagaaacagggttttgccattttggccaggctggtctcgaactcctgacctcaagtgatctgcccactttggcctcccaatggaatgaaccattgtgtctggcctcattcattctttctttcataaaagtttggatactgccaaacaaaattaaagacatgaagacatttgataaattgttattacaaatgtgacagttatttaactactggtgtttatttttattagagtcatagcacctactggcctctgcttcagggattcacaatggtgttgggcaggttggatatcatggggcttacccttagcaaggcattctattccacctatgcccaggcggtgtaaaacatataagcatctggtacgctgtggtaccgacccagtgactggtataacacaatggttaaggttgccaaatagcaacccttaatcaataatgatcaaatctccacggaggtaaactaaactagaagtttacctcatacaggtaatttttgtgccatacatgattcacagaaccttccagatctgatgctttctgagtgatctggtcaatttgttctcaacctggaattcttgggcccttaggtgtttgtaaatttgttctcagagactctgagctctccaccttcatttttaagtgctttaattctttttggtgataatctttaaaacttcacagaggtgtgtcctggctctttggggcgactgcttcatatttgagtactgccacacaatgacagctcatgttctggggcctgcctacagaaagggatgaactttatcttggaccttttaatgtagtgtggatgggcgtctgtagctggaggtcttcaggtgccagtggttaatctgtttgaagcttgcttcactccaacctctcattctgtaacagactcctcctccaccgtccctcacctctgctgaacccttctagcagagggaactcaccacaagtgggggatggatttgggagcttgaaaggaccccaatgaccctgcagtccagccctcaaagtgctaagtgacttactgaagcctcgaagccatttctggaggatttgcaattctttgtatctctggatttgctgccctgtccctccaagccacctggtttcacttttggacagctttaagtgttctcttctctgttctctgtttctgccttcttagaaactatttaaaaccactcattttcattctaaactccggagccataccaaacaactgtaactgtcctctggtgagatttgcgttgtatgtgacaaatcttttaacttttttctgttagggtttcagttttgttggaagtctgcagtttgctcttaaggatgtgataagaatgtaacaacacatttgtatctttgaattttgaataggaaccaaatttttaaatttagtttagttttgttttgtttgagacagagtctcactgtgtcacccaggctggagtacagtgatatcatcttggctaactgcagcctctgcctcctgtgctcaactgatcctcccacctgaacctcctgagtggcagctggggctacaggcaggtgttttttaaaaatggaactcttttctttttttttttttttgagacggagtcttgctatgttgcccaggctggagtgcagtggctcgatcttggctcactgcaagctctgcctcccaggttcatgccattctcctgcctcagcctcccgagtagctgggactatgggcgcccgctaccacgcccagctaattttttatatttttagtagagacagggtttcaccatgttagccaggatggtctcaatctcctgacctcgtgatccgcccgccttggccttccaaagtgctgggattacaagcgtgagccaccgtgcctggccaaaaaaaaatggaactcttaatacattagaaaaaaaatgaaatcccttttaaaaagcactagaggaaattctgtgtttaaagatttacttatttggcaatgcaaacaactgtttatttcctaacataacttttgcaaatctgaatttttatgaaaagatttttaaattaaaaattttaaattgtactaatttttactttttaagtaattttgagtaggtaatatttttataaagatatttgtatggtttgaagataagaaaattaaaggtgttcaagaagagttttgcccccagttctgtccactgtatacccagtcctccccacttctgcatacatatttcagacaggtatttcttggaagaaagaacatatgctgtgaaacttacatgtctcagtaggtctcattttaagtgattctgtaaaatgcctgggaaatactggtgaaattctagaatggaaataactttgtgagattttgagctgagtactggtaaatagtagaaatggacttactaataaataagggaattttatttgataacttttttctgattacatagtaatgtatgttcattatggaatatttgggaaatacaaaaacacaccaagaaaaaagtatatttatttataattctattttgctatgtattttcccattattcactctgtgtttgtcacagatttttccccaccctttttcaatgagtgtatcctccatgtccccccaatcatgcatccagtaaactttgtcattactaccatctgtactttcactcacgtttcaattccaagcatgtccctctctgacaaccacctcccatcattccatcttgcttcttctaggaccttcccttcaaggatcttcagtgccaccagggcttccagttaggttgactgaccctatctattgtcttcccgatgtcagcaccgcccctcactccctcttcattcagcttagagtccatgtgtctttgttaaagtctcctgtacccaccaacacccttgcctttctgtcagttccactgaggtggtagaatcccaactctggttaatcctataaatccttgtcctccaaatttgtactggaattccaggatgtggctggggtaaaaaccttccatgttgcagacaggtctcgtttcaaaccaatgaccacaaacctccaatgggctttcaggggtttcggcaatgctgtgacatttccctggttatatcacccttttgcactctcggtctgttttactaatcatcgaattctctatgatctcaacctaaaaggttagagatatttcctgagaagccccaccttttctcttgataacccactatggagctgtcatttgtgaatttaagaagaaacacttgcctcttgactattttaaaacatcaaaaacaacatttaaaaattgaaggatgaggccggggtgtggtggctcgcgcctgtaatcccagaactttgggaggccgaggcaggcggatcacctgaggtcaggagttcaagaccagcctggccaacttggtgaaacctgtctgtactaaaaaaaattagctgggcatggtggcgcacacctgtgatcctagctacatgggaggctggggcatgagaattgcttgactctggcaggtggaggttgcagtgagccaagatcatgccactgcactccagcctgggtgatagagtgagactctgtctcaaaacaaaaacaaaaacaaaacctgagggatgagccacaaactgggaaatgatatctgccacgttgtataactgataaaggagatatatgtacatatactatatatataatcttctataaatccataaaatattaaacaatccaacctagatgggcaaaaatataaactagttcaaagatgagcaaaaaatatgaaccagtaattaaaaggaaataccaatgagcaataaatatatgaaaacataaccattctctttggtcatcagagaatttgaaaaatacagccacagtgagatagcattttatgtccatcatattatcaacatttaaaactctgtcagtaccaagtgtgggtgaagatacagagcaaagggaactctattacatcgatctaggaaatgtaaattgacacaatcattttagagagcaatttgcaatatttataaatgttggaaatttgcacacagtaaaatctagcaattccatttttggatctatgtcccaaaataaacttaaaaacattgttttgtagagacagggtcttgttatgttgtgcaggaaggtcttgaactcctggcctcaagcaatcttcctgcctcagcctcccaaagtattgaaattataggcgtgagccaccacgcctggccccaaaagaaatcttgcacaggtaccaggagataaggaggaagtgttagttttctgagcagcattgtttgtaaaagtacaaaaaaaaaaatgaaaagaagcaacacaaacaatctatatattcatcaagaggaggatagataaattgtggtatagtcatataaaggaatactatcaagtagtgaaataaaatcaattagaattattaggctgaaccatatgaaattgccattcttctagatcagaaacaaccaaatattggcaatttcatacagtttaaatatatgtatcagtaacataatgctgagcaaataatatatataatatgatatgatttatataatgttaaaatacacataagagtcttttatgttgcttataaattaatatgtatattgtacaaatatacagatgcatgggggtgatgagaagtttagagtagtagttgcctgggatgggattgggtcttggggggacaggggggaacatgccaatggggaggaattacaggggcttcaaatgcatcagtcatgttttatatcttcaactgagtgctagatgtggggatattctcttttctctttaatcctttttgcgtctcagtgctgattaatggaatttagccaccagattgggtgattttttggcttgttgaatagttggccaggtttgcagggaagctttgccctcttgggcagagtatgtttttccaatctagtaactgtctgtttttggtggtgatttctgtggctgtaattaatatgatcagtgttgccaaagcaaggataaggggtattgactcactttttattgccctgagccatccctgttgcaaaataatgatctggatataatctccagaccaggaagcaagctgcagatgggaaactcccttatgacacttctgaagatcccaaacagtttctttttttaatgtaatttgattttttatttatttagttttgagatggagtctcgctctgttgcccaggctggagtgcagtggcacgatctcggctcactgcaagctccacctcctgggttcatgccattctcctgcctcagcctcccgagtagctgggactacaggtgcctgccaccatgcccggctgttttttttttgtatttttagtagagacagggtttcactgtgttagccaggatggtgttgatctcctgaccttgtgatccgcccgtctcggtctcccaaagtgctgggattacaggtgtgagccaccgcgcccggcccccaaaccggtttctaacaaataagtgttaagtcaaggggttcctctacagaatcagtcatcttcaccatgacacccacaacgcccaaattgctgctggcattcctccactctgaatgcacaattagaagctcagcactctattggataaggctgctatttcaccatttgaagaaccttcaaaaaggtctttagagacagggcatggtggctcacacctgtaatcccagcactttggaaggccaaggcaggcatatcacttgaggccaggagtatgagaccagcctggccaacatggtgaaaccctgtctgtactaaaaatgcaaaaattagccgggtgtggtgatgtacacctgtagtcccagctactcagtggccgaggcacaagaattgctcgaacctgagaggtggaggttgcagtaagctgagatcgtgccagtgacactacattccaacctaggtgacacagcgagactccctctaaaaaaaaaattccttagaaacttcagaaggatccttccactagggcagaagggatgagagagtaagaatcttcacccctaccactcatgcctttctgaaggctcagtctggccacactgcaagggcacagtgagccagttttggcctggggcttcttgctgctgccaaattaacaactccagcccttgggtttagccacctgctgctgctaaaaatgttgctgagagtgatggagaggtgttttagttcccattttacagatcagaaaatcaaggcccagagaaactaagtagtcttggagataggagccatggcctctccacttgagttatcatcttgaaacatcaaggacaagccaactttatcaacagttttaggcctgtgagaaatgggcttggtttatcttgaagattgtaaacaaataaaaaaatagactgctccattactgatgagaaatatgagtcattctgccaggaattgaaagtacagctgcccataaaaaagctatgccggggtccagcctctccaggtccttgtgtgtgaaaaaccactcagtcaaagttccccttttatttctctttgtgctcagtaggatgctgaaatttctggaaaagacaatggaaatcaggggcaggaagagaacagtgtggggtgctaaacagatctcagcaacctccctgcccacggccatctctgcgcagacacctcgaccccccatgcgcaggtggagcagcgtttcctagttctttccagaggcttccttctgcctgccttccagccacatcgcctgagattgacaacgccctacagcaagacggaaacctccctttacagcaccaccttgcgattctgcagccacaaagttgagacttctgaacgtggcactcttctgttcccttactgtttcacgtgtacctgtgtcatctttcttgtttcatcgtaaacatacttctaaaattcccattttctttatttagaaatagaactacaagcggatggttaaacaatttaaacaaatggtccatggggaaaagtgaatttcacactgtcccccaaactttcagtg

SEQ ID NO: 90 - DNA, 21780 bp, Homo sapiens
acatctcccggcggcgggccgcggaagcagtgcagacgcggctcctagcggatgggtgctattgtgaggcggttgtagaaggtatgaggaggctgtgcggtgactgccgccctcgctccgggccgtcagccctgcccccgctccctgcgttctcccaggccctgcgcccgcccgggtacctgcccggtctggaaggcggagtgtttgttttgccacctcgcccgggcgggggcgagcagtgaagcccgcggagcgagagacttggcccggaggcgggagcctgggccggggccggggaagccaggcagcgggttaaggcttttgatttagggagagggacctgggggtaacctaaggaaaggcctcaggtcatcggaggggagacctggcccgggggcgggaggctgggctgggaccggggaggccgggcagcgcgaggccgggccggggaggccaggcagcgggaggcctggccaggggaaccgagcccggggccgggaggtcgggcacggggcaccgagctccgagggcgggagacctggcggccggccgagtgccggaaggccgggtcaggcggcggaaggcagcggcaagctgggaaacggacggcgctaccgccggcggaggagtggccccgggaagcggtgctgcgagggctggggcggccgggtgctgactgtgagatactcgccctgggggctgatccttccaattttggacgaggcttccgtctctgctgccttccatgcctggggcctggattatcccgggttgacaatgtggtttagctcttccagagagatagttgcagggtttaaactccaattccttttcggccctgcagagtttcgtgagtgctcgcagctcatacctgtggctgtgtatccgtggccacagctggttggcgtcgccttgaaatcccaggccgtgaggagttagcgagccctgctcacactcggcgctctggttttcggtgggtgtgccctgcacctgcctcttcccccattctcagtaagtggcacccaagcaggaaaccggaaaacatcgttcgcagccccctctcgcccacccacttcttttcctgcttagtcgccaagccttgtcgaccttgtaaatgtctgccagatctgtccgcgtctctctatctctgatttcagccgtctgaccacagcagcctcttccctggtctctccacttccagacccgcctgctcctttgcagtccactttttacagcacaggcagagggatctttatgaaatgaaagtctagaaagctcgtcctttgcccttaggttaaacccagcacttaatatggctaacaaacccctgcgtgtgttgggtcctgagtgcccccacccctccttatctttagcaccggttcgatttctgcacggcaatgctgaccttcatacctagtgtctgcctgcaacacctctgcactccctttctcccgccatcacatttgattagaagagctgctacttaaatttctgttttcattaaacagtttaaggttaaatcttcctatgctgtgttctttctgcagccagcattccctaagagagatgtgtcatatcctttgcagttgcttgtttactatcttccctgctagatttgcaagcaaactccaggagggacggacttggtttatcttggtatccttagtgtcttgccccaaatgcggggcctggcataacacagtgaatgcccatccattgtatttttacttttatgccctatctagaaaaagtagacctggtttaggattattcagcaaataataattagaaaagaaatggtagaggtgacatacggagtcactgaaacgatgtaaacctgcaagatagctgaaagagggccaggcaaggtggttagaccagactgtatcaaaatgggctcagccactgtgaatgtgcgtgctgtggttacataatctctaaaaatgaaatataaagcttaaatcatctctatcacagcccgatgcttggactttggttttgctttgcctttttgcaaaagaaggtttttgaaagtgaaaattattttagtgaatggatgaacagtttattggagtatggcaataaaacctgttcaaagtaagagacattagacattgtacctagttaaatcagatttgcttttgctatcctgaataaaggccttgcctcttgccatttgaagagactggcatctgatataggcaattataatgcttctttactgttttgttttcaaacctcgtttaacacaatctcctactgcttcatccccctacaaagcagtctttattttgatgaatgatatattacattgcttctggtgcctactattagatctttaagctctgccccaaagataagaagcactggtgtttgggcctaaacaaagatgggagaattcttagatttatataatattctttctctgcatgttttgttcttaccttcacatgttgcctgtagagcttctttgcattacaataatgaaatcaagctacctgatatgtattggacacggtctggcatctgccttgttgagccacttttgaataccagtgagcatcggtataagccctgaatagagatagggtttgtctcttccactgcttgatacactcagggtctagtatagtactctgcacacagttggtgttcagtaaattgttatggtgcaaatatcaaatgaataaatgctactgaatctgagttttggcagtttcagtcttcctgacagcaggatttcttcaagcggttttaaacttgaatctgattctgcaaagtagtcatccttggtgggagtgctgaggctttaaagtcatctgtaatttttataaaaaggcatccgagatcctccattttacacttatatcatacaaatcatttagatctgtgaaggctttcccattttctccttttgtccttccaaaaacaccatcttaggacttcacctggcacagggaagacagatcgtttgcacatactaagtgcccttctttctaacttgtgtcataaactcagaggctttgaatagtggagagtgctctgtactgtcttcctggtcacgtggcccttgccagaggaaaggaaaggatggtttgtttgtatagtacaatggaacttatttcaatgtattctgtatttgattttacattcctgttctcatatttttaccttaattacataacaaatattaaaagattgacttcaccaggcccagttacaatcgccagtttgataattcttatacgtactcaaatgaattcagagaccagatgggaaaagattttgataaaacctctggtacatcacaactgaagtcttttcttgtccaaactattgtgaaacagatgttctttctgtttcatttgctaaatctggaaacgtgactgcttttgagactttgtcctctctgacaggtaataaatataatcctgatatttttcaagttgtttgacagaagtgtaatctccccagaagtcctgctggacaggcttcacttttcctttggaggaacacagagatacagggaatatgttttaatgacatatacctaacgctgaacatgaaaccagttattttacttttattattattatttttagaaacagccttgctgtgtcacccaagctcaagtgcagtggtgcgatcatagctcactgcagcctccaattcctatgctcaagtaatcctcttgcctcagcctcctgagtagctgggactacaggtgtgtgccaccatgccaggctacttgtttttactttgttatagagatggggtctctctgtgttgcccagactggtcttgaacacatgatctcaaccattcctcccaccttggcctcccaaagtgctgggattacaggcgcgagccactgtgtctggcctatttcactttagaagtaaattgaatgccacatgcgaagtttgttaaatttttttaaaaaaggaaagaaaacacaaaagtaaactacctagtcgcatcagaaatgccatagtcatttttgccattttttcattcattagaattcagtgcattatgttattttgttatctctgcagtaactttctatcatgttatttattttctttgtcttatttaaagcttctgagattatggatttttgtttccttccctgaagttaagtgttatcattcctatatagtactaagctgtctacagaatagtgggagtctgccctcttgagttgggaagatcctagtttgaatcttggctgtgcgactttaaagttcattaacttctcttagcctcagtcacctgaactctgcagtggggatccttatgcctcagagtgtcattgggaggactcacgaaaatacgcttgtactttgagttcagtacctagcctgtatgagccagcattaagagggacagtcatcacgcagcgctttgcacacagctctcacgccacatcctttggctactgttttggtaaatctttactagtaaatgtttcttaaaagcatttacattcatggacatgattcagaaactaacagttgttttttaggtctcactttgagatttaaaaacccttagggcagagaccagattttatttcttacctcagagtttccctgtaggacaggaaccagcaacagcctaatgagctgattaagaattttagagatttaaaatttaaattaggattgccagttttagagactggcacataaatgttttcatttaaggcagtgactgtttcctttaggatatgattttttatctttctaagatgagatcaccatcctcagaataatttgtaccccgctgggcactagctaatggaggtgatgtcatgctaagcagcacttcagtgagttttgcgggaaccaaagctctgctcccaggagtgtggatttggtgctttcatgtggaaaaagcggatgatgacaagtagagagcaaatgtgcgcatgtctgatgctgtaaggatttcctttaccatcatataaatttttaaagtatatcaaaataaactgataactgagaaaatatatgttgttcagatactaataatgaagttaatgaagtccactatagtatttgtccctgagaaatctttatcaaatattttaaatcctattgtaaaataatgtattttttctttcagttttagagactggcaatcctaatttaacatctccttttgaattccccaccacaggcacactttcacacattcactctttaataacaggttgtttcaaattgttaatactttatagcttaatatagaaatttcactttagaaattaatttttatttctctgccttaatgctatagatgttgtagtctgctttacttcagtattgtaatgagtagttggctaaccaccatgtaaatagggagaacattctagttttttacttgtgtaggaaaacacagcttgaaatgtctaagtatctattttagagtgaagtaaatttatactgacaatatttttttgtgtttgaagacctgactgttacagcgttggtggcaagtgttaagggatccaggaactagacaagtgattctgagacctgagttccaggtttctaagtaatatcagttggtctactgagaactttgccataaacatatgtgttcagaaatttcctttcttagcagcagcatcctgaattgaacagaattacacacacatcagcccagtaagaaacaattcatgttaagtccattgctatgccaggataaatcttttaaatcacaattatttttcctatttatattttgtcaaataagaatgttctaaaaaccaaaatttctgttttcttttttttttttttttttttttgagacggagtctcactctgtcgcccaggctggagtgcagtggcgcgatctcggctcacggcaagctccacctcccgggttcacgccattctcctgcctcagcctcctgagtagctgggactacaggcacccaccaccacgcctggctaattttttatatttttagtagagacggggtttcaccgtgttagccaggatggtcttgatctcccgaacttgtgatccgcccgcctcggcctcccaaagtgctgggattacaggcaaaatttctgttttcatttaaggcagtgactatttcccttaggatgtgatttttttatccttctaagatgagatcaccatcctcagaataatttgtaccctgctgggcactagctaatggaggtgatgtcatgctaagcagcacttcagtgagttttgcgggaaccaaagctctgctcccaggagtgtggatttggtgctttcatgtggaaaaagcggatgatgacaagtagagagcaaatgtgcgcatgtctgatgctgtaaggatttcatctaccatcatataaatttttagaagtatatcaaaataaactgataactgaggcaatgtatgttgttcagatactaataatgaagttaatgaagtccactatagtatttgtatagtatttgtatattacagtactctgaaaagctggtcactatttaaagtttccattaccagtcacaaggagagaataattttatcccacaattttattgctggcaaaagacacaagtttattaaaagtcagtatttcagtgtaagagttactagactgtttgcagaagtgttcaaaagagatctttaggtccttggttgtctgtggaagctgatcagcatttaggggttcctgagcacagactgtgaaccctgcatttggcacatgcattcagagagccaatttgaggcagactgggggctagaaaggatactgccaggagctccaggttcagcttccgaagttattaagtcttatttcccagtttttaaattagacttcattttttagagcagttttaggttcaaaccaaaattgagaagaacgtacagagacatcctgtatcccacctgccccccaacacgtgcgtagtctcccccattatcaacatcctgcaccagagtagtacattcttacaaaggaacctacactgacacgtcatcatcacccaaacgccatcgttcacaatcaagttcactcttggtgctgtttatcctatggttttggacaaatttacaaggacttgtatccaccattatattgtcacactgagtagtttcactgccttaaaaagtctccgtgcgggccgggcacggtggctcacgcctgtaatcccagcactttgggaggccaaggcgggcagatcacgaggttaggagttcgagaccagcctggccaacatggtgaaaccccgtctctactaaaaatacaaaaattagcctggcatggtggcatgcgcctgtaatcccagctactcaggaggctgaggcaggagaatcgcttgaaacctaaaggcggaggttgcagtgagccgagaccacgccactgcactccagcctgagcaaggagcgaaattccatctcaaaacaaaaaaaaaaaaaaaaaaaaattctctgtgctgtctccctccctcctagccactggcaaccactgatctttttactgtctccatagttttgccttttccagattgtcagatagttggaatcatgcggtatatatggccttttcaaactggcttctttcacttagtaataatgcatttaaagtgttcatggcttgctagctcatttctttttagtgctcagtaatattctgttctctggatataccacggtttatttattcattcaccgactgaaggacatcttagttgcttctagttttgacagttatgaataaaactgctataaacatctgtgtgcaggcttttgtgtgaacataagttttcaactcctttgggtaaataccaaagagtgcgtatttaccatatggctggatcatatggtaagagtatgtttagttttgtaggaaactgccaaactgtctttcgagttggctgtaccattttgcatttccacgagcagtgattgagaatccctgttgctccacatcctcaccagcatttggtgttgatggtgttctggttttggccattctgctaggtatgtaatgatacctcattgttgctttaattagcatttcccattatttgcagtctgtgtatctttgatgaggcccactggattttcactttagattttctatagattggccataaagtcttgaaacaaagatattttctcatggattataatgcaatatcagtaaactattatgtgttcacctacgtttccagacttgttagctaccctgtactgttctctcagttaatcaagttaaccacaatttgtttctcaaccacaggtggctaatgattttgtatgtggtctgtccgctttgaattgatgtgcatggggcaagttggtctctatgatattcatggttcaaggaagttcgagatttcctggtacctaatacatgtttattgtacatatgaaagaaaaaagggcagatagaggggaacatggtactgagcatgatagaggcaaggaagggtggctactttgataggagaatacccctatttttgtcactcttgaaacagggccaagagttgaaattggctagaacaatcctgacctttgttgatattattttatagaataatatttgttactgttttctcacttttaaaaaatgcagatgttatagaaaaattagaagatatagaggaatgttaaggagtaaataaggtgtcagtaatgccatcacccagacagccactgttaataaatatgttaatatgtgaagacatactaatatgtaatatgtactgagtgactaatggcaggtcacttagtagctgtctcgattatcagatcaactgtcatggtatggcagtgtttatgttcaggtacccgtattagttattgttgttaatccctttctgcgcccaagttataaactaaactttttcataggtatgtacgtataggaaaaaatatgctgcatataggctcagtactgtatttggtttcaagcatctactgggggacttgggaggtaccccctgcccctgccccacaggtatactactgtataattattcttctatctaaagtaagatctaatggaagataggaactttgtcttgtcttccactctgtcctatttcccaggatgatacctggcacaaagtatttgtttactgacaaactaaaagatgatttatcccaattatactcacatcttcccttgattttccagaaagcctacaggaagtaagatggtagaaaagcaaagtcttcgtagaaatgcagagcatagactggctcttggagaaggtcaaacatcaccctctcctgtggttaaattgagatggtggcactggctgtcttctatattattgctgcacctttcctcaccaggggtgcacacaaaactgggagagaggggaggaaggagcttagctttgtcttaatagaagggaagaaatgatgttttccaagagaccttgaaattggggaccttggtaaaggtttcagtttgggaagataaaaaagtcctgggatggattccaacagtgtaactgtactcaatgccactgagctgtacgcttaagagtggtaaattttatgtctatttcaccacagttttaaagattaaaatttttaaaagtgggggaagttacctaggactttctagaaggacttttgagggtgagcaagttctgttataggcttgtgtattattttggtatttctgattttatcataggagtgaggttaaagttgtattttgactggaatttttgacattgtcagggtttctagagtgtggagaaggtcactcagtattttttgtttttgttttttgttttgcctttgttcttgttttcctctatttagggaggtggattgccatgggaagtacctttgcttcgaaaagccagaaaatgcctggtagaactccagaaaagtagtaaggagctggcttcttcagaggcagcatagcagagtgggaagagggccctgtcacttagattgtgactgtcgacaaagtcacttaaccaccagaagttgggttttctgacgtttagaattttgaaaagattaaaactgagtgccttgcaaagtacctggtatatattaagtgctcaataagtgatagttgctttgattctaagaactggttcaccttgtgagatataattgtgtaatggaagaatgaaagcagaaactttagtttctacttttacatttcctgggccattttactaccctaaatgagaagctgggcttccaaaacccactttaaaagtaaagactaggccgggtgcggtggctcttgcctgtaatcccagcactttaggaggcctaggtgggcagatcacttgaactcaggagtttgagaccagcctgggcaatacagcgagaccgtatgtctacaaaaaatacaaaaattagccagacatggtggtgcatgcctgtaatcccagctactcgggaggctgaggcgggagaatttgagtccaggagatcgaagctgcagtgagccgtgattgcgccgctgccctccagcctgggtgacagagtgagaccctgcctcaaaagaaaaaaaaaaaaagaataaagattaatggagatttggaacatcttgatactgtatcttgggaatctaagcattgtagaattgtgttatgtgagttataccattgtggtgggaagtttttgatttttgttttaactgtgttgagttgcagttcttagaaatgacccgaggtgttgtcttacaaaagaaataaactgtaatctgtatcttgatctgatgagggtatgtaaatataaaaaatcgagctgtatactttctatatgctttatgtagttcactatatataattcatagctcaattaaaaagagagagagaggctaaattgtatgtaccattgcaaagaaatcattatccccagaactgactcacatacacctttaacagtagagggagaactgaggtattaatttggaaaaataatcactgggataattaatataatgcagtggttttatgactgattttttattaacttctattttctttgtattctagttaataaaggtatccatggagaacactgaaaactcagtggattcaaaatccattaaaaatttggaaccgtgagtatttaaattgaattctttataatcagagaaagatggggatgtgtaataagcaaacctcgagcagtggggcaagaggaaagagagtggtctctctctcaggccagagagaccaagtgacttcctacctcagacagctgtgtggctttgcataaactgacttttcttctctgaacctcgtctttaacatggggctaaaactttcacagaactgaagggaagatgaaaggaaaggcctagtagggtgtgtgacccatagttggaaacctagtcctggaaccaaaaggacaccacaggagaggcaggactcccaagcgccggtgctttctaccctcccgaatcgctctataggattagagggtttaggtttgggaggagtttcttgacctcttgtttatgagtttttacgactaaaatgcaatgccagttttcagtccggggacaaactgcctagttatggatgaattttaccctttttttccccgtgtctttttggaatattctgcttattaatgcttccaataactagcagatggaaaaaggaaaaagataaaactcaaattcactttttaattcttgtctgttattatttatttgggatctctcgtaatactttaaattctgaaagtttatttctgaaacccagtattgttattctcggctgccctgaatattacaaactaattttattactaaacaatatgattacagaaatactattaacaagttaccactaaagatttcacaattttgtttagcaaagggatttttctagaaagtaaacttttaaaatgcagtcccattttagagagttgttgctgtcatttaaatcattttagccagtgcagtggcttgctcctgtaatcccagctacgtgggagctgtggcaggaggatcacttgaggtggagagtttgaaaccagcctgggcaacataacgagaccctgtctctacaaaaaaacaaaaaacaattagtccaccatagtgtgtgtgcttgtagtcagtcctagctacacgccagaggttacagtgaagtaagaccccatctcttcaaaaaaatcctttgaaagtgatttacacattttcctactattttttttttctttcttttttgagacaggctggagtgcagtgatctgattatggctcactgcactcctgggctccagtaatcctcctgagtagctaggactacagacatgtgccaccatgcctggttatttttgttttttatttttgtagagatgggggtcttgctgtgttgcccaggctggtctccaatgcctggcctcaagggatcctcctgcctcggcctcccaaagtgctgggagtacaggtgtgaaccaccctgcctggccctaccttttcatgtcatgcagaacaccacttcaataacaagttgcacggaagccccagacaggtttagggttgtttcgatcctttggtaagttgccctcacagtcccggctttcacagcctctgccttttattaggagtatcccctcgtggactagctatcatatgcttgtaaagtacctacctccttaggaggcacccagagcacgtggggaaggggtgtcgggagctgggagtcataagtcccatgatccatcatctgtaggactcaaaggtcaagtcacgctttcaggatttaacttcagtctgtaaatgtgaggctgttcacctctggttaaaaatcataactgttttctcacgttgactcctttaatttactacatttaatctttttccaacagtatttttggaattgtgtataatgtgagatgctcttaaggttaagtgcatgagtatatggactgtaggtgttagtgtttggtagttcctagacctgtttttgcctgactcttggtctagatcagggatcaagcttaaggcctgtttttatcaactttcgttggaatataggcacatccattcgcttacatattgtcctaagcccgtttcaccagtataattgagcagctatggctgggcacagtggctcacaactgtaatcccagcacttttggaggccaaggcaggaggatcacttgaggccaggagttcaagactagcctgggcaacatagcgagatcctgtctctaaaaaagaaaatacagaaattagctgggcatggtggggcatgcctgtctgtagtcctagctactcagaaggctgaggaaggagtatcactggagcccaagagttcaaagttgcagtgagctatgatggcaccactgcactccagcttgggtgacagagccagaccatgtctcaaaaaaaaaaaaaaaagaatagaattgagtagctgtaacagaaaccagatggcccacaagcctaaaacacttaatatttagcccattaaaaaaaaagtttactgaccccaatctagatagcagaggtttttttagataagtgacttccagacagatattttcaattatttacaataatgcttttatatattaataaattactaatttgtttagctcatggggtttaaggaataatttatgaattgtgataaatattgtgctttgagttatatttgcattttgttgatttcccatcatttcagggtaatttttaagatttttactcttacctcaaaggataaaatatttcacaaagttaataagtaatttttaaattataaaggtatttgatgaaattttgaagaatttagaggaaaatgtaaaacatggaagttaaaagcctgaactctgaagtccaacagatgctttccttccttcttggctgtgacacaatatttgcataacctttagcacattacttagcctcacgtcaggtcattttctcatctgtataactgttgatgtgaaattgaaatgaagacagcctggtttataacattcaacaagtgttaactgttactgtgagttataaaaattgcactaatataaacagaaggcgtggtcatttctacctttgtaaagctattatttgatttctaaacagaaagatcatacatggaagcgaatcaatggactctggaatatccctggacaacagttataaaatggattatcctgagatgggtttatgtataataattaataataagaattttcataaaagcactggtatgtgtcttacataatttttaatccttttcaaatgtttgtgccatttacatttgatataatattaaaagcagtattattgaggtattagacagtaaaccgtgacacagactagctgtgaagtagagattgggcaggacctacaggtcctctgatacactgtgaacgcgtcactcttctgcccaacttcatagcctcctcttgctggcctcctatctgtatgcttggttgcctctgccctgacttctctgtagcccttgcttctttttcttctttctgcttcctctttgatcccaatggaaggttctcaaaaaaacagttaagtggtagtatttattttttccccagaaactgcaagagatatcacaagcattgccttatttaatttatgacaacctggaaagtaacgatgagattctgaaaggttaaagacctcgcgcagtcacacagtatggcggcagagctaggtctgtgtggctccaaagcccaagctctgaatccatcttctgttctgcttcacttccttgtatcctcatgtgctctgttgcctgtcttcccttaccctacgaagctccccatcttagagagacctttcttttactctgttccttttgattcctttgatattttgtctccttcccttcttccttaaattttgaatacatgtagtttaagcttgtactcttcatttgtttccattccttcttgagtctttttccattttctgtctctactactaaaactgcttgctttaaatttaccatggccttgccaccagatccccctctcgatttctgtactatgtacaacttgaatgtagtactacatttgagaatgtttttttagaaatatagataataaaatccttcacagtgccaaaaaagctaattaatatttggtgtattgttattttttcttggcagttctttttaaagcttgattttattcataacgtataagcaatgttgtcttctgcttgtttcacttaaaggaatagcatttttcatattgctgcataattttcatatctgttataatgattatataatactgcatccccaaaactaccattcacttaatttgaataatttactgtatgaatgaacattatggctgtttcccttttaaattgatgctatgataattctttgaattggcctattaatcatattagagttaatttttaattagagaagctgtagtagatctaaggtgggccagtacctatcagagtggtggtggaaatggaaggaagccagattacactgggaagatagcagggtttgtgtcagattaattataaggagtgagaagagaatagttgaaaatggagctctaaatggcatcagttttattgcttttggctataagttgagatgccaccttcaaccattaacttaaaaacacaacaccttgtttacttttgctttacgcatatttgaaaatttacttctagatattctgcctcacatttctagttaggatacctccttcctatagaattttgcactgttggctctattgtttcaaaaaccaaaaacaagcatattattccactaccaccagcacctccccccacatatttagaccagcagtctgggttttgcccagtgagctcctttcctactttgcaatgtaaaggtcaggttctcatgagatctctggcaggctggtgttgggccaggcgccatggctcacacatgtaatcccaacactttgggaggccaaggcaggaggatccttgagcaccaaagttcaagatcagtctgggcaacacagggaaatcccatctctacaaaacagaaaaaaggtagcagggtgtggtggtgcgcacctgtagtcccagctactcgggaggctgaggtgggaagatagcttgaatctgggaggttgaggctgcagtgagctgtggttgctgtactctagcctgggccacagagcaagatcctgtctaaaaaataaaaataaataaaaattaaaaggcagccaacacatcagcaccagaagccagtgaccttgtcacacagctgagataatcaacaacattttggagatacatgtagactttctgtatttaatcttcatacccatcaaatttactcaattctgagggatgtttcccaccaagatttagcattttgaaatctgagtgcatcatgcagtcaatctgtacgttaatgtggaaggttctctaaaggagtggtagaaagcccaggagccctggatacaggcccagcatagctttgtcactttggactggtttgttaactctgctacatgtcccacatctgcacaagtgaaactagtaataatatgactctcatggtgattggaaggattagagattagccatagcagaatacctgatgaacagtaataatgtttgggggttttccttgaaggcactataaatgttgtaatgctatcttaaaattgttgggaagttagagtcagagaaacgcatttcctctgagtgtgacagatgtgtgtatgtattataggatcgtattgttttctagtcttatttttttaaactgatgattttcccatggcaacattttatctgtgaaaatgacaacatagtatatcccattatataagttagtatagcttgtctaaccaaacccttattgttagacatttgtgtttttcactacctaaaccgctgtgaaagacatcattttggctataacactgatgagcttatattatgaagtatcttataagctacaaaattgaagaaattttgttcaccatgttcaaaatagttagaattctcttaccatttaaaaggaagaatttattgtggacttctgaattgctgagtagttaatttcatttcaaagtagttattctttgttttccatacaattaaaagtaattctttctgttccaaggaatgacatctcggtctggtacagatgtcgatgcagcaaacctcagggaaacattcagaaacttgaaatatgaagtcaggaataaaaatgatcttacacgtgaagaaattgtggaattgatgcgtgatggtaagaagaaacaattagaatgaacttcattgtacaattaattttatactatggtctagcaataattatatgtataataaaatatgagaattgtggaattatactgtacataaccctaatcttacatactttagtaagaagtttaaaaaaagttatttatgccaacttcctaaaatggtttgagatgtgttgccgtgccccaggttaggttaagatgacctcttagttttagtctcagtttcttcatcatgttcccatacagtatatctgaagttgttgaataaagtcatggattttttttccttttatttgcaaatgtctttacagtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggtaatgtctaactgagtgatttggttattgacgattaagcaggggttactattctcaactgtaaattatccaaaggataatttttttcctgaagctaatgaactattgttacttttcatttatttaccacttaaaagatatagagtaaattttaattttatacttatatcaaaaagactcagcataattaacatccttttttttttttttttttttttttttagacagagtcttgctctgtcgcccaggctggagtacagtggcgcgatctccgctcactgcaagctctgcctcctgggttcacgccattctcctgcctcagcctcctgagtagctgggactacaggcgcctgccaccaggcccagctaatttttaaatttttttttaatagagacagggtttcaccatgttagccaggatggtctcgatctcctgacctcaagtcatccgcccgccttggcctcccaaattgctgggattaaaggcgtgagccaccgcgcccggccaattaacatccatttttacatagcatttcaattttttagaactaagttatgtgttcacacacaaatttttataaataaatatttattttctaacacccaggcctgccgtggtacagaactggactgtggcattgagacagacagtggtgttgatgatgacatggcgtgtcataaaataccagtggaggccgacttcttgtatgcatactccacagcacctggtgagaacgttacacataatgaatgttacatgtggattttaaatgaattaactgtgactgatcatagaattatacaatgaaaagtgtgtttcagagactgtcaagattttgatatccctaaagatatcaaaacttgtctatattttagggaaccttcatcaaagagaagtctcaaaaagttgtctttagccaaaagtttggctagaaaatatgcatatatagccaggcacagtgactcacgcctgtaatcctagcgctttgggaggccgaggcaggtggatcacttgaggtcaggagttcaaaaccagcctggccaacctcatctctactaaaaatacagaaaaattagctgggcatggtggcacacgcctgtaatcccagctactggggaggctgaggcaggagaatcgcttgaacctgggaagcaaaggttgcagtgagccaagatcgcaccactgcacttcagcctgggcgacagagtgagactccgtctcaaaggaaaaaaagaaaagaaaatatgcatatgtagagtagactagcacgatgtcattcattggactttatcaggtagatctccgctactaatatcaggtagaatattacgtggcaacagaggccaagtcagagcttcccctgcatcttagagaagaagagaggtacgtttctcaggagttatttgaaaggtagtaaataaaaaagataaacatgactagtatacaagaggatagatgtggagtgggagaaaagaaggtaaaaaacgatacatgaatgtgccgttaacctccacgtttttactgttctgctgcacacgtcatcatctaaataaacatttgtggattataccaccatttactcacacagctaagggtgtcggagagtttggaaactttaggtaaatgtattcttaagcagtgttgcattttaaaatatgctcaatatggtttatcttatcctctaggcatctttccaagcaaagtacctctaagttaaaagcaatgggtctaatagttaacctagaaaaaaaagtatgataaatatactattttccctttttggaccaatacttggtagtgtgtttattatactttattcagatgctctgtagacaagtaggacactcaaagcaatttgtttcttggctaagtcagtattaaaataaggtgaaatctgattggaacactgtgctacttacaatgatcctttttatacatctttacttttgcatcttaccttctgcgtgtttgctcttcttgcctattgaaaggggagtccagaaagtaaaactttcaataattcagtgttcgtgaagctggtccccggccagctttgctgaaagcagggggtgtacgcatagcacacattcgtccttcagcatcatttcttctgaaaccaaaggtgtctttttttttttatttgtatgactaataagacttatgtaagtttatgcttatttttgcctttatgactacataataatttatagaatcaactaaaatcagctatccatggtattttgcttgtattttgccttttaggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatta

SEQ ID NO: 91 - DNA, 14845 bp, Homo sapiens
ccgagggcggggccgggcccgggagcctgtggcttcaggaagaggagggcaaggtgtctggctgcgcgtttggctgcaatgagctcggcctcggggctccgcagggggcacccggcaggtaggcagggggcgtcgactgggcaccgagcaggtctgcgtcttgctccggctggaggggaaacgagggttagtggaccgggcgcgcggaccggagtggggccgcgggttccttcggctttgcagggcggcctggagaagttgcactcttggattgaagcgctcagggcgggtggggacggtttcgcgcttcagtctaagaaacactcggggacctggctgccgcctcctggcggtcccgagtagcgacgccggcgccggggcgtgcccctgccgcctttgtcctccggggcgatgagcgctttcggggcgccccggctgtttaaaccttaaaaggctgtccccacgcgggcctggcgttcccccacacctggccgtttgaaatgttgggggttggatcttttgtttgctcacttcgaaaagtgaaaaggaggggttgttccgccgagtcataatgaaaacataacaggcccgcggggtgcccgggccaagaccctgggtcctcccgggcttcagctggaggcggccagttcctggcggccagcacaccccggtatctctcttcttcatccaggaaacctgctgctgtctgtcggtttgagccaaaaccacaataacttttttctgcaaagtaatcaactgctaagagcgtacgttctgtcacttattactggtaaagtttagaaacttcaagcctggccagagtgaaacaaacaaaaaggtcgaaacgcctgcagttggccggccgtggtggctcacgccttgtaatcccaacactttgggaggccgaggcgggcggatcaccagaggtcgggagttctcgaccagcctaactaacacggtgaaaccccgtctctactaaaaatacaaaaaaattagccaggcctgggcgcaagctactggggaggctgagacaagagaatcgtttgaaccctggaggtggaggttgcagtgagccgagatcgccccactgcactccaacctcggcgacagagtgagacttcgaatcaagaagaaaaaaaaaaaaaaagaacgaaacgcctgcagttggttagagtgcctttgtttaagaactctttatattttgctgcacaaaggaaatggtgctccagaggcaagctgtaaaagtcacatggtcgtagaggaggtagataggtagccttgtcctggaggcacagtgcagggtccagttgcagtctctaggggcgggaagccggggctttccttcactcacctgctcccttcctcttcttcctccaccgcactccccagtgcatgttctaggcctgatggaggttactctacatagggttactaaatacattgttgatggagccgatgggtagattttcatagagagtgcagtgaatgaagacgatgacagtagaatgaccgaagtcgtttgggaagttgaacaaagtttagaaaggtagccggtctcgggtgggaggggctgcgtggggatgggcctacagagactttggaatctgtaggtgggctggctttcaatcccagcttcactttgccgaccttggcacgcctggcccactttctctgtccctgttcctgagctgtggagctgtgagataaggtatctaaggcatcaggccatcaacaaatggtagctggcaggattatctggagggactatcaaattagagtgaggtgaaaaaaggaatgattagttttgtaaaacctaagctgatttaaggaataaggaggtggcagttacattatcctgcaaaggaagagaagtgaaaagagggccagacacagtggtgggcgcctctagtcccagctactggggagactgaggcaggagaatcgcttgaaacctggaggtggacttgcagtgagccaagattgcgccactgcactgcagcctgggcgacagagggaggctctgtctcaaaaaaaaaaagtgaaaagaggtcaagaatcaggtttaaagaagggcacatttttgataagtagattgcagatgaaaaggaatttctatatctgttatacagggtagctccttcattaaaatttattttctccatatcaataaagctatttcttactttatccaggtttttaaatattaacgcaggccgggcgtggtggctcatgcttgtaatcccagcacttccaggaggctgaggcaggtggatcacttgaggccaggagttcaagaccagccaggacaacatagcaaaaccctgtctctactgaaaatacaaaaaaaaagtagctgggtgtggtggcgcatgcctgtaatcccagctactcaggaggctgaggcgggagaatcgcttgaacccggaggcggaggttgtggtgagccgagaccacgccactgcactccagcctaggcaacagagcaagactccatcccaaaaagatagtaataaaaaataaatattaatgcggcataatgatacttaagtgcccccttctggaaagcttgtcttcttgggatacacagctcaaggtggtcatgatgtgttattttctctcaatctgtgggtaaagtttatcaactccagaaaagtattggaacttaggtcctggcatctgtctccatagctttttgttctgattcagtgtttgctagagtggccactggacctggtcattaactggtactgcaggatgcagggtgcactttgtgagagtgaaggtaagttacagctggccagcatcagaattgggatgtccagagcctaggtttttttctacatccgtagcattaacaaacaacaacaacaacaaaaaacttaaaaaaaaaatccctcactgaggttgccaaatctgttaactttgaaactgaatgtattaagagatggggtctagctctgttacccaggctggagtatggtgactattcacaggggcagtcatagcacactatgtcctagaactcttgggctcaagagatcctcctgccttggccttccaggtaaccgggactataggcttgccactatgcccggccagaacgtcattttaaacagattttcttgagcagctacttaatactagttagccattcctaaacctgtaggtcttgactaatgtgagggcatatttgagacaacccaaactcacatcttaagttattaattttaatgtgtcagctaacaactgggaagctacttctttggcaatatgagaaacaagagttttaaagacccaagcaagaatacatctccagtgttttcaccctgagggatatgagttagtttgctgagcagccatttggcacagcttccatgagttaggttgtgagccgccttcggctcagcagtcagtatggagcagaagccacaggaggtgagccgctggcctgctgccaccgaggaggacactgagacatgagtgctttccaagttgtgcagaattttggcatgtgaggaggatggttgtgacatatggatttaattttcttgaagttattgtttctttatactctaattggttaaaagataagcaggtgaggttatcaaaaggcagtagattccgacagcttttgaaaatgggaagagtgaaatccctgtgctgtcttcatagagcagtgtgtggagtaggaagtacctcgttactgtgctcacctagggcaaaggtcggattaaacagctttctcatctgccatgcagcggggaggaccagttggagaggttgcttttggctctcacaccttagtgtaaaaatcactttgtgaaaaatgcagctgtcacctccttcctccaagattctgattctgcctcagttaggatccaggaatctgcattttaacatgcacaccaggaattctgatgcccaaggttgagcaaaactgacttagggcgtacagacagaggatgccttagtgtggggtcttagttgggtctcattgcttggggcagttccaggaggaataggctaaaagggacttgaactgaattccccaccttgtattttttttgaggagaagtgaggttagatcaatcaggtgatgggggctagtaatggggagatctctaaggagaggggaaccaacccttttggctaggagatgatgggtaagagtccatgctttagggtcattcttcctcaactgaagggtgcatcttgctatactgctaatatttcagtttattcattgctgtctcccctctaagctgttgagctatcaggtaaaaacagatgcatgagtggatggggcctttattgtagaagatgccacactttgcactgtccagtgtagaagccactggccaattcatttaaattgacaataaaatcgagttcctcagttgcattagctgcatttaaatgctcagtagacacatgtggccagtggctaccttatgagacagtgcaaatacggaacaattccaccatcacagacacttccatgacatagcactgctctagagagtagagaggaattcagtggaaggctgtccagggagtagggagtccagttgagaatggagagcagagggctccccttacagggttggaaatgcagatgtgtcatgcaggagatccaaggtccaagtctttgcccttgcccttcccttcctccacccaaacttctacctcttccaggcttacaccactgctaatccagcattaaccacaaactatatttcagttttcctgtaggacttaattctttttcagaaaatgtgcaaaaacattttctgcataacaaagcaacttcatatttcaactccgtaatcacagaactgttactctaggcatattttgcagtgaatgcatttgtgtaatattttctccatttctgtttataagattgttattttgcaggtcaagttgggggtgagaaagcatagagctgttatagtttgtttattagtaagcagtttcccttcatttccttttcttcacatactttggcttttaaactaaccaaaacagaagggtcttaagagtttgggagtcagaagggggatgggagttcctactatattttactgccataagtaaaaaataattaacaaaaatcaactttttttaataggtggggaagaaaacatgacagaaacagatgccttctataaaaggtaaagctgtgctcttttctaataaaggtctcttcctttgatggtcatgatcagcctacagaaatcaaagcaagaatgggtcctgggagctaggaagtaaaactgagtaggccaagttttagcctttggggagctcatttgtagataggcaggttgtgctgcccctggttgtcgagggacccggagtgatgttcagaatgcatattaattggcatggcatgagcctagagctagaacttggttctgagcctcgtggttattcctggttgctggatcctgggggccaggggaaagacatcaaggcagagggttagggatgtgtcaggatggcacatggctgctctttaccaattggcagagagatatttcaggactttccttattagcatggcctttcctggagcacacccatggaacatcagcctggcaaggaggaagctcagatctctatctacatgttgacctagaacttggaggggctcattatttaatatgacttgaagtgattgtttttcaacttttcattaacagagaaatgtttgatccggcagaaaagtacaaaatggaccacaggaggagaggaattgctttaatcttcaatcatgagaggttcttttggcacttaacactgccagaaaggcggggcacctgcgcagatagagacaatcttacccgcaggtagtagttttatctacctatcaagatgaggcagttaagtgataaaattacttttggccaggtgtggtggttcatgctggtaatcccagcactttgggaagccaaggtgggaggatcacttaaggcaaggagtttgagacaagtctgggcaacagagtgagacctggtctctacaaaaaataaaaatcaattagctgggcatggtggcggtagtcccagctactctggaggctgaagggggaggattgcttgatcccaggagttcaaggctgcacggagctgtgatcatgccactgcactccaggctgggcaacagagtgagaccttgtctctaaaataaaaaataaaataatttttttccatgtttccaaatgaaaagttaaaaaaaattaaaaattaaaaaaattccagacttctagatgtagggaaaagttacttatcataacttgtcaacactaatgaggtaacaacagatcaagagtgttggagcatgggccttgctttgatgcagcctcccttaagaacttgcctgagttggccgggcatggtggctcactcctgtaatcccggcactttgggaggctgaggcgggtggatcataaggtcaggagattgagaccatcctggctaacatggtgaaaccctgtctctcctaaaaaatacaaaaaattagccgggcgtggtggtgggagcctgtagtcccagctactcgggaggctgaggcaggagaatggcatgaagccaggaggcggagcttgcagtgagccaagatcaagccactgcactccagcctgggcgacagagtgagcctctgtctcaaaaaaaaaaaaaaaaaaaaaacttgcctgagttattttccttactctgttctattaaatgttgacaggcttttgcatttgtactaacatttgcatagtagacaacaacactctaaattgaatcggctgtcattatgattaaatcctttccgaccatggtgaatgaagggaaaaccaccattgttatatttcatttcttttctcctaaagaaagcaaatttatgtgtcgttaaaatgtgtatagattcttccaaagtaagggtatttgacaactttgaaaagtttataggctaacatttcatttaatataccactaggttttcagatctaggatttgaagtgaaatgctttaatgatcttaaagcagaagaactactgctcaaaattcatgagggtaggtagttttgctatcatatagttcatcttcctctaatgaaaccgagtcctttatcctatctgtaaagacaggtacaagtaattacttgtgtgacaaaaaaagtattaatttagcacaggttacaggttttgggtatgctgctgtgtttccgttacccagcacatttagagacccttgcaaataattatgcctctaaagtttatatttagcataccactagttacagtctcttgtagaaatgaatgaaatgaccccttcaattggcagtaaaagcctaaaatgcaagtactacaggtgctgggcagtcaacaggctcattttctcattgactcctttcatgcctcattttctcactggtttccaaatagtgttggtttacatacattacctcctttaattctcacagcgtcaatagggggtaggtattctaattataacaacctatattataatcatcgctgcatgccaaccattatatttgcataattactttaaactttcttcagagctcttctttaaactgcacatcattctaactttggctgcttttaccagcttttctactttgctcagaagctttggaggacatcagtctcatggcaccgcacctggctttgagtactcttttggaagctctaagtgctataatcttttttttttttttttgagatggagtctcgctgtccgccccaggctggagtgcagtggtgtgatctcagctcactgcagcctccacctcctgggttcaagcaattctcctgcctcagcttcccaggtagctcgcccccatgcccagctaatttttgtatttttagtagagatggggtttcaccgtgttggccaggctggtcttgaacactggcctcaagtgatccacctgcctcggcctcccaaaatgctgggattccaggcgtgagccactgcgcctggccctaagtgctgtattcctatagtgaaagtgcagcaatgcgtggggagctgttgagcagcagtttctgggtctttccactctgctctaaggtctctgctgattcaaggaaatttttagtttattgccaaaataacttggatcttaagtgagattccctatcgtaatccctttatgttttccacatcattctgtgttttagaaaggctaatgaaatttggtcaaactctattactctgaactttaataaatttggatttttttaaaaaaataagatacagtacggtatattgtttgattaaagactaagttgtttcatcacagatattttacacttattaaagagtaggccgggcatggtggctcatgcctgtaatcccagcactttgggaggctgaggcgaggtggatcacctgaggtcaggagttcgagactagcctggctacatggcaaaaccccgtctctactaaaaatacaaaaattagctggatatggtttcaaatctgtaatcccagctacttgggaggctgaggcaggagaatcgcttgaacccgggaggtggaggttgcagtgagccaagatcgcgccactgcactccagccctgggcaccaagagtgaaactctgtctcaaaaaaacaaaaaagacaaaaccacaaattttcctcctccccaatcatgtggatgtaactttattcttgtgttaataaactgaatttttatgtgtagataacaagcatcatattttcatttctatattctcttttgggtcctttatagtgtcaactgttagccacgcagatgccgattgctttgtgtgtgtcttcctgagccatggcgaaggcaatcacatttatgcatatgatgctaaaatcgaaattcagacattaactggcttgttcaaaggagacaagtgtcacagcctggttggaaaacccaagatatttatcattcaggtaagactgagtacattatcatcttaattataaagtctgtcattctgaacatgtgataaaggtctaaaagccagttttgaaagtaactttctccagtaattggacaggccgtttttgaattctggccaatcatagttgcactttgagctgttagtaataattctttgacactctcattgtctatattacaaaataacagcatttggattgagatttgaagtgactcacaaagtaaccaatgtgctactccctgtccgagcctgataccaaggagagccattggaaagcgtacctgctgattgaagagtgccgcacaaggcaacctcatcagactaggtttgcttctttgggaggtggagagcatataaaccagtggaaagaatggaaaaataaagccttctagtcttatcctgtctcatccctttcacattgccccttaaaccaagattgtttccccgctgccaaattggttttagggataaaagtattttttacaggcgtgatggctcacacctgtaatcccagcactttgggaggccgaggcaggcagatcacctgaggagttcaagaccagcctggcaaacatggtgaaaccctgtctctactaaaaatacaaaaattagctgggcatggtggcaggtgcctgtaatcccagccattcgggaagctgaggcatgagaattgcttgaacctgggaggcagaggctgtagttagccgagagcataccactgcactccagcctgggcgtcagagcgagactctgtctaaaaaaaaaaaaaaatttttttttttgcatgaatattacttggcacatcattaacgattttttttttttttttgagatggagtctcgctctgtcccccaggctggagtgcaatggtgcaatctcggctcactgcaacctccgcccccaggttcaattattctcccacttcagcctcccgagtagctgggattacaggcacctgccatcatggctggctaatttttgtattttcatagagatggggtttcaccatgttggctagtgtggtcttgaactcctgacctcaggtgatctgcccgccttggcctcccagagtgttgggattacaggcgtgagccactgtgcccggccaaagattttgaactacaaaagagaaacctgacatgccagtgtcacaattctgtatttccatgaatagcatggaggacatgaaataacattatgttagtctattcttgcattgctataaagacctgagactgggtaatttataaggaagagagatttgattggcctacagttctgcaggctgtacaggaagcatggtgctggcatctgcttctggtgaggccttaggaagcttacaattatggtggaaggtgacagagagccagcatatgacttgttgggagtgggagcaagagagtgccaagggagaggtcccagactctcttaagtaaccagatttcatgtgaactgagtgggagctcacttacaccaagaggatgatgctaaaccattcatgagagaccctccccgatgatccagtcaccttccaccaggcttcacctcccacactgggaaccacattttaacatgagatttggaggggacagacgttcaaaccgtatcaaacatgaaactgcatttcgcatcctaccataaagccttgttttggggtgaggaagtggctgtaagtgaagaatgactgcctcgtttctggtttggacaactgcattggaatgtctgtgggacatggaattggtcatacaggtgtagaacctaagacaggtggcctcggctggagaaataaatcaggaggtggtcgtggaagccatgggattagatgagtttactcgtgttgaatacagcctgaaaaaggagcataaaacaaaaccgaggggcacccatgaggaatgggctgaagagggaagatactgaggaggatggacaccaggagagaaacaagaaacaaataatgacatgattgttttgtgaaaaggggagtggccaacactgtcaaacacaagagaattggaaataactaatgagctactgtgggaagaaagccacaaatgaaatcgttttccaagttactttctctctctatgccttagattcttggtaaaaagagcacctgcctcatggggtggttgtgtgggcaaaatcacctgactgatttaatgaatgcaaaccacttagaacagtgcctggcatacagcacgccctcagtaaaggctcgctcttactcttattgcagttgactgggcaggtgatgtcattaggttaaaggtgttctgttatatttaggaaggacagtagaaaaaaggcctgaaaataagcctgctgatacgaagattaaaatctgcctataaaaacgggatagtagggattttctatttattttatgatttgaaatcattcaggactttcttttgatgctcataattctttaaccatttcagaactgattgatgcatttataatgctacaacagaatcttattggctggctgtattcgtgtatagggtgaccataacaaagtaccacagactgtgtggtttaaacagcaggaatttatcgtcacagtcctggagctggaagtctcagatgaacgtgtggggaggattggtttcttctgaggcctccctttttggcttgtaggtggccatcttgtccctgtgccttcatatggtctttcttctgtgcatgtctgtgtcccaatttcttcttatgaagacactagtcatgttggatttggtttcacccgtatgacctcattttccttaatcacctctaaaggccctgtcttccaatacagtcagagttgaggtattggggctaggacttcaacatatgaatttttggggaacacaattcagcttgtaaaagtcacttatgagaagagtttaatgttagcctctgagtgagtcagaatttaatgttaattatgagtctaaatttaatgtaaattctgagtgagtcagaattagtgggtaaaaatttgagacctcactttttaatgggcacacaaggaagatggtgcattagtaggtatctcctcaggtcaggctggatgtcattttaactcctaacaatttatagcagcagccaggcaagcaaaagtcaatctggaaatacactgcctgcctaaacagaaacacttaggtcaatactatagctttcaaaagggaaggtaacaccgtgtgccctgggtgtggttaatctgtaagaaattttaaaaccacaagctttttcctctacagtatacccttctaccaacataatttgatgtatacttggggatgccaattttttcttaaaacattaactaaaagaaagcctaagtaaggaaacaactttgttggcttttgtgccctccaaacctgaatgtattgcttctgaactgctcagaatgtggtttctgttgtaatgaaggggtactggcttacacattcactgcacacattaagcactgggaaggaaacagtaggcaaagaggtgggtttttcctccttgtcttgtaggcatgtcggggaaaccagcacgatgtgccagtcattcctttggatgtagtagataatcagacagagaagttggacaccaacataactgaggtggatgcagcctccgtttacacgctgcctgctggagctgacttcctcatgtgttactctgttgcagaaggtgtgtggtgtttaaaacaaacatataattgcctctcttggctaaggtcctgtaagtttcacctttgattggtttgggtcagatctttcggttgggacatggtgattccatcctgaagctcacagacttagaatttctttgaccacatggcacagagtgataaatgaaagtgtaaagtaccttacagaaaaataattcctgagagttatgttgagtaaagcaacagtctaattaattatattagtattagcagcctaccatcagttactgagggtggtagtgccattgtggtaattgtcatggaaagctttaattttttttttttttgagacaaggtctcaactctgtcactgaggctgaagtgcaatggcatgatcatggctcactgcagcctcaatttctcaggctcaagcaatcctcccacctcagcccccctgtagctgggactataggcatgcaccaccatgcttggctaactttttaatttttcggtagagattgggtcttgctatgttgcccaggctggtctcaaacaatcctccagccttggcctcccaaagtgctgggagtacaggtatgagccattgcgtgcgtgcgtgcgttttttttttttatagtctcactctgttgcccagacgtgtgtgtgtgtgtgtatttttttttttttttaatagtctcactctgttgcccaggcgggagtgcagtggtccaatgtcagctcactgcaacctctgcctcctgggttcaagtgattctcctacctcagcctcccgagtagctgggaatacaggtgcctgccaccacgccaagctaatttttgtagttttagtagagatggggtttcaccatgttggccaggctggtctcgaactcctgacctcaagtgatctgcctgcctcagcctcccaaagtgctgggattataggcatgagccaccatgcccaactgaaaaatattttgataatggttctttgcttttgtagtaaataattttgacttctttttagtaatctcatgtctcaatcattgtctatcttgggaattttttaggaaatggaagaaattatacagaattaaccccgtgtatataaaactatatagaattaatctcttttcccatttgaaaagagtcaaaaaaatttaaaagccatttatatcatggacacatcttaagactcttctaaggatttttaagaacttatacttctgtaactaaaaagaatacacacagtaattgaaagccagaaaactgcagcaacattttccttctcacttttttaggatattattctcaccgggaaactgtgaacggctcatggtacattcaagatttgtgtgagatgttgggaaaatatggctcctccttagagttcacagaactcctcacactggtgaacaggaaagtttctcagcgccgagtggacttttgcaaagacccaagtgcaattggaaagaagcaggttccctgttttgcctcaatgctaactaaaaagctgcatttctttccaaaatctaattaattaatagaggctatctaattttacactctgtattgaaaatggctttctcagccaggcgtggttactcacacctgtaatcccagcactttgggagtccaaggtgggcggatcacctgaggtcgggagttcgagaccagcctgaccaacatggagaagccccgtctctactaaaaatgcaaaaaaaaatttagctaggcatggcggcgcatgcctgcaatcccagctacttggaaggctgaggcaggagaatcacttgaacccaggaggtggaggctgcggtgagccgagattgcgccattgcactccagcctgggcaacgagtgaaactccgtctcaaaaaaaagaaaatgtctttctcttccttttatataaatatcgttagggtgaagcattatggtctaatgattcaaatgttttaaagtttaatgcctagcagagaactgccttaaaaaaaaaaaaaaaaagttcatgttggccatggtgaaagggtttgatatggagaaacaaaatcctcaggaaattagataaataaaaatttataagcatttgtattattttttaataaactgcagggttacacaaaaatctagctgatttaacttgtattttgtcacttttttataaaagtttattgtttgatgtttttaaaggtttttgaaatccaggaattaaatcatcccttaataaaatattcgaaattc

SEQ ID NO: 92 - DNA, 51748 bp, Homo sapiens
aacaaatatttcccgaaagatccaggagcagcatctccaccagcaagctgggctgctgggtgggtacttccttcaaagctgagggagcgtcctacgcccacgcgcgcaggagggcgccccccgcaaagcaacgtctaggagaccacagtggatgccacagcgggcccgaagcggatcagccttgtggggtacgcatgctaatgtaggcgtggagtcccccagggggacgccagcagttccagctgggatccaggtttcgctaggggagagcctctggctatgggaaaggggtctccgagttgatgtgaaggcccaggtcgaggtgtacactgggggcggggaagtggaggtgaccacacgagcgccccatcactgagcgccgccgcgaaatctgcgctctttgggtcacttggagcgcggccagtttggcagatttgtttttttcccggaacaacccgcggcggctcggctgtcccgggaaactgcaaactttgctgtgcgcgttctcccgcgcgcgggctcaactttgtagagcgaggggccaacttggcagagcgcgcggccagctttgcagagagcgccctccagggactatgcgtgcggggacacgggtcgctttgggctcttccacccctgcggagcgcactaccccgagccaggggcggtgcaagccccgcccggccctacccagggcggctcctccctccgcagcgccgagacttttagtttcgctttcgctaaaggggccccagacccttgctgcggagcgacggagagagactgtgccagtcccagccgccctaccgccgtgggaacggtaactgcagcccccacctcggccggcgcctctccagcccgccggccgtgcgcgccttgcctccctccttcctgccggcttcctagttcccccctgcgcccccagcgtggtctaggggagcctggttgagtgggactgagtggccccgacggcctgcgctgaaactttgggaagagggcccgttccgctctctccatcgcttgccttgctcagcttgtcctcccttccctcctagccggggggctaggggacacctcgtactattcgagatttaggagaggagggctcgtgatctggcacagcggctaacagcgagggctcctttgcctgcgttccggtccccaccccttgcctgccggcggtgggacctcaaccctctctctgttaaatgggaaccacggtgatccccgcagactgttggcggggatggacagagttgattatggtacgcgtttcgcggcagtggctctgtcaagtctgagtacactggagctgagcgtccttgctgcagggctcttagagggaccttgaggaggtggaaaccaggcaggagacatttagacgtgtggagtgttaggctccaggtgacagctttgcggtttatggagcagtaaaattacttgtgggtgattgtgggtgtatcatttccagatctttattcttgaacttctgggctcctgggctagttgacgtggccctccctgttgtctcaacttacaggctatttcctccttttgggtctcgccggcctgaccttcacccttggtaccgccattgcctagattcacagtccaccttctgccacctgtaaactgtgtggctttggacaggttacttaacgtctctgaagaagctaaagtttctgcaatagcaaagtaaaggccctggtctagcagtgccatgagccttgggtgacgcagcggagcgcttgagtgcccagcagagcctccctttccccctcccagctgctagaggcaagagggggaggttttcaggtcttctctgtgtgccctttaggaagatttttatttgggcaagaagtgagtcacaaattgtatgatgtcacttttcaggggaagcagctgcagtccatttcccccttcatgaaagtaaaaagttcagacaatagctgggcagtgacttcttacccagctgtgtaccagttgccccaacatgtgggctcctgttcaacatgtttagaaataatcactacaggaactttttttcagtctctacaaaatctttttaaaatatggatgtggtttttaaatatcggcaaaggttgacagttgcatattatcttagtctcgtgggcagtggtgataatgggaatatttcttgactatttagattgtgccacctagcattttacatgcattgtttcattcatcctcccaaccacctgtgacataggtactgttgttttcccattttacagatgaggaaactgaggcttagagaggtcgagcactttttctgaggtcccatggctaatatgtggaagaactgattcagccccagatctcagggttctcaaccaccctcttgggtctccttggttctgctgtttggacagcagtttattgaaggggctgaaggatttgaaaatacatttaagttagatttataaagaaaaatggatttggtgcctgccatgtacctgacatttttctatgattaaaaaaatgattaagatgaggtctcagtctgcaaacagtgacaatcttggtggctaatagtaagaataagagttacagtgactaaccaagacttactatgtgcctatcattgttagtgctttgagtgtctcatgtattaatttatttaaagagaagttagacatatttaacagtgggataagcaatctccctcaaatgactgctctttgcagcctggaccttaaaaaggggacagatatgagaaaataatgccatgtgtaccctctacggacagcttggcagaactgagataggtctggattttcttggtgcactgtgatgatgaaaggaggaaataagaggtcaaaaccaggtcttggtttgactgaaatgacgtgtctgagatcaggcattccccacttggttaccaccctgggctatgatcgctctttggaggttccaaaaatcaagcccagtctcataggaataagaaagtaactaattgtttagctttacagatttgaaagagccaagtcccaccactgctgacttggattgttagaagagacactttctgtcactgcagacagtgttcagcatcaacccagaaggatgcggtaggtttcagacagaagacctaatggcctactgtttggagggaaagttctagaaagcgtcccatcattgagccacagaaatcagcctgaattttacatctcagtagctaagtccaaagccctctcttagtgtctgagaaggatgagtttaagctatacccatcctttggtggaacatttcaaatgtttaatgagtgcacagttctctctgcctgcatcgctcccacctaccctctctgcttcccccttttcagttctcaggtcagacatttcctcccctgaggagtttccctaatttctgtgaggctcttgagtttccctggtatggctacagattgttcaccctcaaggcatacaccacagttgcatttcaaactagacgccatcctttttttcatgtctgtttctcaacatggcaggaccaggtcaatttgctcacaagtatatccctaattcctaacttctagtaaatatccattgaatgaatgaagaagagtctccaaaagtctcagcagtcccaataatatcaaaacaaaggcttggctttcttaggagccattttgcttagggtcttcccctttttcaaaaccactttattaaggtatagttgaaatataaaaagctaggcatagttaatgcatgcatacctaccaagtttggagataagcatagatacacccatgaaatcatcaccacctcaacaaagctaccacctcctaaagtttcctcccacaccgtttaatgctattattactattatttttattactactattttttgaggtggagtctcaatgtgtcaccaggctggagtgcagtggcgcaatctcggctaactgcaacttctgcctcccgggttcaagcgattcccctgcctcagcctcccaaatagctgcgactacaggcatgcaccaccatgcccagctaatttttgtatttttagtagagacggggtttcaccatgttggccaggatagtctcaatctcttgaccttgtgatccgcctgcctcagcctcccaaagtgctgggatcacaggtgtgagccaccatgcctggccaaaactagtattttttgtgtggtaagaacattcaccataagatctacccttttagcaaattgtaagtataccatatagtattgttagctatgggcactatgctatataggagatctctagaatttattcatcttgcacaactgaaactgtgtaccctttgactatcacttccccatttcttcctcgctgcccccacccccaacctctgacaacctccattctattctccacttgtatgagtttgactctgttagattccacatagatgtgagatcatacagtaattgtctttctgtgtctggcttatctcacttagcgtaatgttccttaggtccatccatcttgtcacagatggcaggatttccttctttttttatggcagaataatattccattgtgtgtgtataccacatattctttatctattcattcattgatggacatttagattgtttccataatgttacagtgaatgtgggagtgcaggtatctttttgagatcctgatttcagtttctctagatatatagccagaagtgagattattggatcatatgcgatttctagtttcaattttttgagaaacctctagacagttttccataatggctgtaccaatttatattcccaccaacagtatagaagagttcccttgttttcacatccttgctaacacttacctttatacacacacacatatatacatacacatacacattatatatgcatatgtgtatgtgtatacacacacacacacacacatataaaatagctatcctaacagttgcgagatgatatcttattgtggttttgctttgcatttccctgatgattaggaacattgagcaccttttcatatacctgttgcccatttgtatgtctttagagaaatgtctattcgggttctttgcccatttttttaattagattttttttttttttttttttttttgctattctgttgtgtgagttccttgtgtattttggatattaaccccttttcagatatatggtttgtaaatattttctcccattccataggttgctttttcgttttttgtattgtttccttgctatgcagagctttttagtttggtgtaatcccacttgtttatttttgcctttgttgcctgtgcattagcatcatatgcaaaaactcattgtcaagaccaatgtcaaagagctttctccctatgttttcttctagcagttttaaggtctcaggtcttatgttgaagtctttaatccattttgagttgatttttttgtatggtgtgaaataagagtctagttttattcttttgcatgtggatatccaattttcccaacaccatttcttgaagagactatcctttccatattgaatatttttggcacccttgtcaaaaattagttgactgtaatgtgtgggtttatttccagactctctattctgttccgttgctccatgtgtctgctttatgccagtatcatacggttttgattactatagctttgtaatataatttgaagtgaggaaatgtgatgcctctagctttgctcttgctcaagtttgctttggctatttagggtctttcgtagctacatatgaattttataatttttttatatgtctgtgaaaatgccattggaatttagatagggattgcattgaatctgttcagtgatcaatttgagcagcatggacattttaacatattaattcttccaatctatgaacatggaatatctttccatttatttatgtctaatttctttcatcagtgttttgtagttttgttgttctggctcaaagaagagcagtgtgttgcttaatttccacatatttgtgaattctctaatttctctcctgttactgatttctactttcataccatttgtggtcagaaaagatacatgatatgactttaatcctcctaaattaattaagacttgttttgtagcctagcatatgatccatcttggagaatgttgtgtacacttgagaagaatgtgtattttgctgctgttggatgaaatgttgtatatatgtctgttaggtccatttggactagtgttgttcaaatccactgtttcctaattgattttccatttggatgaaatatccatagttgcaagtgaggttttgaagtcccttactcttatctattgctatttctttctgtagttctattaatacttgttttatatatttaggtgtgctaatgttgatgcatatatatttacagttgttatgtctttggtaaattgatatctatagttataatataatgaccttctttatctcgaaagttttttactttagtctattttgtctgatataagtatagccccccctgctctcttttggttaccattcatatggattatctttttatatcccttcacttttagcctatgtgtgtccttaaatctaaagtgagtctcttgtaaatatcatgtagttggatcttatgtttttactctatttagtcactgtatgtattttgattggataacttaatccatttacatttaaagaaattattgataggtaaagggctcactgttgccattttgtgattgttttctgactgttttatagttcatctgtttctctcttcctctcttgcttccctcccatgtgatttgatcattttttgtagtgatatgctttgtttcttttctgtatatattttgcatatctactacagatttttgctttgttattaccatgaggcttacacaaaacatcttataacgttctattctaagttgataacaacttagtccatttgggatgctattacaaaataccctaaactgggtagcttataaacaacagaaatatatttcttgtagttctggaggctggcatgttgaagatcaaagtgctaacagcatcagtgtatagcgaagtttcatttccttgttcatttattatatcttatcacatggtagatagggcagggcagctctctttatataaaagtgctaatcccatttatggagctttacccttttgacctaatcataccccaaatgccccacctcctaatactatgacattggtgaatagatttcaatgtgtaaattttggggggtacgtaaacattcagaccatagcaacaacttaacttcacgcacattcaaaaattctgcagttttattctctccttccatgttttatgttattgatgtcacagtttacatttctttatattgtatatctattaacaactatatagctatggttattgaagctagagttgtttttaatactttagtcttttaactttagtagagttcaaagtgatttatgcacagctaatacagatgctcctcaacctatgatgggtttacatccctataaacccaatgtaagttgaaaatatcataagctaaaaatgcctttaatgcaactaatctattgaatttcagagcttagcctagcctgtcttaaacatgcttatatcacattagcctacagctgggcatgagaatctaatacaaagcttatttaataataaagtgttgaatatctcatataatttatcaatactgtactaaaagtaaaaacaggatgggtgtatggttacttgaagtatggtttctacatgatgtgttttgcttttgcagcattggaaagacaaaagatcttaagtaaaaccattgtaagtcaaagaccacctgtaaattattcacatattctggatttgactatacacttacttttaccagtgagtttaaagaatgtcctttcatttcaacctgaagtattccttttagcatttcttgtaaggcaggtctagtagtgatgaacactgtcattttcatgtgtctcagaaaagtatttatcttttcttctgaaggacagctttgctggatataatatttgtggttggcagtttctttcttttagcactttgattatattatcccactctttccaggcctgcaaggtttctggtgagaaatccaccagatggtcttatggacatttctttgtatgtaatgaggtgcttttccgtgtgtgtgtgtgcatgtgtgtgtgtgtatgtacatgtatacatgtacgtacatatatatgtatgtacatgtatacatgtacgtacatatatatgtacgtacatatatacatgtacatacacacacgtatatatcaatagcttttggagtacaagtagattttggttacatggattaattgtgtagtggtgaagtctgagattttagtgcacctgtaacccaagtagtgtacattgcacccaatatgtagtttttaaaaatcccacatcctcctcccactctcccctcttctgagtctccagtatccattataccaatctgaatgcctttgaatgctcatagcttagcttccacttacaagtgaaaacatagatatttggttttccattcctgacttacttcacttagaataatggcctccagctccatccaagttactacaaagacattattgtaatgtctccatcttcatttctctttctttctttctttctttctttctttctttctttctttcctttctttcttttctttctttctttctttctttctttctttctttctttctttcctttctttctttctttccttccttctttccttccttccttccttccttccttccttccttccttccttccttcctttctttctttcttttctttctttttgagacagagtcccgctctgtcacccaggctggagtgcagtggcgcgatcttggctcactgcaacctccacctcccgggttcaagcgattctcctgcctcagcctcctgagctgggactacagccgtgtgccaccatgcctagctaatttttgtatttttagtagagacagggtttcaccatgttggccaggatggtctcaatctcttgacctatgatccacccgcctcagcctcccaaagtgctgggattacgggtgtgagccactgtgcctggccctccatcttcatttctgatttagcttatttgaatgttctctcttcttttattggtaaatctagctaatggtcccctgagtttatcttttcaaggaagcaactttttgtttcattgatcttttgcattttttgtttcaatttcatttattctgccttgatctttgttattttcttctgctagctttgggtttggtttgttcttgcttctctagttccaggaggtgtgactttaggttgtcaatttgtcatctttcagactttttgatgtagatatttagcaccacaaactttcctcttagcactgcttctgttgtatcccagaggttttgataatgtgtgtcactgttatcattcgttttgaagaattttcaaatttctatcttgatttcattgttaacccaaaaatcagtcaggagcagactgtttaatttccttgtttttatatagttttgagggtttcttttggagtcgatttctagtttgattctggtgtagtctgagaagatacttgatatgattttcatttttaaaaattaattgagacttattttgtggcctatcacatggtctgtcttagagaatgttccatatgctgatgagaagaatgtatattctgcagttcttgggtagaatgttctataattatccgttaggtccatttgttctggagtgtagtttaaattcagtgtttctgtgttgactttctgcctcagtgatctgtctagtgctgtcagtggagtattgaagttctccaatatcattatgttgctgtctatctcttgtcttaggtctagtggtaattgttttatgaatctaggagcttcagagttatgtgcatatatatttagggttataatatcttcctgttgggtcaatccttttatcatactttctttgtctttttgtttgtaaactgtttttctttaaagtttgttttatctgatataagagtagcaacttctgcttgctttcggtttctatttgtgtggagtatctttttccacccctttaccttgattctataagaatcctttgtattaattagctcagcttcttgaagacagcagacatttggtttgtgattttttttttaatccattctgccaatctgtatcttttaagtggagcattaggccatgtacattcaacattaatattgaggtgtgacccaatcatcatgttgattgttacctggatactttgttttttttattgtgttattgttttataagccctgtgagttttgtgtttttgagaggttctattctgttgcatattgaccttttatttcagcgtttagaattccttttagcatttcttgtcgggctgatctggtagtggcaaattccttcagcatgtgcttgtctgagaaagactatatccccttcatttatgaaacttagttttgctgtatacaacgtttttggctgagagttattctgtttaaggaggctaaaaatagggccccaatcctttctggcttataaggtttctgctgagaagtctactgttagtctgatagcttttcctttgcaggttatctgatacttctgtcttactgctcttagaattctttccttcatgttgacattagtaatagcctgttgactgtatgccttggagatgtccattttgccatgaatctccccgaagggctttgaccttcttgtatttggatgtctaaatctctggcaaggctagggaagtcttcctcaattattccctcaaataaattttccaaaatttttactttttcttctccctcaggaacaccagtgattcttagctttggccattttacataatctcatatttcttagagactttgttcatttcttttagttattttttctttatttttgtctgactgggtttattcaaaagccttgtcttcgagctctgaaattctttattctacttggtctagtctgttgttaaaactttccacttgttttgtaactccctaaatgtgtctttcatttctagaagttctgattgtttttttttcctctaaagtatctatctctttagaaaaattttcattcatatcctgaatttttaaaaaactttctttatattggttttcacctttttcttgtatctccttgggtaacttaataatcaaccatttggattctttatttggtatttccaagatttcatcttagtttggatccattgctggaaagctaatgtgatcttttgggggtgttatagaaccctgttttgtcatattgccagaattatttttctggttccttctcatttggatagactgtttcttctaattatttttgaatttatttttgattcaaccgtttctttctaatttccttttttccaccttatggatgtgacttcaatgattatagcttattgtaacctaatttggctctgggtgcttttggcggtgaagactctgtataagttccttggttatagagagtctttgtatgatggttttctcagatgtagtagcaatgtgcttcgtgtgtgagcaggttgactgtctcttgtggggttggaatggcaaaagtctctgaagctcatccccagtggtgtgcacttatttatttattcatttgttcattcattcattcattcattcctccagtattactgggttgaacagttcaggcttcaagtcagtatgggagttgtccctgggtaaaaactgggtgtgcctaaaacaggtagataaatacaatacctaatggagggcagaggtcccagccttgacgtaggcggctggagaagctgtcattgaaaaacactgaggtcttttcagggggaaggaaggggctaccccagctcccatcccaggccagcaggagaaaaaactgcctcccattcacactcctgacccagtgttctgtccattcaaaccaggcagacaccactttccagctgcagaaatactgatgttccatgtagagagggattataattacccctcatgcaagcctgaaccttgagggcacttgtcctatgaggatgcagtcaccctgaagtgttctagaaaggctgtctacagatgcacccatgccacgctcttgtgggagaagcccaagctgtagctgcagtggtgggtgaggaggaaaagtctccttctccaagacctgtcacaagcaccagggatgcctgactgttgtagtagagccacagactttcccttctgagttcagcattgcacctgtgcctctgctgaaaaaaacttcccacaagcagaaagctatgggactcaagctttgccatctggattcttttgtcccatgggttactcctttgatgtggtgcactcccccttcccctaggagtaggagccctgagggccagactgttgtgaatgctgctgcttctctgggtctagccacccagtggggctgccacactccaggaaagtgccggggaatgtctgcagggggtccagtgatgcgacctgccctcaaatttccagcagtaggtaccagcatctgttctgatgggggtggcagggaagtgacatagactctgtgagattccttataaatagccttagtgtgttggctttctcacacactagctatagtaggaatgaactggtcatgtggacagactcaggacctactgattagctgggggtaatgcaggcagtggtgacagatggggtcatgcgtaagttttctccttcctgggtgctatgttattctgccagcagatgctgtaatggactgtgttggttggcctccaggcaggaagtggcacttggaaaagaacaccagctgcggtggtagcagtgggatttgtgcttcttatgttacccaggtgaggtactctggtgtctcagacaatgcgtgaggccatagagcttcccaaagtttctgtcctttgtgttaagctatggagtagggggtaaaggggcaaagccaggtgggggctgggtcacgtaagtacatgctatggctctccatgtgtgggctcaagcagaggccccagtggggataagagggcagtcctcttgccgcaggggtaatgttccagggaggagtgcaactgcctgtgctgcacagaaagtccacacagggagtggggagtagcaggtgacagtaagctctgcccagttcccatgcacttggcaaggtaggtctcacaccggtagtgttccactagtagcagctagctaggttccaggcattctgctctcagaactcaaaactgccccaggccataagccttcccagttgagacataccatggctttcaggccacgccccttctggtctgcctgagaaacaaaggtacccagctcttgtgctcgtgagtataacccactgcccactcacccctcggttctggccaagggggttcatcgtcactcgagattatatcacaaatgtcaattgggaacctctctcaacctatgacagactactgagtttgctggaagatgtccacaaggtcacctgtgaggtaggacctggaatgacttccttctatccctgctggagaccgagagcacatgcaatgcacatcccaatgctattccttctcatgtattccccagtgctcactaaatcagcttcagtgctgggtagggttaagacctttccctgtggcctggattgccaagttctccagtgggaatgtatgtcccagagacagtttatccccctcacactccagggacttagaattttctacctggttcacagtataggctgcagcccaccacttctttcaaaggctctgtggtttctttcagttttcctattaagttcctgtgttgcttcttggaaaaaagtacacagcatgaatctctacacactattttatcttcccaagtgagagaggcatgctaacaatgcctccaatctgccatcttggaaaaaaatcagttgcttttcttttgctgctttcaagattttctccttatctgttttgactcttaccagtgattgtaatgtgtctcagtgaagacctatttatgcccaatctgtttggggttctttgggcttcatgaatctagatgttcctttccctctccagatttgggaagttttctgtcataatttctttaaataaactttctacccttttctctttgctccttctgagacaccgatactgcatatattggttcacttgatggtgtccaataaattgcataggtttcttcactctttttcattcctttttctttttgttcctctgactgattaatttcaaatgatctgttttcaagttcactgactctttcttctgattgatcaagtctactgttgaaactctcaattgaattttttatttcagacattgtattcttcagctccataatttctgtttcgttcatttattggtttttatttctttgttgaacttctcattttgtttatttgttgtttttctgatttcatttatttgtctgtctgctctcttgttcctcactgggcttttttaagatgattattttggattctttgtcaggtaattcatagatctccatttctttgggatcagccactggagctttattttgttcctttggtggtgtcatatttccttgattatttgtgttctttgaagcctcgcattgtgtgttcacacttgaagaagcagtcacctcttcccgtctttattgactggctttaggagagaaagacctttgccagtgagcttagctagagattctggggatctctcacactttttctctagatatacctgctccacacctcttgttccctctttgggattatatgtgttctctcagtcctgcaaaggcagaccttgtgctaaaagcctcctgcttattccttagggtagtaccctgaaatgttcaaagttatatgtcttctctcaatccatcaaagttgagctggctgctaatatccctacctgctgttgagatccaagcattgtctgtggttgtgtacagactgttgtgcactgaggtacatatcagctggttgaaggggtacataggcaagttgtcctgcagggtttatgggagggacttagggtagcatccatgagctgggtagcagaatctatagccggcttttgataaccatacactatttgcactcctgctgctgcttctccttgctcctggctgccccagacgattcagccgtactattcccctcagtgttctgggtgggatgaaacagaagtgggtctcctagacaacatccttttgggctgggaaagctgggtgctcacttcactctcacttcccccatgggagaattgtgagctggagggacctctcttggaactgagctgtgccaccttaggggaggggtgatgtgggtaaagtgagctgctcttattatactctttgatgcatccactcttcgattttttgctccaccagtgtgctgaaacctctcagtggactcctgtggcctcacaaaagtattcttgtccataggtgtagttgccaaaatcagtatttctatataagaatgaaaactggaacctcctattccgctatcacactgacatttcttctttcttttaaaaatagtggttatattgtgttgtcatcatataccctagattgagcctttaagattaactttagcaaaagggccaacttgattaacaccacatatcaaagttagtgtctttgtctggtggatttttttaaaactttgacttactagttttgaaaatatgtgagtgtgtattgtgttaataacagtctatattggaaagtaactaagtctatgtaaaggagacaagagaggctatcaggtattttctgcatgtgtggccttatgcttatctcctctgtgagttatctccatttttgagaaactttgggttctaatctgaaaaatctgcctcccaaccagaaacacattggtgatgatgaagggaggctcatgatgtgttgagaaacaaggtgaccatctgacttcccatggtcattgtagagacctggcagtaggactttcccttcttagctccctcccctcttcccagttcaccctcagataagctggaaggtgacaccataatgccattcggagtgcaaggccactaggttgtcactttgcctccttggacacctccttctgaactgcattccttctccccacctccaaaagttattacttgtgctcagcggcacaaaatattctgtaaagtagatgccttcttgttttccaacttaatgacagcatccctgggtgagccctaactggaatacagaactgcacctgacaaccgcggcctgctcagtgaagttgctcagggattgtatcagaggcatttgaaccggagcaactccatattgaataggggctgggtaaaataagactgagatctactgggctgcattcccaggaggttaaggcattcttagtcacaggatgaggtaggaggttagcagaaggtagaggtcataaagaccttgttgataaaacaggttgcagtaaagaagccagccaaaacccagcaaaaccaagatggtgacaagagtgacctctggtcaccctcactgctcattatacactaattataagccattagcatgctaaaagacactccccccagcaccatgacagtttgcaaatgctatagcaatgtctggaagctacgctatatggtctaaaaaggggaacttccttagttcctggaatttcccaccccttccttggaaaacttgtgaatagtccaccccttgttttagcatataatcaagaaataactatgagtatccctagtccagcagcctaagctgctgctctgcctatggagtagccattcttttattcctttaccttattaataaacttgctttcactttactctatggactcacccttaattctttcttgcgcgaggtccaaaccctctcttggggtctgcatcaggacccttttctagtaacagttgggaccaggtagaaattggagtctgaagtttctctttattcctgaaagttgatccctgatcccttcatggggaagaaaatgggacttgatttaggagaagtgattctaatactggccaggtgcagtggctcacacctgtaatcccagcactttgggaggccagagtttgagaccagcctggccaacagcctggccctgtctctactaaaaatacaaaaaaaaattagccagatgtggtggtgggcacctgtaatcccagctactcgggaggctgaggcaggagaatcacttgaacctgggaggcggaggctgcagtgagcggagatcacaccattgcactccagcctgggcaacaagagcaaaactccatctcaaagacaaaaaaaaaaaatgattctaatactggctctgccttgggccagccacatcacctttagctaattctttccccttagggtgtgtgtttcatccagccttccattcaattaaatattttagtaagcaccttctgtgttccagctacctctgccataatgaacttatattgtcttataggagccaaacagcagagcgcaaataaacaagccacatacgaaggctatgcgggaaatgaaggcagagggtgggggtggaaagggccaggtagtaaatatttttggctttgtggccatcactcaactctgctcgtagagaggaaacagccataggcaatacataaatgaatggacatggctgttttctagtacaactctatttactgaaacaagtgttgggccatagtatgctgattcccagactagatcagaaagggccttaaaatccaaggagatggctttagatttgtacttatagttaatggggatctcttgaaaattctcaagctggaatgtaatttgatggaaatctattttgtgtagaaccgtgtaaaagcatctgacatagaaagagagcctaataccccaggttgtcgctgcttttgaattgcgtatgagcactttgtgacctgctaggaatttagggggaaattttcattgttgtaaaccttgacagaccttccactgtttcttgtatgcagtgaacatacaacaaaattgtggttactggattagaagctccctgagggcaaggactttgttttctttgttgccatatatgtagtctctgggatgtaagcatattcacatatttgaatgcattaatggggcggtaaccctgaagcttaaatatgcaaaacttctcacccctaggcgtaatggaaaactgtatcacctaatgagtgtcatttaaaaatatcacagtatcagtgatgccactgaccttgtggctttttttctctcttcccagatggcagatgatcagggctgtattgaagagcagggggttgaggattcagcaaatgaagattcagtggatgctaagccagaccggtcctcgtttgtaccgtccctcttcaggtaagtttgcttaatcagggaccctggaccacgtcagcctgccatgcctctgccatctccacccacccatggggagggggacattcagggaaggaggttcatgctgagcatgaggtttgcacaggttcttgctagctgtacgtagcaacactagtgtcctcatgtgcaccctgttgtctgtgggccaagcccaggaatggacaaaagcaaccactgggagtctcctgctcagccgctgagtgtctggtagcagttcctaagtatcaggggctgttctcattagaggtgatttgcaggcaccttcagaacagagcctgggctgctgctgccagtgggaccaagtttgacaacacagaatccaagggctgagggacaggaggttttagggtgactcacgcccaccctgtgtctcctgaggcattgcactgatggaagggagattgcatcctgttcattagttcctacctttccatttcttgagctcacttttaaaattctaaattttgcatttaataatataatagcttcattgattaaactcttgtatgcctgcttggtattattgcatttagtctacataattgcacatttagttttattgttatcaccatttgtcaggtagggaaactgaggtgctgtgaggttgaatagcttgcctttttgctgatagttagtaaatggtaaagctaagatgagaaactaaacaatgccagcaccactcacttaaagattctgctgtgtgcttcccatttaaaagtcgggctagcttggtgcagtggcttacacctgtaatctcagcactgtgagaggccaaggagggaggatcgcttgagcccaggagtttgggaccagactggacaacacagtgagagccccgtctctacaaaaaaagataagaaaattagctgggtgtggtggcgcgtgctggtagtctggctactcgggaagctggggcaggaggatcacttgagcccaggagatcgaggctgcagtgggccatgattgcaccactgcactccagcctgggcaacagagtgagactctgtctcaaaaaaacaagttgtttttttttttaataaaaaatataagtagggctgtaaggacatggaggaaccccaaccctcccttaaccttgatcatggatggacagtgagtggaacttcttgagagacagaaggcagcaggagtcagacgcatcacacttctttggattccctaagccaagtcctactgggaaagatagagagagggataaaggccgaggttagggagtgctcccaggcagtattcaggaggggaagagctggtggggatgggcagccaggctcccaacaccccagagcagaccttgggccatatcatccaacataggacttggaaaagtgggagaaccccaacactgtggacccagattccgttgtttgccagatagagtcaagaatatccaatgaaatgaccagaaaatacagttctgactcctggaactttccaaaaccatgagaaatcggtgcaggccaacttactccccaaggaaagccccttagagcaatggtcttcaaatgcctttgcttatatgtgctcaaaataatataaagctgtgtgtatattttaaggtaacatacacatttttgtcaagatagttgcaaaaaatgtaataatatttcactcttccgaaccctttttgagtatctgacttcagcaagttgtctacaagtgaaagaaacgggaatcatttaataatcattttgtaagtcagtttaagaacagactaatacacaggactccagctcagcaaagccttttgatgtacttcccagaaattattaaaataaatggtgtgttgtaaatactgacatttcaaagtcgtttctttaaatgtacccagtggaatctacatccatagtgattttataaccacctttatccattaaaagaatacatgaacagctctcctgtaacagctagaacttttatgtcttttttcccttcaaacttggttttttcattctcttttcctccacattttcttctgatgtaatagatttagttgcttgaaagtcttattgatcacaccacatcatatacctatgtaacatatacatgtatgcatatgtgtatccatataaattttaagacagttttctagatatcatgagtattaaaagaaagttctcctagactaagttactgtttcagctttaatgaattcacaattgatctgaaaaataaatgttaatatatcattaatattattaaattgtcattcatcaaaataattattaaatagaaattgcattgaagtttcaacttataatggaatgaaggggctcttaataagttagtttctaaagaaatggacaaataatacttattgctggaataagaaagaatttgatattacctctttttcctatttttcatttttagagataagatgcactgagaaatcatgaataaatacatgagatggtaggagttttgttacagtcatgtcacttaattctttgaattccttctgagttctggaccaaaaaatgacaacttgattaggtctttccttaattatgttggaagaattggcaattatctaacttacaaaaggaattatcattccgccttaaaggtatttaatttttttagtttctgggaagtacaccaaaaaacttgtacccaaacttctcaaacagttgtaaattaaatttgctcttcttttatttagaggcagtctgtttaactcaaaatgttccagaaaagataattaagcattaataaacatttgtcagtatcctttttttgataaaatgcttttaaaccatatgctttttaaaatgtatttttgtcaagacgttggagttgctaatgcagctcattcatgtatgaaaattgtctgctctataatctaatggacagagccagtccctgtcaaaccagttagccataccacacttgtttgctgtcagtaaaggtctgataccatttttcagttcagtgaatatgttattaggcatccttgtgacagtcatcttgtttctgaattctaaatttttattcttggatagatgaatggatggatgggtagaagggaagaaggatgaaaggaagaaagaaagggtaccaagcccagccatgccatgtttacctcctggaatcagtgtttgttttgttctcacaggactgatatggtttggctctgtgtccccacctaaatctcgtcttgaattgtaatcaccataatccctacgtgttgagggagagacccggtgggaggtgactggatcatgggggtggttcccccatgctgttctggtgatagtgagttctcatgagatctgatggttttatgtgtttgacggttcctcctacacacactctgtctctcctgctgccatgtaagacatgtctgctcccccttccaccatgcttccccagccatgtggaactgtgagtcaattaaacctcttttctttataaattacccaatctcaggtagcatcttcatagcagtttgagaacagaccaatacataggactccagctcaataataaaaaatctttggaaataagggaacgaaaaaggcaaagacattaaataagaaccatcatcacttccatttcattctattatatatatatattttaacacatttttcagtatatacaagcatactttgttttactgtgctttgcagatactgcttttctttctttcttttttttttttttttgagacagagtctcactctgttgtccaggctggagtgcagtggtgtgatcttggctcactgcagcctccgcctcccaggtacaagcgattctcctgcctcagcctcccaagtagccagactacaggcgtatgccaccacgcctagctaatttttatatgtattttagtaaagacaggattttgccatgtttcccaggctggtcttgaactcctgaccttaagtgatccaccccccgcttggcctcccaaagtgctgggattacaggcatgagccaccacacctggcccagatattgcatttttaataaatggaaggtttgtggcaaccctgcaaacctattggctccatttttccaacagcatatgctcactttgtatctctatgttacattttggtaattctcacaacattttaagttttttaattagtgttatatctgttactatgatctgtgatcagtaatcttttttgttgtcgttgttcaaatccaggataatctctgtaaatgtgatgagtgatctttgatgttactattgtaattgctttggggtgccacaaagcacacctgtataagacagcagacttaaatgataaatgttaagtgtgttctgactgttccacccactggccattcctgtctctctccttctccttgggcctccctattccctgaggcaatattgaaattgggccaattaatagccctacaatggcctctaggtgtctattgaaaggaagagtgatatgtctgtcactttaaatcaaaagctagaagtgattcaacttagtgaaggcatgttgaagccaagacaggctgaaagctaggcctcctgtgccaaacagccaagttgtgaatgcaaaggaaaagttcttgaaggaaattaaaagtgctattccagtgaacacacggataataacattattgctaattattgctgacttggagaaagtttgagtggtctggatagaagatcaaaccagccccaactttttcttaagctaaagcctaagccagagcaaggccctaactctgcagttctttgaaggctgagagaggtgagaaagctgcaaaagaaaagtttgaagctagcaatggttgatccatgaggtttaaggaaagaagccttctccataaaatagaagttcaacatgaagcagcaagtgctgatgtagaagctacagcaaattatccagaagatctagctaagatcattggtgagagtggctacactaaacaacagattctcaatgtagacaaagcagccttctataggaagaagatgccatctaagattgtcctagctagagaagagaagtcaatgcctgacttcagtgctttataaggatgcttgactctcttgttaggcagactggtgactttaagccgaagccaatgctcattgaccagtctgaaaatccttaagaattatgctaaatctatactctttctgtgccctataaatggaagaacaaagcctggatgacacctgtttatagcatggtttactggatattttaagcacactgttgagacctactgctcattaaaataagattcctttcattgacattgcacctggtcacccaggagctctggtgaagatgcagaaggagattaatgtttttatgcctgctaaaacatccattctgcagctcatagatcaaggagtaatttcaacttccaagtcttattacttaagaaataatgtcttactatttgagaaatattatttcagaaatacattttataaggctatagttgccataaataatgttgggaataacattatagctatagtgttaccgctgatggatctgggcagttaattgaaaaccttctggaaaggatgcaccattctagatgccagtaagaacatttgcgatttatgggaggatgtctgaacattaataggagtttggaagaagttgattccaaccctcatggatgactttgatgggttcaagacttccttcaatggaggaagtaactgcaggtgtgccaatcatggtggaaatagcaagagaactagaattagaagtagacctgaagatgtggctgaattgctgcaatcttatgataaaacttgaacagataaggagtttcttcttatgaataagccaagtaagtggtttcttgagatggaatctactgctggtgaatgtgctgatacatttttgaaatatacatttagaatattacataaacttagttggtaaagcagccacagagtttgagaggattgacatgaattttgtatgtgttttaactctttttttgtttgttttcttttaaactttttccttttttttttttttttttttttttaacgaacactttcgttgagggctgactttcaatagatcgcagtgagggagctgctctgctacatacgaaaccccaacccagaagcaggtcatctttgaatggtttagtgccaggttcgccaggaacatgcattgcgtgacaggcgaggggacaatcacctttctgttgacttgaattttgaatgaagttgtactgtgaataaaatgctatcaaacagaatggtatgctacagagaaattgttcataaaaggaagaatcatttgatgcagcgaacttcattgctgtcttattttaagaaattgtcacagccaccctaattttcggcagccaccaccagattaatcagcaggcatcagtgctgaggccagatcctccaccagcccaacagttacaacccactgaaggctcaaatgattgttagcattttttagcaataaagtatgttttaattaagatatgtattttttggacataatgctgttgcgtatactcagactggagtacagtgtgaacataacttttctacccactgggaaaccaaaaaagtcaggcgactccatttattgcaatatttgctttcctgtggtggtctgaaactgagccgacggtatatctgagttgtgcctatatttgaatttggaacagcccagtgtggtcccacgtacccccattactagtgacatacttcccctttatcagactcatgtataagtaagaagcccaccacagtgcctgattcaaggagactcacagatacatcttgtttgtctctttgtggatgacctggaggtttcatcaccctgtaagtgaggttcagggtgggtgagaaagtctgcccttcttttacacagtgggagatgggagaatgggcaagggaaaagtggtatctctgacagaccagttttagaaaaaaatacaagtggcagttgaggacctggccatttattcttcccttaagactgtgcacccctgggaaagtttttgagtaccttgctggaagacttctgcctaaaagaccttttattttgcaaaaatagatgtggtctgtggtatgtcccccccacccctcagctttaagttctttggaaagataaataagcctggagggtctacattctggtccactctacctttttcatagcatgactgatgttgacgtcattaaaataaacagtaagtatcccgaggtcctctctgcagtttcaggagcaccatgtgacccaatgacagatgtggggtgcgatgcatgggagtgccactggctcctctggatgttcgttgtagctgaaggtgctccgccccccccccacacccctacaaccttccctcccatcccatcccaccctattccagctcccttctctaaggagctcagaatcactgttaggcagtggaggaggcagtagcatctctgacctgactctaatcaaggaccagactgctcacctgccctcccctggagacatgaaggatcctgggttgcagaaagaaatatccccttccccaaaaagccagggtgggactcaggtttcaaatactaacagtttcaagcccctagacttgtcttggcctttttttttgcctcacagccactagatggcaggacagcatcgttttatttccagtccataggcactaaaaatccagcctgttctttaaaaaaatatttagtgattttgtaattttctgattattgaagaacatttggaaaacacagaaaagcacaaaaaaaatccaaatatcttaaaatttgtaaagcattcagatttttagttatttagaggaaatcattgtggggccagtccatattcattatgaaccacagtttatagaacagggtctagggtcctccttgcacttgaacagggttctgtcttgatgtaaatataaccctatagtccttgccctggatataaagtcaaagttttaaccaaatgcctaggcacagctacagaaaataataactaattgctgaattgtaggacatagccttggagctgtgggaggttgaggagggaaggataaggaaggactggaggaggagctgaaacttgagttgtcaggaaaagcagggggggtatcaggggaccggtggaacctcagggccagggtggagatgatggtcaggcaaggccaccgatgtggcttctgcctaggaaagtgggcaaaatctgctggacagggtgagttaggtcttaatagcataggccacaaggagccattgtaggtccaagaccaagccctggccagcagcctagaagatattctctcctaggaacctgagaaatcagaggctcccttctgagctctgctcaaggtcagaattcaagaaaaggaaaaaaaggggaaaacaggtttcccgcagtctcagattacccctgggcctccgtggagtctcgtgtgtctctgctgaggagtttgtttacccttctggtttcccagtggaagagagcaggagaaaagatctattctcaacatttgctaaactccctattttccaggcactggctcggatcacatgggttttacccttggcatcatctctgttttccagcctttgccccctggagggtggttaataaatgccacttggttataattctctctcctggaggcatcttgggcttcttcaccagtgagtgaagatatgtaaacacatccctataaaaaatgtgttatttgtataattataaggaagattcaagtggcatcctttttcatttggagaggggttaaaaaactgttttagaagacgcaatgctttggaattagagacaagaacaaagaaggcagaccttaattcattccaaagaatacattccaagttaagcaaaaattgtgccatgatgcccattgattgaaaggggccagatctgggcccactaaagaaaatatgaacattgaaatttatgcagggcgtttacttttcaataaaggaaggattcaaattcagcttccagaaaattggatgcctgtctcccaaatttgtacatagagaatgataaagatttaatgctgtatttgaagcagtgatgacactatgtaaaataatagaagtagcaaagttgagtcagacaaccggggttcagatcctggcccttcctcccacttactatttgagggactatagcaagtcacgtgaccttcctgtgcctcagcttccttatctgcataatagagatattgatctctgcccacgggattgttatgagaatcagagtaaccgtcagcttcctgaattacctgaatgtgcctgctgaggaagaaatcatagaatcatgattttaacactgggagaacttacctaattcccttcattatgatcaaggaaaggaagaccagagaggtgatacgtagccacccaagaggaccaggaccgagacacaggcctaacttgtccagtgcttccccccagcgtcaggtggcacccacgactttggtggcaccaggctgttcatccacattaatccacccacagagtgcttttttccttccacccaagtgggtcagcaaattttcttcgtgtacacggcttcttctctgcttcactttggcagagggatggtatagggacagctgtcccagcagggcgagcagtgggctttccagtggcggagggatggcatagggacagctgtcccagcagggcgagccatgggctttccagcggcggacggatggcatagggacgctgtcccagcagggcgagcagtgggctttccagtgaagagggccaagtgtacgtttcaggagcagcaagcacaggacaccaaaacgtgggcagaggtctagaaactgcaaagctgtagcttctgcatgtgtgggatacctccagttcttttcagttattgctcttctagaggggataaattaaagtgaaaaggtaaggtaaatcatcagcttttcacagtaatagaaacctagaacactattagcagagaaaaattaagcctagtaatagaaaagtactatgaaaacataaccagttgcttctcacatgaacatgtgatcacagacaggaaatgtgagcgtggcattgcatgtttaacccctgagctgctggttttctttctctcaaggatctgtgatgatgagaattttgtttgttttgttttgagacagagtctcactctgttgcccaggctggagtgcagtggtgtgatctcacctccctgcaacctccacctcccaggttcaagcaattctcgtgcctcagcctcccgagtagctgggattataggcgcgtgccaccactcctggctaatttttttgtatttttagtagagacagggtttcaccatgttggctagactggtctcaaactcctgacatcaggtaatctgcctgcctcagcctcccaaagtgctgggattatgggcgtgagccaccctgcccgccaatggtcagttttaaggggaaaagatgggtggagtgattaaggactgaagtatgttagctgttctaatgctggaccctgcagccgtaatacagacgtattgtatcctccattcagtctattaggctatttaaagacaattcagccttttctaccccctggatgatttgttttaaagtcatttgtcaatttttattgtcagggaccctactggttttgtttttttgttttttttttttaggggaaagagggaaatgtggaggttggtatgttttggggagggggatctattcttctccttagcctcttttaaactgagtttgcttccccatgtttatatttttgcaactgactttcagagaaaaaaatgtatagagcgaattttctctcctgttcacagacctgaggatggcaggtgatcaagaggcttgtgcagggtagcaggtgtcataacctcattgtatcagcttcataccctttctagactgtggtcctgaaccaagaaatggagaaaagcgttgctgagccgttcactttataagtgtttggtttttatgtgtttgcattttccttgttgcatttggagggttgagatggggaaatacagcaactcctggatcgttcactttatgcaagatcattgaaaaatgtttgtatgcctcatttaaaaatgaagggctttggtatgcttccgtggtctcctattatttttattcacttgagtacctttaaaggaaaaacataacctaatgaacttgaactctttaattcaccacacactcacttcctgtttttgttgattaacttacatatagtttgacatgttttgccgtcatgtgagtgccgttttgcagcctggtgtagatttgggacttcggtgggttgaccatgtgtgatgctcatcaacttgaactgtatgatggtttgttctgttgatactctgtctcttgcttagctattcccctgtcgttcccaatttttcactcttaaagattgtgctcctggctgcatgtttatggaaattttgttttcttttttcctttggaccccacgctcacagacagttgcttttttccacaggagccatcccagggttgggggatgctacaatggggagccggggcatttctgccggtcagcagagaagggagaggccagtgtgaccttcccagcccgagtttgaatggtcctgtggaaaactccagcgtgcagttcactgctgattcagtcacaggccttcagggccaggcagcctgtgccagtcttctatcccctgctgagctccgagcatgttgagtttttattattacagagaagaaggaaactcacttcctgtcgtcgcagagcacagcctagttctgatgcagaggggactgttttcagatggagacactaggtactactacctgcactctttcttttcttctctgtcttgctctgtgccttaatatgttaggactgtggggatgccctctgttgagatgttgagaccatgaatgaatcatcccaaaaatatttagacaaagtggctacgaaaaccagagctctagttccgaatgaaacagctctggggaaatgtgagcctggtggtgtgtttactttcatgctgatgaatgtctgcaggcagatagagctactgggaatcctattcatggtgatgctttagaaaattaatcgcagtgggcttcttgcatgcttatattcctttccaaatatagaaaggcataattcacattttgagtagcccaggggatccataagaggataaaacctgtatttatccactccagtgatggggaaaattacacttgcacccggagtggattgtaaaaatccattgtactctttctaaggtttttcacttctttgtaaagtaggcagaatatttttatcctataacgttttctgatacaagttgctgtaggctcttcaaggatgtctttttatctaaataatcatgagagcttggttataattttttgactcttgactgttgtagtgaaaatgactgagttgacctcacactgtgaaattagaagttgcaggaaatggctctctacctaagaagttaggacactctggttccttcctgatagttgatgctggcattatttgtgttcctagcagagatttatgcttatctgaacacatctggaaatgaagatagtggtacttgcccatactggcgaagaagctcaacatgaagaaagagatgggatggttaggaagcactgggttcaacctgctgtgttaactttcctttgcattttagtgtacacttaagtgcacttaataagtcattctaccaagatattgtagtgtgttgtgatcttgcttgtctggctctaagcatagtgatttagtagccaggtttctttttttaaatctgcagtgaattgtggaacacagaagcttttaagcggatttagaactttcaattcactgctctggtttatcttggactttgcacttaatggcaggttccaaaacaagaatcctatgtttcttcgcaaagtaatcttagtaaaagtcttccgaatataaacggggccaaagtaaaggtagttgcatcagcagttagcaaagagaggaaaaagaggaggatggatagaatgggaagcgacaaactctggaggaaaaactaccctggccagttttatttgccttgtctttctttgcctctcatctgtactttgcagaatcagtgggataatgattgttaattcaatttgtaaagcataagcctataaaaatattcatacttcttcatggtgacttaaaaaatatctgaagtggttcctccaccgtttgtgtcgttcatcagcttcggaagaaagactcatacccgttgatctggacttgaaagaatctcagtggccttttcctcctgcccctccgtttggcggggtacagcagttctcacatgcttcagcatcttctgcagtgaggtcctaggaacctggagaaacaacaacagccacttttagaaaatcatgtctttggggatgattgccagctgaagaagtttctaatctggacctttgaaagcattttattttccttctttttccctccccagctcccacccctgggagaacctgctggactgagctatggactgttgccttctttgtgccattggctaattaattagcacaatctcctgggagcccttgaggccctttcttctgtccaatagcagttgtttagctgatgatctgctcgactccagcagctgatttccaagcagacagtaactcttttattcgctgctgggactgagatcacaaagcatgtctcctctgactgtgctgagagtgaattactgctcacacctaggctgccctggggactctacacagtttgttacaaaggaaggagactctaaggatgacactgcctgctggggcatttcctggaaggattttggtggtggcattaaaggaatttcagtttaatgttcagctcagctgtcattgctgggagaccttgcaggttccaaggagagttgtaaattgcccccgtggccctaaacataccctcactgctgcagaggggcaccttccagaggccgtgcttcctgaggtatgtcaggttccatctcctggccaagagccaaggagccaaaaggctgtgcacagctggagaggtgtttgataccgtagagcgagctggtgttctccgccccacacaggagtgtgaatcggcaccacgcaggaatgtggggccaacatcttccatcaacttctccacttccacgggctctggaagtaggcgaggggcttgaaacaagatcagagacagcaatgaaaggtcagagccaagagggcctatgcagtgggcggacaggcttgtcatcgtgaccctcaagcttcagagggtccgagatgctcagaccctctgctgctgccattgatcagcatgttgcttttgttctgtgcttaacactacttattggagatcatcccaggagaacgcccacacctgacctgagactcattctgtaggtctagagcaaagcataggattccgaattttaacaaagttgagaaactctggaataggagacttggggttacaccttggaatgaatccaggctctattcctctctagctttgtaattttggacaagctgatttcatccctctctgtgaaatggaactaatacctcacagaactcttgaagattaaatgagataatatatgtaaagtggtaaatgatcaaaaaatgatgtttattataactgtatttattattgttgttattgctgacacagtggagtaagaagtttaaaaggctaggcagagggataaagtcacagtgaaaaatagaaaaacggggtgtctagggagccccctcaattagcacaaaaaagtatgaatccagtgatcttcaaaataagccagatcttgaaatccgtttgtagcaagcaagagacttttaactgttaaatggcaattattagtttagtgttttaaataacttatttgcatataataaaaagttacacagagttcttccactcttgcctactgtctgctcccagctccctgtaacacagataaccacgctgaaagatagacataataatgaaccggcgtcagtgtcgggagtaaatacccaagattcattgtctcacggccacggaaaactaagacacagacacacaaatactgaggttcagagtggaagtttaataagcaaaagaaagagaagagctctctctactgcagagagaggggtccaagagaaatggattgctggttccgcagtggaatgcaaggcgtttcatagatgagcttgaggaggcagtggctgatttacataggatgcaaaagattggttgaaccaggtgtgtcatttgcatagggcaccaaaaactgtttagggctaggtgtgtcatttgcgtagggcatgaaaaagctggccaccccacactcatcttttattatgcagctggttctccacctggccagcgccatgttacctgtttccttactgtacatgtggtggcaaagaaaagggaagagtggagcctccatgttaaacatacctggcccttacgtagcccttttctactggcatagctgccggtgttcacccgtgcaagcttccagcttgcttatctatgtctgcagcttgatttttcagactgctctttgttaaaaaaaaagaaattatttggggcctgctttttgttaaaagggaaattctgtggaggactcttatacccttactatctgcctaaataatttctatctcctgtatcaataacagtaataatcatgatgtttatttaccacttacaacaggacacacactgttctaaatgctttgtgaagattaacttgtttacaggctctgagcaaatgctgttattttgtccttttaacaaatgaggaagcacaagcacagagaggttaagtaatttgcccacagtcacacagctatgcagtagaatagggagtcaaatccacacagcccagcccctgaatccatggatttatctactgcaccatccttcaagtgtctctttatgcagatacgagcaaatctaaacatattttcttttcttcttttttttttccaaaaggtagcacactgctgccattgttctgcaatttggttttgttctgcacttaacacgacttattggagattgtcccacatcagaacataaagaggttcctcattcttgtttactgtactgtgtgattttgattaaagaaccctccctttatgatccaacctggttattatgggagcgagtgactaattgaataagcttatgtctgccagatagctcttgtaattgaagtgtgctatgaaggttcaacactggaaatgggagagtcaggggaaatgagggaagaaaacttattactccaaaaatgtttccaggtagtattaggtctcccacctgaaagaaatactcaagcaagagttgtcctgcgttcgggctgccctaaattaactccctctcagaaatctgttctcttcctatatgtgagctttgagcctaatgaggctgtacctaatgagtgtctctgcagcagccttgcaacaagaattggcaaaatggaagtgcgggtaccagtgtgcctgcccctccctcacctgcccctgacatgtcctgctggtcaccaggcaggacggcagctccatttagctgatcacctaaacagaggtggcccagggcctctgactgtggtgtttcttcagcacgaaacgctcttcactcattcacaaaacactgttgagcacctgctatgtgtctggcactgttgtagaagctgggggaactgcagtgaagtagtccaggtcctgccctcatagagtttacactctagcaggagacaacatagctctgtaatttgaggtcaggtgatgaatttaaaaattaaagcaggggccggcgtggtggcttacacctgtaatcccagcacctcgggaggccgaggtgggcagattacctgaggtcaggagttcgagaccaacctagccaacatgatgaaaccccatctctactaacaaaatacaaaaaaaattgcccggttatggtggcgtgcacgtgtaatcccagctactcctgaggctgaggcaggagtgggaaggaaaaagtggatataataggggtagtaactcatgtaggccctgtgggctgtggtcaggaccctggagttccttcccagcatatgggaaaaccactggatggctctgggcaaggaactaatctgactggatttatatatttttttttttttaaatacagggtctccgttgccgaggctggaatgcagtggcgcgatctcggctcactgcagcctctgcctcccaggctcaagtgatcctcccacctcagcctcccaagcagctgggactataggcgtgcaccaccacgcctggctaaaattatttatttatttgtttgtttgtttgtattttttgtggagaccaagtttctccctgtcgaactcctggactcaagtgatctgcccacactggccttggaaagtgttgggattacaggcacgagctaccgcacctggccttaccattttatttaaaagctcactttggagagaagccagttaggaggcaatggtggacaacaggtcagaagatgatgtaccttgagcgttccagggtcctggcctgagggagcaagcagcatgatgcccaatgaactagggttgttgtgtgcagagacaagagacccagggatagtggccagctccaccgggtgggagccatcgtgggtgccctgggtcctgccatgccctgtgatcctccgcaagcaggtctgagccgtgcaggggagagctgcaccaggactggggccgacaggccagcagggacaccctgaaggcttcagaaaccctggaacggagtttcacagggagccctgggagggctttaagtggtgatggtggaatctgatttttgttgttgttgttgttgagacagtcttgttctgtcacccaggctggagtgcaatggcatgatctcggcttactcaaacctccgcctcccggattcaagtgattcttctgcctcagcctcccgagtagcttgggattacaggcacaagccaccacgcccagctaatttttgtagagatggggtttcgccacgttggccaggctggtcttgaattccctacctcaggtgatctgcccgcctcagcctcccaaagtgctgggaatacagacgtgagccactgtgcccagcttgatttctctttttaaaggaacgctcaggctcacaggaatcttgggtgaacgttacccactctcctcttccattcccacatttctcttatccattggctttgttctgcccaatctttgccagtctgtcctcttggctcctcaagccacatggtaaaacatggcggccaccaactctcattttaaccaccttgacagaatgactctttttctcaatttcaattctcaaattcccagggaagagggctgattgacccagcctagggatcaggtgccccctggaccaatcagtggtggctgcaaggtcaaggggacaggatggcaaatcactttctaccaatatggtggctctcactgtagcctcaaagggagaatagggatgaaagggatttaatccccaggggaaagaaggtgccttaaaacatcacagcttaggtggaagcctaatctcttggactctcattcttgcagaatatatctataagcagtggacttttagtccctctccccttttttctggtgctttcctcctgatgccttctagacaatcatttgcaccttttctttgtctgtctccagttacatgttttaatcatcggggtttgcttcctcaaagttaagctatggatggagttttcccaaggccagctcttcttaggaggatgaattgaattcatcctcctaagaagagattgaattgatagtcactcacaaacacacatctgtggtctgggaagatgtgggtttaacaaaaagctattttggttagaaggaaaaattaatattgactgactcaaatccagaaagaggaagcagataccaagttcattttgaaaaataagagttcattttaggggcagactagctaagctcttttgcttagaaggagaaattaatattggcggactcaaatccagaaggaggaagcagatattaagttcattttgaaaaataggagttcaatttaggggcaggctaggtatcacccttttgagatatttaccaggagtgaggaccacatttcatattcagttgtaaggtacttttcataaccatggacagtgttttcttaaagtgtttctctttcttcccctattgtgttctttttatgtaaccagttaattttccaaattttattctgatagaaccagagtccttttattttttacataacatatctaattctgtttttctcttaaaggatgcttgctggttttgttttgttcatcactgaggatgagctaatgacagcttttaaaacatcccagcttgttttttacttggatatcatcatagagatccataccacagaagaaagaagtaggacttttatctctgaaaggattttagtgcataaactgtgacttccagcctgctagacttcatgctagtcttaggatctttgaatagccttaaattagctgcaggatccaggaagcttgctctgaaattcagttgacatggtaagaaccctactttaggccagatgtggtagctcacacctgtaatcccaatactttgggagggcgaggcgggtggatcacctgaggtcatgagttcaagaccagccttggcaacatggtgaaaacctgtctactaaaaatacaaaaattagctgggcgtggtggtgcacacctgtaatcacagctactcaggaggccgaggcatgagaatcacttgaacctgggaggcggaggttgcggtgagccgagatcacgccactgcactccagcctgagcgacagagagagactccatctcaaaaataaataaataaataaaaactctactttacctattcagtgttcttttcttttatcccattctggcattttctgaagggttgcagagagcactggttgaagcctatcctgaagctaccttggtagaggagttaattgcaccaggagacctaatttcagaaaggtcacagattatattccaccctccacaaaagtaacctggaagatgagtaagtcctgtcctaaattttagtaccaaaaacagtgtttgctcaaagaaaaaatagtctagtagagaaaagcacaccctttggggtcagaccaccaggaatcacatacaaactctgaacctgaattttcttatctacacgaaggcagcatggctgtgagaacatgcagtgattttataaaactcctggcccataggtggcaggtattaataggaaatagctacgtaaatatacttcttctggacttaggtactgtttttgcattggtcacctctgcttttgagtctcactcaagaaatctttgcccagaccaatgtcctggagagtttccccaacattttcttctagtattttcatagtttcaggtcttagctttaaatcttccatccattttgatttaatttttgtatatggcaagagttaggggtccagtttcattcttttgcatatggctatctagttttcccagcaccatttattgaagacattgtccttaccccaatgtatgctcttagcccctttgttgaaaatgagtttactgtaaatgcatagatttctttctggattttctctttttttttccattggtccgtgtgtcttgtttttatgcaagtcctatgctgttttggttattatagctttgtagtataatctgaactcaggtaatgtgatttctccagttttgttccttttgctcaggatggctttggttattctgggtcttttgtggtttcatataaattttagaattttttcttctatctctgaagaatgtcattggtattttgatagggattgcatggaatctgtagattgctttgagcagtatggagatttttaacaattttaattctttgaatccatggccaacttgcttggatttggacttgctgtgccccctcacaaccctgagctagttacttgcccaccccaagcctccgcagctcatccttaaagggggttacgatgatatctgcctccctctttgagttgctatcagaattcagtgaggacatgcagatgagagttttaacaatatctgggcccctagtaagcactgacaaatgttaattattattgttacttgtaaaatgggcatgattatcccccactacctacctctgaggcacctatcgaacaccagagattttgtgtgttcgaaagactgtgcacacattattttaaaaagtacagaggacactgtcaatagcagtcattaacagggtggcaataaggaaatcctattgctgcctgaatggtgtgtccttgaacagtgcagaaactccctttgctgatacatctccaaggggcagggggtggggatacatcacaggaagtacctgctgccactgcaactcccatctaattttgcgacagtcacgaaatgcgtcacctactgcatgcaactgactgcgtcacatgagaggaagttggttttctgcaaagggtaacaactcaccggatcaggtcacacgggcgggtggacgcagagctccgactagccgcaagtccagcgctcttttgtgctgcttctttgtggaaggaaatgtgaagaaaacccagcgtcaccctgtaaaccagacaaaatacaaaacagtggagaagcccagagaaggcaaaacagattccggatatttctcttttaaaagtaaaatggcatcatggaagaaatttggccttccgaaagtggaggataaagtcatgttcaaggggaagaacagcaatacagcatctgcggcttagacatacagagctcgtctgtaatttggagtaagataggagtgggggcggagagggggaaggccatgccctttcagagattctgagaaactccaaccataaaagtccatgacaactcaagtgcagtacccgtgaccccatgtttgtcaggtaacaagctgggttttgacttttattttgctgcttctaactctggctgggcgccatgggagaagggcgggcagatcactctattgaatactccaggggacagtgttgcagactgggacccacccttcactagctgggtgacctgggacaatccccgtctccccatggacctcagtttccgtatctgtaaaatgaagtggatacaattctattcattcatttatataacaaatatttattcagcaacttatatgttgggcattgttctccctattggggattcagtgattttcagaacggagaaatgtctccctcctggagctcacgttggcatagatggctggcaagacagcttcccaccctcattggaaatgtgtccctctgcccgctccatggtgcctcatgccccaccacactgcctacctgctagacttttggcaaactggaccaccagttgtctggagattggaaagagcctacttttttgttgtaatccttctgttcctttttcccccttttaatgtaaatgttattaaaacataacatccacatagaaagtgcacatactgataaattttcaccaacagaaacacacatgtaaccagcacccacaccaagaaacaaaatatgactcacactgaagaaagaccccatgtccctctggtctctgatctccaccgtagggaaaaccatctccagatttctgatcctaggtattagttttgttctttttaactttgtctttgtatatacccttttgtatgtcagttctttcactcattgttatatttgtgaggtttattcatgttgcttcacattgtggtggtttgtttattctcgtatagtatttcattagacgaacgttcaacaatgtgtgcatttgactgtgaatggacgtacagattattttctgctggaggccatcgctgaatggtattgctgtgacgtgtggacctatcttagtgaacgtgtttgcttttcccaggggagttgctgtggcataggttatgtatacattccatttcagtacattctgctggttttccacaatgggtgtacaaagtaggttcccaccagcaatgtttgataatccagggagctgaacattttgcatcttttacgctgtagccattctggtaagtgtgtactggtatcacatggtgattttaatttgcatttttctggcatctaataaaatttgccaggggaccctgttccacttaaacatgacaattaaacagagccgtctgtccacgccaggtcttttcttcaaggatactgcagttttcttaggcatcccccgctttcacactagtagtaaaatgaagagacgttactatacacacttcttccacagcccctgactctggaactttatatttcaccagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtgggtgtgtgggcatgggctcatctttccggttccctttcatcttctcctatttgtatcagacatttatgggagaaatgctgcacctacctactgtggcagacagcccctctgaaggcaaggttcctgtattcaggggaaagggttatgcggaaatcaagaatgttcagtctaaggccccaccacgtgtattagctgatgcggggctttgaccaaagggctaagaatccaggggaaccttggctttgatgggagctgaatgttaccaggaggctcacctgttgcgggcaggtggcactgttagcctcccctttgagtttgcttcagttcatttaaattgtggccttggaaggcattgtatatacttggagtgtttctgctgcagctggcaccagtacatttagcacccggcccactggcgcccgcatgtagtattcagccaggggatgctcacctgtggattcattgcttgattcccacaggtatgggcgttcgaaacggaacagacaaagatgccgaggcgctcttcaagtgcttccgaagcctgggttttgacgtgattgtctataatgactgctcttgtgccaagatgcaagatctgcttaaaaaaggtgagtgctgccaggagtggtggctcatgcctgcaatcccagaactttgggaggccaaggtgggaggatcacttgaacccaggagtgcaagactagcctgggcaaaatggcaacaccctatcttgaaatttttttttttttttaagtagccaggcatgatggcatgtgcctgtagtcccagctacttgagaggctgaggtggaaggattgcttgagcctaggaggttaagggtgcagtgagccatgataacaccattgcactccagcctgggtgacagagtgaggccctgtcacaaaaaaagaaaagttgagcccttaccgcccctccatctatcttcttcctgtacccaagggaggcgatccgcccaccatggccaggcccatctcagaaggatgcctgtgcagggcagaggaatttcagtgtgagaaacctccctccctcttgaccagtccatacctgtcctggagtaggcaggtttccttgaggagccttcaatctctttgtaaaatgatgaaatcagcttaaagtccagcaaaagaaatagattatttgtatacagaatggtcacaatttcaaaagactcattcctgggaagtaacaaatctgtgtcatcctttctagaatgaagtgtaagcgtaaacttttcccttgtggcagatagagaataataattccatatactttagaactatgttattttttatatagcatgttcacaaaattatttcattagatctttaacagaagccctgcaatgttgggcaacagaatattatgctcattttataaatataggggtgggccacgtgtggtgtctcacacctgtaatcccagcagtttgggaggccaaggcaggaggattgcttgaggccaggagttcgagaccagcctggccaacatgatgaaaccccgtctctacttaaaaatacaaaaattagctaagtgtggcgacacacacctgtaatcacagctactcgggaggctgaggcatgagaatcacttgaacccgggaacccaggaggcagaggttgcagtgagccaagatggcaccactgcactgcagcctgggtgacagagcaggactctgtctcaaaaaaaaataataataataaaataaaaaataaaataaaagaaggggtggagcttcagagaggaagaaagatacactgaagggtgcagttagtaggggcagaaccgaaacccacgctctggtcttctaactccaggacaaatgcgtttcctattacacgaccctctctaatggatgccacctaaggtattctggcatttagggcaagtgtttgaaagtaacatcctatcaattcactagacacagacccacaggaagtagataggaacacaatctaaatcactgctatttttcttaacctcacagctaaaacaaaaaaagtccccaccatctttttttttttttaaaactaggcatttttcctaatttcctccaacttgactcttacaagctgaccttttgtaccctagtaggttatgtcctagaccagactagaaatcaggagtctgagatctgggtctggcccaagttctaacaggcaacccaggcaaggcaaccacatcatcctgatttttttgctttcctgaaaggcagattatgataccagctcctgctgtttcttggggatggagtgaggaagcctgtgagccaagaggaattttgtgagcgtgcttcgagaagtataatggcccagataggcatatgaacttgtcccaattgtagtttctgtttggtttttgtttgtttgttttgttttgttttgtttgagacggagtctcactctgtcgcccaggcttgagtgcagtggtgcaatctcggctcactgcaacctccacctcccgggttcaagcaattctcctgcctcagcctcccaggtagctggcattacagatgcgtgccaccatgcctggctaattttttttttttttttttagtagagatggggtattaccatgctggccaggctggtctcaaactcatgacctcatgatccgcctgccttggcctcccaaagtgctgggattacaggcgtgagccactgcgcccggccgtttctgttcttttgaaaggtgattcattctgcccaagtccagagcatgtcacaatcagagaattcttgcttattgtcctatcaaactagtaaagcacttattttttctgactttacatgcagtcagttccagtgaagacaaaactcccattttctaactgtcctaatttgtgtactcttaaaataagctaagaactccagctttcatcaccatcaccttgtacctctactgtcaaaactaatacaagaatcactggggagataatgcaaagtgtcttggtaattcgaatgggagaggccactcttactctgcctggaactggtgaggtagctggactttgcagtgtcctgggcttgaaaaacggccccaaggctccaacgtgttctaccacctttggggaaggttatgagacctctccgagattccatttttttaaatcagtgaaataaagataaatgaggcctacttccagtcttgtaggaattaaaaataactcatgtaaagtacctagatcagtgtctgcacatagtatttgctcaagaaattctaaatattattccttcccccctcattaatcatagagaagaagaaaggatatgtgtattagctagttataggttggtgcaaaagtaattgcggtttttggcattaaaagtaatggttagttcacctatagctggttagttagtatcatagaacctttggtgagttctagctgggccaactagctacatggtttatgattcctctcctcagtatcctaaatggacagccaagctagtatttttatttatttttctttaattttgtttaattgtggtaaaatacacataacgtaaaattaccatcataaccatttttaaatgtatagatcagaatgacttcacatggttgtgtcaccatcaccaccatccatctcaggctttctttcatcttccgtaactgaaactttatctccattaaacactaactggctatttccccttccctccagcccctggcaaccaccgttctatattctgtgatcttgactactcagggtacctcctgaaagtggaatcatgcgatgcttgccctttagtgactggcttattgcacttagcgtaatattttattctctttaacaaacacttgcatgatgcttattatgtggcgtgttttacaaatattaactcatttaatgagttaatattgatcttcaatgtacagataaggaaatcaaggcacaaaatggttcagtaacattcctgatgtcacagaactagccaacagcagggccacacacatcagcccccatacactgtacctatccctctctcttaacgtcttagataagtctgatcctttgaaaggagcccagtccccagctcctcccctcccctcccttgtaaccctctaatagtcagaggcagctgccaggctgcctctgaaaatgctgcatctgaggctccccagaacttagaccttaattcttcaatgttcgtattatttgcttgcagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggtaatctcttttcaatgccaatacacttgaaaatgggaaagattgcagagtgacggggatggcatcatttttacaaatccaaatgctgcttccatattcaaattagggttttatttttctgggaaagattacagagtgacggggatggcatcatttttacaaatccaaatgctgcttccatattcaaattagggttttatttttctatctctgaatggttagcatatgtgtttccactggatcacaaattatgaaggtttctttttttttttctttgagatggaatcttgctctgtcacccaggctggagtgcagcggcgtgatctcggaagactgcaacctccacctcccaggttcaagcaatactcctgcctcagcctcctgagtagctgggattacaggcacgcaccaccacgcctggctaatttttgtatttttagaagagaggggtttcgccatgttggccaggctggtctcaaactcctggcgtcaagtgatccacccacctcaggctcccaaagtgctgggattacaggtgtgagcctccacacccagccacaaattatgaaggtttctttaagacattgcaatacttttatttgctttgcttagtcatttgaaacacattcattcatttatcttttcatcaaattatcattgagctcctaagtatgccaggcacagttctaggtatcaggacacagcagtgaacagcacgtacatttctgttcccaactgcatagaatgatgtctgctttgatatttaggcttgccgagggaccgagcttgatgatggcatccaggccgactcggggcccatcaatgacacagatgctaatcctcgatacaagatcccagtggaagctgacttcctcttcgcctattccacggttccaggtatcatgtccattgtctgccaagcatacttcagtccattccatcatcaaaacacagatttggggactgtattcgtttcctcttgctgcagtaatacattactacaaacacagtggcttaaaatacacaaatgtattatcttgcagttctggaggtcagaattccaaaataggttggcagggctacgttccttttggaggctcaagggaaaatccatttcccagcctttacgtggcatgttagaaccacctgcattccttggctgtggccccttccttcatcttcaaagccagcaactttgcatctctctgacccttctgtcgtttaccgtgctctctttctgaccacagctgagaaaggacacctgtgattagatggaacccacctggatgctccaggatcatctccccatgtcagtccgatacccttaaccacatctgcaaagtcctttcttccacataaggtttcatgttcataggttccagggttagggcgtggacatctttgggcaccattattctgcctaccacagaaatgcattcacttttctctccaggaaagctgaattctctcatttgttattattattattgttttagtagttataaggacaaacatttctgtagtactttgcaatatagagtatctttcatgtgttttttctcatatacaataataccgtaagtatttaggaaaggtgttattcctgtcctgattttacaggtaaaataaaagaatttttagtttggatgaatctaagtgatatgcctaaggtcaggtagagatttcagtgcacagtagagctgtgagtcagccaaggttcctttacacggcagcctgtacacagataccagaaaacgccagcaatgggcaagcctactcactatttaccaagcactacatttgactgaatctgttcaatgaaagtccttcctttgttttgggtacaaaccagcactaagttagaattttcccagctgtaatagtagttgtgtcaagtatttggcacaagggtactggttacagtaaataggttgatgtgtttggaaaaccagctctggcaggatctacagatgagattttgtgagagcgataacttcacaagttttaaggatggcataagatcgaaaataatttggtctttctgctcttgagagggaggtggtgtaatgggggcatatgtctgtgtaaacaaacccagtggtagagttgtagttgctctgagcaaggaggcagttgagaaaagctatgttaaaaaggagctgctgggccgggcacggtggctcacatctgtaatcccagcactttgggaggccagggcaggtggatctcaaggtcaggagattgagaccatcctggctaacacagtgaaaccccatctctactaaaaatacaaaaaaaaaaaaaaatagctgggcatggtggtgggcgcctgtaatcccagctactcgggaggctgaggcaggagaatggcgtgaacttgggaggcggagcttgcagtgagccaagatcgcaccactgcactccagcctgggcaacagagcaagactccgtctcaaaaaaaaaaaaaaaaaaaaaggagctgctataactgagcctaaaatttcaaacaacataggtaaaagaaggatggcttgtcagacggagtgctgaggggctggatagcccagtgcatttggtaaaactcggggctggatctcagggtatatcagtcttcttgggctgctatagcaaaataccttagacaaggtggcttaaacaacagacatttatttctctaagttatggatgctgggaagtccaagatcaaggtgccggctaagttgctttctggtgagggctccctttctagctcataaatggtcacgttcttgctatagcctcatatggcagagattgagagcaagactgagtgaggtctgttgtgtctcttcttataaggacaccaatcctcttggatcagagccctaccctagtgacctcattggaccttaattacctccataaagaccctgcctctaaacacagtcacattatggggtgcggcttcaataaatgaattttgggaagacatagttcagtccatagcaagggatatgacagggcatggccagggtcaaaccaggacaggtaggcaggtggccctgtcatggtggaacctgtgtgctatgtcaagcagcctgaactttactcagataaagtggcgcaagggaacggttttaggttagggagttataggatgagatttgccctcccgggtcatcaggctctcctggccctgcccctcagacaattgggcattcagcttccttgtgcctctagatttcttcagcaaggtccaactctactcctatgtatcccagcagcaggaacacatctcagaattccttgaggttctctgcaaattccttctctagtaggcttggattaggaagtagcactgacccctaaaggatagtgaggagttccagagttatggaatagacctccagcatttcctttggaagtctgcacatgcagatctgtctcacacccacgtatctgatatttatcaggtgggtacgtccatcaaaactgacacaagagagtaccctggcaacatccaccaatgctggcccttagtgatgctgtctgtcatgggatttccatgctgaaatactcaaagcattttctagcatcttcatgccagccgttaaatctcagatgtttgctctctgagcacaccagcataattctcattaatgacttgtgtgcagagtagagtgaaatagtttctgaaaagcaggtgtgaaagtgccatatactcattctcattggtgagtggagcagctgtcagaattagctgatttggtcgtctcctttctttcctgttgaaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaaccag

SEQ ID NO: 93 - DNA, 4240 bp, Homo sapiens
gacgatacgccgggcgcaggcgcagaagccgcgcccgtccgcggcgccgccagccagggcggaaacggctgcggcttcgctagggacgcatgcgcgggtcccttagttttcgcgagataacggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcacggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaaggtgggcgcggggccgggccgggggagccagggcctggtcgcccggctgtaggtgctgcgaggctcctccggttggcctccaggcgcctcccctttgccgggtttgatttgcgtgggttttctccgtacagccctggttttgcagatgggagagccagaaacgcagaaaagttaacttattcgaggttgcagggcgtggacacgcacagtcctttttcctccacccacttctgcccgggtaaattagaaaactcactgaagaaaagatgagtcagagaaggtgtgggggaggggcagaggttgggtgagcctgcctcgcatcatttcctttctgtctcggaatatgcttttcacggctgtctgagagtaatactagcattcagtaactcctacccaggggcttacagtgtgccgcttacccttgtaactgccaaatacaattttcgcagtagccctgtggcttagatactgttagctatcactgttcccattttacagaggacaggactgtggctcacaggttaagtggctttgtcgaaatgcgcagccgataactgacggagctaggcttgagccaagcagtccggcctccggatgggtagtgttagccactacactgcctctctggtcaagttcattgtggagtggcttcctgtcctgctctcggtcactccctctccaccctcgcctgtggattgcagcagcttccaggataaaaaagaaaccctgagtacagcagagtttctcagccctaccccccttgttctcagagtcgggagaggcttgggagtgctctggggacgcctctcagaggcttcaagctgtagcttggaatcagccattcagtcaccaatcagatagggcctaaatgtgtcaccatgggtttcactctgtaaagactggtgcctgttggggacaggatggacagaacagctctctgcctgagagcagtcaagtccagattttaaaaaaaatcagtactgaacaaacaaaacaggacgtagaaaaatcgggttttatggatatttaatgtctggaaaaacactgataaattgcattttaaaggcggtctacgaaacatagctgacatttgagatgtatgtgtgcttggttttatttatatcgtcatgtagttactgtgtgctgggaaaagtacaccagaaggtgagcggtgggtatggacaggttggtagcgggcgactctgccttcctccccagaagttcagcatagcggttaagggtcgactctggcaccacactcttagggtttcagaacatggctctgccatcgtctagctacacgatctcaggaatgtccattagcttccctgtgcctcaatttcctcatctgtacagtcatggtaacacagtgcccagcccacagggctgtcagagctgcgggagctggtacacctgccaacggtgtctcagaattgccagtagtccaagcagcaccctgtcctgcctctcctttcctctcttcacattccagaagcggccttttatggtcttgtgaccagctccctgatctcagtggtgacgtcagcagatgaggagtatggtagccagggactgaagactggtggtcactcggggcagctttctaaataacaattggagtgcctactagtttcctgtgattgccataacaaatgatcacaaatctggtggcctgaagcaatagaaatctaccccctcaatctggaggccagaaatctgaataagcagggtgccacagaccggcacaccctcggaatgctgttggggaggctccttccgggtctcgtccgctttgtggtggctccaggcattctttgacttgtggccgcttcactccaggctcacacggccttccctgtgtgtctcctgcaaggatacctatcattggtgcatccaggtcatccaggatgatctcctctcaagaccctcagcttacctttgcaaagatgctttttccaaagaacattcatggtttcagcaatttcacgtgaacataccttggggtgacatcgttcagcctgctgtagggcaggatgtgggatcaaccctattttcttccctcccacaactccccagcccctccctcagtgtctcctgctctaagtaggtagctccactacaacttcctttggcacttgagtcttcagtgggccacgcctcctaggacagtattagagagcagggggtttggctgaggtggaatcaggccactcttgggcatttggtgcagcccctttgctgccaggcgactctagcctctacagaggacctcgtgtaggcacctctgtccactcagcacttggcgtctgtgctgaaaagccctagggaggattgtggggtcgcttgtctccaaacctatggtaaaccgttctgttctttccttcccagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccttggaggccaccgggacagacctggacactagggtcaggcggggtgctgtggtggggagaggcatggctggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatactacaaaaaattttctattcct

SEQ ID NO: 94 - DNA, 25255 bp, Homo sapiens
cctacccgcgcgcaggccaagttgctgaatcaatggagccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggtgagccctctcctgcccgggtggaggcttaccccgtcttagtcccggggataggcaaagtggggcgggcgcgggacgcgtgcgggattgcggcggcagcggcgcacgcgggcacctgggagcggcgggctgctgcgggaggcgttggagactggctcccgggggctgttaggaccttccctcaggcccgggtgctcagaacgctggaggacttgcttttcttgggccttgatgcgaagtgctgaccccgctgggcaggcggggcagctccggcgctcctcggagaccactgcgctccacgttgaggtgggcgtggggtgcggacaggaattgaagcggaagtctgggaagctttagggtcgctggagggggaccccggttggagagaggagcggaactcctggacaagccctgacaagccaagccaaaggtccgctccggcgcgggtgggtgagtgcgcgccgccccgcgggggcggggagagagcctgcagccttcagaacagatattgctcattttctggcagttctcagacgtaggaaataagtcagcaccgaagcagtggttaagccggagggctcggaagaacggcaccttttctttctcgaaaaagttatatgggggctgaatgagcttctggaggcttgtttaccgttttttattgtcacacagaaaaagaaactgccttgtctcccttccgggaattctctctttaagactgtaagtcgctgcctgagtggtttcattttgttttgtttttctgcccttctctttcttcttttgccctttcttagcttgcactcccatggtgatttctgcttggtctcctgctggggttggtggtactcgttcccaccgcacagaacccggcgcctattattggccaagaaacttgagcagcctgttttgaaaagtccctcgctcagaaatgccagcttgcagatggctaatcaaagagacgtggatccaggaggctcatttgagtaccggagcctctgagagtccatggatttttattttattgggccccaacaaagtgccaggcatagcgagagaagtgtttacaaatgtgatctccgcggattctcacgagagccatgtagtggggaagataaccacatccccattttacagatggcgaaatgaggttcagagagcttcagtaattcagccaagatcacacagctagtaaatgggagatatgggattgaactcagatctaattccaaaactcaggctgttcgctgattgcatctgatatccagattacaccaagaggctgagatgtctgggtccattttatgattagaaaaaaaaatcctgttcctttcagaaatagtgtgcactatttgggattctttagaaacttccttggagaaaattaatgattcaagattgagaaaacatttatacaacctcaggccacactcttctctctcttgttattaaccattgcaccactgcaatgttggctgctttgaaaatctcatagtttttggacagcagtattagtaaagtgtaagaaaattgtcaaagcttggagctatgcttgttgaacttttgtaccaatagcacctttaccagaggctgcgtgtttaaagcccgaagaaaactttgcttttctgaaagaatacacacacacacgcatatgtaaatattcatacatttatgtatatatacatattataatacctataagttaggtataacttatatttgtatatgatatatggcctaggaaattaaggcttattaaataaaatttataaatgcagatgagtcaaatacaaagatcagacataactctatcacctaagtaatcattgtttacgttttgcagtttatcttccatttctcccctctaatatgactcttttaaatttagttacacagaaattggttttgcgctcacgacatgcctaacatcaggcctttatccttaaagaagtttcaacactcttgtgtcacctcatgtgtctacagaaaatgtttgcttttatgccttcacggttatgttttcttagtagtagcaataaataaaatagatgcaaagtgctaattacttggaatacagaagcaaattttaattctattaatgggctggacatagatgggtggggagctgttttctgcttttcccctcttcccctagtcctctgactctggtgataactatagtcaacaagtatccccatccttaaccccttttgcttctctttctctttccttctctcaaccttcctggtgttagttttctctttcctatttctgagtgtttttactccgacacttacaataaaaaagtttgaaatcccaaaaagttgacaaatttctaaaggagacagaaaaagagtcaaacttactttacaaattaatttgagaaatagctgtgggttgcattttttttttttattgtgcatgaccctgttattggccaagaaacttgagcagcctgttttggaaagtccctcgctcagaaatgccagcttgctaattgaagggatgtggatccatgaggctcatttgaattccgaagcctctaagagtccatggatttttattttattgggccccaacaggttttgtcttgcattatttaggacattggccaggcaatcactggacagccagtttgctctcctttacattttgtagaatggttatcttatggtcaaaggaaagggagagggcctttggaaaataaagctgtgtatttacaagcagtcatacagaatagttttgtggggaaaataaagaacagttatttaatttgtaatttaatcatttttcttaaaccaacccaaagagcataaaatggaatatttatttatttttgtagcttaatttgtaatttaataatttttcttaagccaacctaacgaacatattgggctgtttattttcatttttaatgggccatatttacatcacaaaggacttgagaagtcttacaaatacaataaaatgataaaatatgaattaagacattagcaaccaggatggaaaaacacaaatttgtaaatgatggccaggtttgcaagcaaaaattaaattgataaatggcagcacccccactaccagctatagttagactgatgaaaaatcctctaatgttcatgcctgaaatacagttaccacccttagcagcaaattagaggcaaagaagttctggaatttggacgttgtctctgagtaagctctttgagacactggacaagtaatttccttctgaatactcttatactgacacataggagaagtgtcagtgtttcaaaggaatctctttgaaggctactacattgctttaggggtgccagattaccagagtaaactgccagtttgagagaataactgtttcttaagagatggtctgaaacctaagtaaggaaatccccccacttgaaagcccctaggaagttaattgcttttggcaaattatcttgggccccaaaagtcccttgatgagcacatgttttgtaataggtactaaagactatttacttatgatgaaaaataaaataacacaatttaaaacttgaaattgataaaaagcaacttgaaaccaaatttaggacagtgaacccatccctttcttatttttaaataggtaaatatagaaaaaatgaccacatgatgtgaaacaaaaagcaaatatttaaaaactacatttatactttatctcaccacactaatgtaaagaattttgattttacttataaattcttagccttgtctacacatatacataattgcatgtttaatttgagctatatatagtctgttttttgttcctttgcatgttacacaaacctttttctatttctacataatttttatctcatattttttattggatacattatagagagagcatttattaaatgagctgggattactataatttttattatttattttttaatttattacttatttttataatttactattgaaaaaaagcatttcttaaatgtactgggatacatatatatatatgactttttcttgttactaaaaaattactcatagaacttacatattaaaattttaggacttgtgatgaaaaataataaaataattcaaaacgataaaaagcaacataattttatatgttgtaccttgtacttccttataaggtacaacactacaatagccttagtgtgtagttttctttttgctatgtatgtatatatatattcataaaagtggaaaaataacatttaataaatcctctttattttctggaaaatccttgctttaaaaaaagtctttagctttttatatagttctacttctaacaccaattaaatatcttcaattcagtctcaagcaggaacaaatcttcagtccacttgcctacctttactgtctttgaagtgacagtgtgagtagtaaagcccaaatcagagagaaattgacttttgtaagattggtaacttcaccttccccggaaggaaatgaggtggttcttccctttgatcacaactgctttcttgatttgaaataaactgttgtacagcccagtcaccccatctttagacatttagaaatggcaatcatagttatataggacaactagcctgagtcccactaagtagaaatgatagtgaatttagtataagattatacctttaggctgggcaggtgactcacacctgtcacccagcacttcaggaggccaaggtgggtggatcatggatcacttgagattaggagtttgagaccagcctggccaacatggcaaaaacccaactctactgaaaatacacaaattagctgggtgtggtggcgtgcctgttatctcagctactcgggaggtcgcggcaggagaatcactggaacctgggaggtggaagttgcagtgagccaagatcatgccactgcactccaggctgggcgacagagtgagactccgtctacaaagaaaacaaagaaacaaaaaatcatacctttagagcaaggccagccttgtgaattagcaaatctgactacaaattcaatcagcagatgtactcagcccagcaaagtgagcaagcttactataggttgtgttaaggcatggactgggataaactggcaaaattagagtaaatttgacaatttgacattggattcattaatgatagcctgtccttcaatgaagtcaggcagcattgtgtttctattcacctctgtgttttgtgaggctataaaaatataagatatgagaaatgtgaatactttttatttgtgagggcagatatcttgaaaaagagagcgagaggaagtcagagtatgcgggtgaagactcttgtttttttgctgaggatttagctttggtttttagccattctcacagagatcattggtcctaattaactggttgttgttgttttttttcatgtgaatgtctgtaaggtttcaggcttgattttaaaaattgggcctatactcacagaaagacaaatactgcatgatctcgtttatatgtggaatctaaaagttttgaatccataaaagtagagagtagaatagtggttaccagaggctagttgggggcaaagttgggggatttagggagatattggtcaaaggatacaaaatttcagttaggaggaataagttcaagagatctagtgtacaacttgatgtctatagctaataacaatgtattgtatacttgaaaattactaagagtagattttaagtgttctcgccacacacacacaaaagaaaatgataagtatgtgaaggaatgcccaatgtaattagctcgatttagctaattatcttccaaaatatgtacataattatcttccaaaatatgtacataattcaagacatcatgttatataccataaatatatataatttttttatttgtcgaataaaaataatacaaaaaaaccctgggcctatactgcccacaggtagtggccacaggcagagctggtcccaagcccctccctctctctgtagtcccttatcccaggttgctttattcttgtatgacccacgtggcccctctgggcttgtaagggctctggggctgtattttaggactctatagcccttacattacccatttcctctaccaaaggtcatttctcttatcttcaagcttatttttggaagggtcattatttcttcatgagaagtcaaattctgatttgcaagtgctgaacacagatgccattagtctataaaactcttatattctcacatgtaaatgtagtaacctgctaacctcagattctgcttcctctaacctagttgccctgcaactgtgatgaacctcaaaatcaccaagggtacttccccattctcagagatcctgattccttaggtctatgtaggggccttagcactttttattaaataatgcatcactacaggattctgatgtctgtcggggtcttgagaactatttttctgactctagcactaaactcaaaatgtaatttcagatggaatttcctaggctcattcattttattttatttatggcttggccagtcatggatctaatcagtaacttgcaactgttgcttcaactacctctgtcctggactttccagagattggctttaagaaagaaagaggacatccctgggataagattaccatgtgtatttttatgtacagattttgaaaaacatacaaatgaatgggatctttgcttatctcttccatgtagaaaaatttattttacttctatttcaggttttcaataatgtagtaggacaagatgacatcactatatccctgttttttacacagatatattagagatgcattatcttattggaaattttaaactattcaataataaactattagtcttttagaatttctttttcctcaagtgttgataagtaactgaaagtctacaagcagacaagcagaattagtcggtggaacttcatttcttgctccatttttgtcctcagcagtagagggtggtgagatttcaacccagcctagcaggaccaataagtctggaaagaagtagctctagttcatattggcacctgctaattctagttctgaagaccatgggaaatctcttgcctatttagctcagtgatcatccaagatgggaaattcttgggctcagctgtgagggatcccaagtttatatgtaacactaatgtctcacaaatcaagaatccaagagaatcaagagactatagttcattccttatattaaattcttaggactgccaactgggtggctacagttttgggggctagaagtctgatatcaaggtgccaactggactggttccttctgaggaccacgagggcaggatctgttcaggcttgtagatggccttcttttccatgtgtcttcacattatcttcctctgtttgtatgtgtgtccaaatttcctcttctttttttttaatttagaaatttatactgtctacaagctttatatagctttagttaaaaaaaagcaaaaaaaaaaaaaaatcaaaacaaaaacagtgaagccaagacactcttccaaagtctggacccttccggccttccaaatacaagagctctggaagttgtatataccaaatttcctcttcttaaaatgtcaccagtcacattggattaaggcttaccctattaacaccattttaacttaatcacctctgtaaagaccctatctcctgatacagtcacattcggatgctcaggaagttagggtatcagtatcactatatgaatttgggagttgggggaggacacagtttagcccatgacagtcctgaatctcctttgctagatgcatgactgtgggccagtcacttcaccagttgggatactgccatctctatcagaaaaggggtttgggctaggtcatctataaagtcctttctgctctaaattgtaaatataatgagataccaacatttagtttaattgtttaaaattttagaagctaactggatgctttgctggtgtcaacactcccctttacaaaaaaaaattcggccgggcatggtggctcacgcctgtaatcccaacactttgggaggccgaggcaggcggatcacggggtcgagagattgagaccatctggccaacatggtgaaaccccgtctctactaaaaacacaaaaattagctgggcctggtggtgcacatctgtagtcccagctactcgggaagctgaggcaggagagtcacttgaacccgggaggcggagcttgcagtgagccgagatcgcgccactgcacctccagcctggcaacagagcgagactccgtctcaaaaaaataaataaataaataaaataaaataaaataaaataaaatctcactttctgtttctactgttctctcaagtacccctctgccttctgttacttctttgctgcattctgagaggaatggggtggggagcactctttcctgtagaaccccataacccatctattttcatcaatttatttgaaattcaaagccaggggttaaaatgtccactttcaatttgagatgtctaactttcagataaatctattaacatgcatttctaagtgacttttaagctaagcattttattttattgagctcgtatggaagggtaactattatacttgtataataaagtgcactttcaaaaatactcggttcaaatgtaaaataatattcgtaatattttaagacaaacctcctagaacttatatgtgtctttcttcccagagcagtctctatgggtgcctaaacaatactgcattattagatttttttcagtttataagccacacaagaaagttaacccatgtcatctctagaggcataaaaatagacagttgttctgagaaacatatctgtttattcctagttcagtaacagcgcaatgagatcctaaattatgaggtactttttgtttatcttattgtctcattggcaaccagcaactcctgttgcatttttgacatgggaatctatcagggtgtggttaataaagtacatttccatggtaagtattctttaagaaaaaataaaccaagatttcatcagagacagaaattactgcaaactgtacttaccagtttctggtgatttgtataactgagctttcaatttcaaaaattaaaaagttctctttagtgtaacatatttttgtgtccagtaattttacttcaaaaataaaagagaattttctttaccatcaaacaacgttgctgtaatgagtggtgatatatttagtcctagaggaccaaagagaaataaaatggctttgattatgctggtttaagaaaatatatccgatgaaacagaggttaatatttgtgatgtttgatttagtaaaattataagactaccaaagaaaactagaagagcaaaataaccaaaatttatataaagaattcaatgttgataattcaaaggtttagaattttttccacctttcaaatactaagttgctgttatagatttactaccattattacccagattttctattttactaaaaaataataacacagttcgttatgataaatcagtatagatctttaggctcaacacaaccctgctaccttttaaacttttttattatacaacaaacacatatgcattatcaagaaaagatgagtttagcaaaatgaagaaaaatagtcttatcaactagaaataagcaccattaaaatttctgtgtgttaaaagataatatgctgctgaaactttttttttcttgaaatgtccctcttttctttcacttttcattttcttaatccctaaccttctactgttgaattttctggaccaccgttataccccctcatcaatagggcatttttttctgcagtagctgagcacaatggtcatattgaagaaattcccttgtgggggctttgcctagaggtaaaatcctcttggccgggtgcgttggctcatgcctgtaatcccagcactttgggaagctgaggcgggagcatcttctgaggtcaggagtttgagattagcctggccaacgtggtgaaatgccgtctctactaaaaatacaaaaaattagccgtcatagtgtgcattcctgtaatcccacctactcgggaggctgaggcaggagaattgcttgaatgccggaggcagaggttgtagtgagccaagatctagattgtgccactgtgctccagcctgggtgacagagcaagactccgtctaaaacaaaacaaaacaaaacaacaacaacaaaaacaaagtaaaaccctcttcactgtgatgactctaaagcttgcttttgtctctctaaatcacaacaaaccgtttgcagtgtgatgctgtgctcaaaattgagaattctcactgactgttccaggcatctgtctactcattcttgccatgctgagggctgtcatttctcaccactgaatgcctttttttttttttttgtgcttctttttaaaagtcttttcctgtttgctttgaacttcaataaaaacagggggtaagaaggtaatatgcttttattttgtctgtggggtttttttcttccttcttttggttccttttcagatcctagctcatcaaggccatttgccacactgacactggaataagcctgaatgggggtctatatttcttccagtagttagtttaattcggtcattgagctgttgctctatttgtaaccgtcatgctagatccgagggctgactattcctgagaaagtgtggagatcctttcagactgccatggtgctagggcagagtttcagtcattatcttctgtgtctgctaattcttgcatcatttcttctactctgtaacctggttggctatgaaaagtgattcttcctcactgatgctgcaggcaatgggtgaatatccaattgttctctcaggttcttgtcatcggatacaaagaacaaatttcatgtgtccctgtttctgagaggttcaaagggagcaaatgcacagattctagcttaggatgacttccagcttctaactatttgtctgtgcattccatttcctcacccctgcgagaggttgcagtcatggtaacggctgttctgagaaattcagtgcccaaactggagggaggggaacacaaactcagcttcttcccaagcttcagggcagggctggcaagttttgccttccccgccagcaagagccctggctttaggggtcttgctacagttttcccagactggaggtcttggggctggattctggttcttagcgaattcttgccaaacacctcccctttccccagtatccatttgttttgaaggttctttgcaggcttcttgccaataattgtcttaaaacaaatggagttgtttgcatacctagatggagtaaaatatttaggaaactattctacaaatatgaaacagcccagatttgggccagaagtcctggtcctgagtctcttgttagccactcttaactgtgaattattggacaaatcatttctcgcactctgtgtaatctgtcacctgggtacttgatgatttaaaccaggaattgtggcccttctcataatactgtctcctaaatattgggtgaatttagtatatcaaggagggcagggcactatacccgtaggggactctctctctccctctgtctctttgcctttctcagatatgcatctttggtggcagacctggggttcaaaccacagttgttttgaaatttctctttccttctccactatgctccccctcactgaaactttaataataaaagtagcacacttattgggcatgtatttgttatgtgccaggttctgtgctaacagctttaagtgcattattccacgtattttcacaacaagcctgtgaggaagaggttatttccacttatagataaagaaactgagacttggagaatgtaagtgattttacccacaaacacagggcagtaagtgggaggccctgttcaccttagaacacctggcttctatcattcatggtgctgtttctagtgtggtttgaagaacctgagatccaaactgctatacaagtgacctgctgctttcttggagagagaaatctgaaagacagtggagccctcacattgtctttgcctgtgcacagcagatactgccaattttgggtgggttacacttgtttaccacgttgcttacttcagaaatcaataaaattctcttcatgcttttattttacaggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtatgttacacaaaacatccagagattacagtgaaagtcacagttaggagtagcacatagtaatcatgactataataattttacagtttttggttcccctatattatataacataactgagagaaaaacaactatgaaattattttccaaagatgagttttatttatatttatcacgcttatttgatgtggttatggataaatttaatttacaagtgacatgcacctctgaaatgagaagactggtctatttggctccatttttttctaagcaaaaatgactcatttgtgaatatgaaagcttatcatgtcaaaactgattaggatctaccataacaatagtggaactctgaaagcaagagacttctcctcttaagggatatgtctcagcacttcccttcaatcagaaggtctctaagaaagctgtcctggcactgaagcctgcaaaatatatttgcattttgcagctgaataactagacgaataagaaaagcaacaggcagaaaccaacagcttttttttttaaatcaatactttgaagggcaaactaatttcagatcacaaatccttcaaacactggtaaattagaagctaagcaaaatgcaattgtgcaaacatttcttcaactttgagtagagttgaaaaaaggaaaatagcacatgggttcatgtgatagattaatagaacaaaaaaggactgtagtatgtttcatggttgtcctcccaggcttccagcactcaagctgtaaaacaggatgggtcctgtttgtgaaaagattctaccagtctccctgtgcttcatgtccagattttaataaccgttatggaaaaatctcccctataacccaacccatttatacttaaacccatttacacttaaatcttctccaacacgaataaagaatggcgtcctggctttattataacctgctaaacacaatcaatttgctctatgaattgaaatctttgttcataattttaaaacctaaaatgtaaattaaaatgaacaaaatatgctttgcacatcaaactgtcaaggatttttgtctattgctttttcggttttgctttgttttattttaatttaagaagtgaatgtaaattgttacaaacttttaagaaatacatttggatatatgagtcaaaaatttgaaaaaaaattttttttaacttttttttcttattattatactttaagttttagggtacacatgcacaatctgcaggttagttacatatgtatacatgtgccatgctggtgcactgcacccactaactcgtcatctagcattaggtatatctcccaatgctatccctcccccctccccccaacccactgtttatacttgctaagatagcaattaatttatacgaaaataccctgagaaaataatcaaaaataaaggaaaatattgtacacatgatatttcattatcaatatgatgtaggattccttaggtaaattctggaatatttaaagactgaaatagtatgtatcaaagtcatgttttctgatatatttctaatataatcctcaattatataaaccttcttaagtaatttccaactgatctggctggattaactgattctccctgatccgtctataaaatatcctggatggcatccaaccatgttaaatactcttcccacttcaattccctcttgttgaattttaggcttatcaatatctaagttgcttccaaatctgtttatgctcattagtgttgtgatattcatatgtaatttgattgaatattgcataaattaatgaaatacaaatacagagaaaagacagattttatttctaagaaaactaggttgagtgctttggagaattcaataaagatgagctgctaaaatgttgttgatgaattttgtgagggaaaaataaaagttaagtagtaggaaaaatcacaaaaatctctaaagccattcatagagattattggtatgtttatgttttcctttcatcaaaaacgaagggagggagggagggagggagggaggagaaaaaaagaaagaaatgaaaaaggaagagaaaaatagacaaacaggaaattataggtgatgcattatggatgtgacttaagaaagaacctgggattataataacttctatatcacaaaattgtcaaatgattatatagttatattttataaattaaaacaaaatatttacagtatttttaagtgatttcctatgtaaattgacatttttgattaaatgatcaaagaagtcctccccacatcatcatattcaataagaaggattctatggtatactgcacacatatttcatatatacacattgtacatatatatatatacacacctgttatatatatgctcatgcatatacatgtatgtatgtattatatgcataggaatgcaacaaaataacggcaatatctccagattgttgatatatagttttttgtttgtttgtttgtctgtttttttgagatggagtctcactctgtagtccaggctgaagtgcagtggcatgatctcagctcactgcaacctctgccttctgggttcaagcaattctgcagcctcagcctcccaagtagctgggactacaggagcacaccacaacaccgggataattttttgtgtttttaatagaggcggggtttcaccatgttggtcagtctggtctcaaactcctgacctcaggtgatctgcctgccttggcctcccaatctgctgggattacagacatgacccactgtgcccggcctgatacataagttcttattatactttcctgccttttccaacatttctataataagcatatgtaccattatactaaaaaaagtattttaaaatctgattttcaataaaacaactacttattttcttattttaataaattttgttttcatactttggaggaacgaaagaacctgtggtttactgtatctccattataccaaggaagttgtgctaggcacattctgtaagataattcattaaagagaccaattcattcagagaccagtataataccactagcaaaaaataaaattatacttggacttgggttctgttttctttaaatattgctacaatgttatatagccctatgcactatttttgaattttgttctgggaatctccagtttgttttttactattgacagactattatctttacttactaaaatagcatatatatttacatgtcataatttgctcatgtagtaaatattttgttttatcaaaaagaatatatgaagttattaaggaattcatgttcctaggaaacacagcagaaattaattttgctgtataggtgagcagagcagattaaactgcttatatttttaaaactagttataccattaacaattagagtcactagtaatgtttttctcacacttcccttgatattttctgtcactttcttcttaattctctattcccttaccttcatctagctttccccatagcatttttttagcacttgatatcaatatatttatttgtgtattgtctgcctgcatcccaagaaggtgaagtctttggtgatgaagggtttatcttatttcctgcataatatcaaacttctaaaaagttcctaggactcaataggcatttaataaacacctatcagataaatgaattttttaagagaacacattacataatgctttctaatagcaatacagtgacaaactttatttttaagtaaattaatgcaaatatgtatattatttaaaattgtttgtttttaagataacaagcctgatagataataaattttggcataaatatgttaatgcttatcaaaactcatcagtacatatcctgtcttttgatgaaaaagtaatagaaaggggagaacaaagagaactctcatgctcactaggcaggccgagtgcagctctgacagcaatgcaagagaaatattactatctccatcatatgcaggatgaaatttaggcttggagaaaacaacacttcgttaaagattttatagctgctcaagatttgaccaaggcttttaaaacttcaaatgttcttttccttattacactgtttcttatcaggatttgtggactttggaaagtaaaatgaaaagtcagagcaatgtgagttagtttgataatctcagtggccagtaacagctatccccactctgaatatataccaaccaacctctcccctttctccaaggaagttagttcttggcaaaggcatttcatgcagtgtactttgtcattctaaccttcctttttttttgtatgctcctgttgctaatcatcctatttctatgggcttcagtcactcttttagcttttgtcttgggagactttctgtctgttgacatgacttttaaaataatcttctcccccattgtatttatatctcattagcctaccccccctccccttgtgttttagaagagttttattgtctgtcatccctctatagttcccaccctgttacctgcccgtgtcctgttcaaacacttgctccttttttccttgggcaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggtaagagtcttaaaatgcaattgaaagaggccaatcttggaatttcatgtagaaccatttataagacaatttgaaattggggcctactgtggtgctatgttgacacacaggaaagggaaggacaggtggctagggtaccgcagaaccaggtgccgagctaactactggtctagacctttatgagtaagtctaggcaattcttccagatataggagaatgagtaaatatgaaccctaggaacagggttcatcagctcaaatcaaaagctcagaaattattttttttctggccttgacttacgcttatataatggtgctcgttcatggccagaaaaattcagaagcctgcagatacaaggacacagaaatccaaaaggtaggtaggaatgctccccctttctttggggatttagtttgtcctgataattccatctggggacctgaattttcatggatatctcaatgtattctaaggacccagattgaagtataacagaagtgtttctagttttgtttgacatgaagaaacctctggacataaagcttttcccatccctattcagcctataaagcaatgtttctcatccctggcagtgcattagaattgcttagggagctactaaaaatgtttcatgtttaggtcccatctcagggcaattacatcagagtctctgagtgaggaccttggtattggcctgatggagtaagtctggggtagagcctaacattctacatttttaacaagctcccaggtgatgctcatgctgccagtccccaggtcaccctttgagtgttaaggctagagactagaggaacaggggagacgtctaagtattggtgaggtttgtcttggttgctgctaaatgattgctggccatttcaacctggggtttcctgttctgtgtttaaacactgactgtattactggtgtcatgctgtgactgttgatataagcagtggatctcaaaaatccatgcagctcctgcccaccattttcatagtctgcttataattagccgctataactaatagtttccaaactgattttctaggcttagaagtggaaataaactgcacccggacccagaataccaagtgcagatgtaaaccaaactttttttgtaactctactgtatgtgaacactgtgacccttgcaccaagtaagttttagtctttctctgattaaaacactagatataacatgagagttatcattttcctagggaagtaacactgactgagagttaagaattagggttctagtcctgctttgcctccaagcaactagatgactgtttgctcatttaaacactggtgaacttcctgtgtaggtgacactttgctggccacttaagctaaagatatgagccagacatatgcctggcatcaaggtatcagtccagaagcacagacagtcaaggaaagcaatggttattgtgtttcaacagcatgagaatagcatcagaagagacttatgttccaggtgttacaaattatacagaaaaacttttcaactctgcctgaggagatggaggtgaagacatgaatgtgtctcatgacttgaatcttgaagaaagaaaagaaagagcattaacaggtgcacatggatggaatgcacattataggcagggaaacagcagctgcaaagagacaaaggaagctcaggaaaacagaatacctggctggagtgtaggaaagactgagaagcgttcagggctgaatcatgaagggccttgtcttttaggctaaagaggttggttttgacccaaagttagagaacctgccttgtaagtcatcttgggaagcttttaggagttcatctaataggcttaagaaataagcacatgatgccttatgttttatttgctaggaaaattttatgtacagttgtcccaggctctcccctggccacaagtgtctgagagtgcccctatgatgacaggctaggtaggcattggggaagcagctgacttagtaaaataataacaataatagtaattccaaatatttcataatcttgatttaattttcttgtcatcataaccttttgaaatagataatattatttccatgttattgatgagataaaaggctcatggcagtgtgacttcccaagctcacctagtcaggtaatgggcagaggctgtgaactcagacaacctgattgtgaatgtttgtctgtctgaaggaaatcacacatgaacctcttgagtctcctgatcaccaccggttgctaaaagtggcagcctctaagggccagctgagtaccctccctgagctacatcatgggcgtggctatcacctggccattttcttggtctataggaattttttgaaattacttttgacagtttattttaagagctagtttaagctataggatttacgtgttcagtttattactaggtttaagtttatttttgtatccacttcatctctcttgtgtgtcactattttcctatcttcctttaactcttgaaatcttaagacagagtcattccttatgatatttttcatccagccatccaaattatattaacttgtgccagctttagatactaatttagaaatatttgaaggaatacgtttgccagagatgcaaagatgaataaaatggcccctaatttacaaagtgccattgaaaattataaaggaattattctgccaggcttttgaatttctcctgtatttttttttctagatgtgaacatggaatcatcaaggaatgcacactcaccagcaacaccaagtgcaaagaggaaggtaattatttttttacggttatattctcctttcccccaaccccatggaaagatgtgaagaaaaaccaatcactcttgattactagaaagtcctttatttaatcttaaagattgcttattttcatataaaatgtccaatgttccaacctacaggatccagatctaacttggggtggctttgtcttcttcttttgccaattccactaattgtttggggtaagttcttgctttgttcaaactgcagattgaaataacttgggaagtagttcacaaagatttgcctcattcttacctataaaaagctaccactttggtagatttatgtattgttaatttcttgcccctgaatgcagccttgagagctgactgataagaacaaatgaaattattcctcagctagtttctgagcaacagttttggggcattgagtggtattctcatccttcctatgaacaggtgttctctgcagcagcagaattggccaaaaatcagaagcaattcttcactattcattgagatctccctatgcaaaaagagaacacaagaagcaaaggcattcccaggaaacacattgcagggaacactttaaaaacttgtacttcactgcctcctcttcctcggcctaattgcttgtttttaattatttctccttcttaacttaaaatactatggggacacatgttatacaaaggtgacttagtagagtcagtagaaaagccaaaattagatattatcataattagtctagaaaaatccctttaagtcattcatcaactacagggtcacaccaactttcagtaacttagaagtattcaattttcccttctcagaacaattatctgtttcttcagttcagttgaagaagaaagtttgccttgcctttagcggttgtttagctgaaaatacatttgggatatttaagcactgtaattgtgctcagagacatacagattcttctatctcacattgactttaatgcatacacctattgagtatgtatgcttgagttatttgtgtgtgtatttcatttctgggcatccatagcaagttgatgttgacttgcttgtcctacggcttctgcatcctgccatagtcttgccgtccacatctttgctggacagagagtggtgcttgccatatggtaagtcaaaagccatctccttgctaggccagcctgtggtaattagatgactaattaagatatgtcctttcactagaacacttgacttagtagtacgaaagttccaaaatcagcggtctcctgcgatgtttggccacttttaagtttcactgaatttctcctttttccttcttatatttctcttagtgtgaaagtatgttctcacatgcattctacaaggctgagacctgagttgataaaatttctttgttctttcagtgaagagaaaggaagtacagaaaacatgcagaaagcacagaaaggaaaaccaaggttctcatgaatctccaactttaaatcctgtaggtattgaaataggtatcagctttccttgaaaagaaaaatagagaaattagtgatttggctttttgttacttccttttacttttttgtttcttgtttgtttcattttgtttgagatggagtcttgctccatagcccaggctggagtgcaggggtgcaatcatggctcactgcagcctcaaagtcctgggctcaagtgatcctcctgcctcaactgtgaccctgggactacaggcatgcaccaccatgccaggttaattttttatttttattttttatagagacagggttcactttgttgcccaggctggtctcaaacttttgacctcaagcaatccttctgcctcagcctcccaaagttctgggattataggtgtgagccatcacatccggcctgttactttctttatttaaacattgcttgtgtttgtgggtgcataggttaaaggggcctcacagatgaattatgatatggtacccaaattaaaagtaaacttgtacacaaaaaccgtaagaatcaacaaaggagggaattgagagtgtgctgaaaatgagctgaaaaaagaacttggccaacctccatgttccgtgttgttgttatccctgcagagaaacagcctttaccaggcatgggttcagtatccaagcctgagcaaagagattgctcttaaagtttgtcataagggcacagcttaactttctctggctgccggttgaccttatgtctcaccatatcttttcccaacatggtatcaatatatttcagatagcaagaaatacaccgagaaaagaaaccagttgcacttaatggaattattttcttatttggggccagggctcagtgggagttaggattctttaaattaatatggtaaaaaaaatttcaatttgagccattttctggtattaagaataagaatagttacagggaagaaaattttagagtagttatatttattatttattttaataagtctatatgaaaaataacctcaacctattttatgaattctttaggtttcttgcctttaaaaactaagacaatattgcttagtttctggcaaggccggaacctttcagaataaaaattgaatggtaaaagtaaccttcttaatcacttaatctagcttcctaattttatacatcaagcaactgattgtacttctttctgaattaaggaaaaattagaagttcacatttagaatattctaaagatatatttttatttgtctttctctgcttccattttttgctttctaggaaacagtggcaataaatttatctggtaaggcttttatcattttatttcatagagatggcatcctttagagtaataggccaatttcagagtaaaataatgttactaatttcagtgacatattatgggatcttgttatttctcatacaattctacctgctcagcataaagcatttatcaggcagtttgtttaaatttataatgaatactcatagttaaaaataatcaagtaacaataagacacaatagtctgaggcttaagaaacttttccttcataatcagctagatgtattacagaactcctgcctaaaaagatctagaggttaaagtgtactgtagactcaggtattatcagtgtacccaactctataacaacatacatgattccattcagttgttctttgatctgtgatttagagataagatgatcataaactctttgcttatacttttagatttgtgggtcattgatcattggatccataagagatgttataggtgatcttttccaatcctcttaatttataaatgagaaaagaagatacagaaatgttatgtattgtggcccaggttatttaacaaattactgggtatatggcaggatttggagttagaactcaaggttgtcttgtttctgtattcccctagtcagctcttcatagacctttaggacttagctatattctgaagtactataaaaagagaaataaacatggttttcactaatgggaatttcatttagaaaaacaaattttcagactattttctatttttcagatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggta

SEQ ID NO: 95 - DNA, 87641 bp, Homo sapiens
ggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcgggtgagtggtccccagcccgggctcggcggggcgccgggggtcttcctggggtccccgcctctccgctgcgcttgacagtcgggcccggcaacccggcccccgggcggaaacgaggaaagtttcccccgcgacactcacgcagcccgactcccgtagctgcagggattgtgagtttttcttgaaaaagagaaggaaagttcagttgcaaggggcgcggggcacgtttggtcccctttgtgcgagcaggaaaggcgttgtgttggccgcgttcgaggcgagcccccacccccggaaagggaagtttgagaagttggttatctgaaggcggccggggagcagcggcccggagcggcagcctgagctgccaaagcagccagcgcacctgggccactccgcccatggcgatgccgcgtgcccacccagctctttctgagccacccgttcaaaaggccagctcctcagtccttagctcctggagacggccacgctttccctcaggccggcttcttggcccggagtttttggaaacaagtttcaagaaaataatcgatttccaaaagaaagttagctggctccactgacgccttggcatggatggatagggagtggagatgctcaggtgaaaccgagaatccctcactgaatgcctactgggtgctagaggctgtagattttgcctggaacaagatagtcctgtcttcagggagttgatggttctatgcaattatcgtttgttggaaaccgaagggttaaaatcctaactaggctacccacctgatcgctgtctctgaaggtttttaaggaaaaaataaaaataaaaaaatatatatatatattatatatatataaatatatatataattatatatataaatatatataatattaatatatatatgcatgcaggaatgggggttcttaactatttgttatggaaagtgtaaaacctctgagacttcaaaagttagattttttttttttggagacggagtctcgctctgtcaccaggctggagtgcagtggcgcaatctcggctcactgcaactttgcctctgggttcaagcgattctcctgccttagcctcccgagtagctgggattacaggcgcgtgccaccacgcccagctaatttttgtatttttagtagagacggggtttcaccatattggccagggtggtctcgatctcttgacctcgtgatccgcccaccttggcctcccaaagtgctgggattacaggcgtgagccaccgcgcccggccaaaagttagactttttgcagctatgatccaaataacagtatctgcagctgtggtctgggtaaccgagtatttgggcaagtcatagagctttttctgggccttagtttcctcatctgtaaaatggccagcttgaatctgggtaattttacatcatcttcatgtttaacatcttacgtatcgtgcccctcccctcctttcccctggctcttctggtgacttggagatgacccatgtagactttggatgaaatgtagaggagttgacagtccacatcacccggaggcactcattttatttatccagggacatgggcagatttacctttaggtttgtctagaaaaaatgcgcatcacggtcagttgtaaattttagagtgtttgaagtggattgggaactttttaaaaattatggcatacattgaaggtggcatggagatggaagcttttaatcaaattaggaagaggcactattgcaagcaaaaagtcttgacacacatttgagtcctatggttttaataaaatcttagtgtttcgttcttggcgtttttcctgcattgcagtaccagaatgttcaattgtctctcattttcctccagacttttaaaacctaagtgacattttgctaataaatatttaaaatggcacccttaattttctgtggatgttaaaaatcattacaacttttgttccagattataaaagaaggaaattagcaggccctgatgttgttagttaggttctgtttacaaggataaggtttatgatttgcaaattccagacccaatagttcacgagtcactttcatttcatcaatatacacacttttaaacaattagcttaaaaacgtggtggctttttatttgggtatttagacagttttacaaggcccacagatttcatatttttatagaactgaagtttcaaaatggttgaattaatgaatcattttgaatttgtattcatttgattcaaattaaattttcaaagttggccaatggttgaagacagatatattgaagacgagaaacctaattctacttacattttaatttttcatgtaagtaaatagtttcagaatttctctaacgtaattggtaaactgaaaacattttttcaaaatatcttaatgcaagataatatatcaggtaatgagattgtttaataaacaacaagctccttttacgtcacctaaaaaggcccaaaaatctgtcttctgtttagtagcttctgtacttctgtttagtagtatgcaaaggatttaaataaaagaacaaatttcactaagaaatagaaagtttttttttcttcgtttttgacttaatagattcactcttcctaaatgatcaaaattaagaaatgactcttttggggaaaactgtaaagtgcacaataactcttcaggtctgaaaaatatgacttttcaggttcctggaagtagatagattcttattgaggacaaagaatttgtaaaagtgtcatagtgatcaggttcttcacatcactttaataacctgcttattttgtcagggtaagagactagacatcattaggccccaaatctgatcttcagtctactcgtgctttttttccgcctcataaaaacacatttccacctttaggccactcaacatcttatttttaatgagttatgatttatacaaaatactaatcacattttgaactcattgccttcttttcaatgtagcattccctaatgatgactgttgtctatgtagtcaacataactactacatgttttctactcagttatgaacatgactttttaattttttcagtaaggttagtttttaactctggatcaataaggcacctctgatatcattgcaaaaactgggcattttttcttctaccttttcaaccatatttattgagtatctcttgccaggcaggatgctcagacctgggataccatctcagatgaataagacagacctggtctttgccattgaatttaacagctgggagcatgttataagtaaagaaaaggatacgtgttttaactgtttatatttgaaagcattatggaatactggtgttttattttctacacctcattttcaaaagcctcatttttttttgttgttgtatgcactaggaggatgtgcatgttgaatgtttccttctaggtcccattgaatgtatttttgaatcaatttgttgtctctttcctatccctgccttgtcacggagccccagttgggcagcctttaattgcattctccattccatagccagcatgatggacccaatgcgttcatttagtgctctctttgaggataggctggtggtagaagagtgtagggtataaactttggaatcaggccgtcctgggttccagacccacttgccatgtactggctgtgtagcctgttgtagttgctttacctactagtcatccctggtctcatttgtaaaatgaggattatggagttatggtgaggattaaataaaatattgttttaaagtatttaacatggtgcctgcaacatagtaaatgctcaataaatatcagcttctgttattactattaactccttaattgggcttaccaggggcctctgacctggttcccatttgactctgctgcttcacatcccaccacagcccacattttcccagtctatttgtgtcactacacatacacacaatgtgagcaatttaggcagctgttcctttgttcaggatgtctggaactcctgctacctggctaattttcactcatcttttaagacgtagttcaagtgtcatcttcttgaggaaacctgctttgaatgtcccagtttgaggtaaatgtctcctatgagatacagacctctcacttagctggtaacaataccaagccaaagtcatatctttacgtaactctcttgcccattatacctttaatcctctcaatcttattcagttttctatctctgggatctctggcagtgcctgacacatcatttagcacccaggaagtgctgagctgagcctccacttcatcctactgtatctaatgcaactgaggtcgagcatttaactaagcagtcactgtttgttaggtgtttggtccaaatagtaaaatctttactttcagttagaatagttttagttctgatcacaataagtaatttgactgtttttgaagtatggaattggttcttgtattctcatgaaatatggaaaaagatgtttcaacttctgacaaacatgatggaaagctgctagaagttttcatgcaattcctttagccataaattttgaatcagtgtagggccttgaaagccactgcaaaattttaaataaagtcaccagaggaattatccagtagatactgattcctcttttttttttttttcatagaagggtgtcggaaagagaattttattacgaatgaagtgctaaaatctaaatttattttttaagtttcttttttcattgggttttatgttttggtttataagggtgaagcagcgttggttgaagggaagtgtggtcttgtagccaccactgcctactctagagtagcgtggatattatttaggtctgatgcaaaccaccaaagcagttttaaatagggtgcaggggaaacatacttcctggctacagcatggcattatttggccaagttccacataaaagcataactctgttaccttgttagcttctaccctccaggtccttatgtacaacttcagcagatttaagttatgattttcagtagaacagatatgcattcgcagcaagaatgctcaccgcttcttttgcactctctactttcctggtaatattttgctccacaggtacttgttgcttgtgactgaggcaagataatgactcatacttctttgcttggcatgccaaagggtttggaatgctggacaggcaaattgtctcatctcagggagaaggaagagaaagacaattaacatttgagaacctaccctgagacagccacttgatattatgtatctcatttaatcctaggaagaaatctccaagataagttttattatctttattttatggatggaaagatggatcctgctcagggtctctctggagttttgcctgggtgcatgtatgagtgtgtggcccaagcttcttgtgcttgcatgctgctaggttctttcgtgtggtctctatgtgtgtatgcgtgtgttgggagggaggctgaagaggggtgaatggatatcagatttgagagaggggaagcttaccatctaatgtcatcagttcagtgctcctgatttaattgatttggtttgcttgcattatctgcctccttcctgactacatttgtaccacagaaaatcaagataaggcagagtttctttgcataaggaaactctacagcccacagtttgacaatggtgtcttagtggtaggactcatggtgggtgacctgtggtttggccacttatagcagttggacataccccatttgcaaagatgtgtattgtaaaccccaaattttgagtgtgtaggacaatcatttgtgtacaatcgtgtacaactgctgatgagggcaagaagagccgactttatccaacataacaaagaagaaggggacagtttgacttttgaaggggacaatttgaaaacttataggaggttaagattctcttcctcacccattacatcaggagtacttctgccttttacttgccacagtcagctttctaggtcttagcacccaacaagtagcaactatcctcttgggtgtagtcagtttagtctacttatggcctcctgcttagactcttaagggttccctagcatctgtgttttgtttgtaggtttgaagctatcattattagatgagatttagcttcagggcccgtacctatgactggggagattctatctgggaaaggtcaagacatgcagctcttttttttttttttttttcttctcttttctgagggaatattttcctccaatttttttcagctctacaactaaaatatagacctagtatatgaacacaactggcctctgtcctgggccttagatggtactctgctgtcattcttctctggtcagagccatgcctatggggtgaggtgacttttgggccttccagtcttactctcttttcatttttagaccatgatttggttatgtgggaacccacattcgctgtccagaaggccctgaactggtatctgcagtttgcatggatccttgaagccatcttcctgaaggctgtcattgctactggttgtgcaatctctgcacgagggttgtttaagggatagctctgtgtgtgtgtgtgtctgtatgtgagagagagagagagagagagagagaaagagagagagagacagagagcgagcttgggtgtccacatatcacaaggcccctcttgatgtaggatggagcaggcaggggggaggaaggcaaattgattaccagggctcaggatgatgtctctctttaaaccacccatttctgtggaaggactatgaacattgtaggagttctaaagttgtacctggtcttccaagacattgaaaagatatatttgtcagtctaggtagaaggataacacctattttattgagcagtttgctagcttgatttgtaactttaaatgttttgacttatggtacatgggcctctatttgctcacttgccttgggccttcccatgttgggggtggatctgcagcagcaacattcctttgcagagatgttgggtagaaataagttttggttaattgtaccattttttccctggaatagacaacattgaacattaaagaaaaaatgagttactttgtagacatagtgctctatttcctttgggaaatgtagtttttcttagtttgcgttgtcctgaagtgaactttagctctatactttttttctttcctttttttttttttttttttagatttcctagtgccctagttgcatttcttctgtgtattgagagaccaccaggcgggcaaggtgaagtttatctgaatgttttttcctcctattgtaaatattttatttgaaccaaaaaaaggcttggttcttctcaagcctctttaaagaaaacaaggaaaaaggcttctcagtgctttagaagatataagattgtcaaaacttcattttagagaactagggatttggttgaaccaacatgaatgcctttgaaagaagatatgggttgggtgcatattttcagtatatgctgcagcagctctttattaaagtataaatcattacgaagtcttcatttcctatggggcgataacactgctgctttgtggatgactacctgtcacgcccaaatcctgcaaacttttctacatagggaaatgaaattgggcttatttcccctgtagcttttctcaagagacttcatggactaatttcccaataatcatagtagctaccacttattgaggtcttgctactgcacggatcatgctgagtacttcaggtgtattaaccctcaaaacaactttagaaggtaggttatattatgcttattataaatcctccagagtcaataaatttgcctaagtccacctagttagaaaatgattaggctggggttggaaccaagatggtctggtttggggatctagattcctaattgttatactgtactgagactagtctgccttaattgacataaactacttgtccattatagcatgggtgttggaagactagaggttaagagaaataataatatccaacatttttctagtgttttagcattcttcatatattatcccattgcattttcttagtgtaataaaataacactcggtttatacaccaggtagtcaaacatcatgcctgtcttgtgatctcaatggaaaaatgaagtgtatacctcaagtgatacagtcttggctgaatcatggaacaattatgccatcaggaagtttaggtattctgagtaaaacaggcactttatttgaaaggactgggagacttcacagatgcatcaaatatgttgaggatataaatgccaggctcaggtggatttactgtgaagtgcttgaacttaaccttcaaggctacctataccctggtataggtccatctcctggctctaggagaggccctggcaatgtggttaacaagtgtcatcaagtcaaatactacgaaatcttgcagtgccctgaatcttacagctcacatataaaagaaacctgataaaagttttccaaatttgaagtcaatccaaaaaatttatatgacattacctgtaatgaattatgaagctgaaaggaacttttccaaattattcaagaataaattacaaattctgatctacatttctaaagggaagactgaattatttttctattctctcaatagagaatattgcaaaatgttattggaagagatgatcaaagagtgtgcaaccaaaaaatataggagaattatttcagaggtatggcaatcagttaataaaaatatttgttttttaaacacttcatatttgtagtatttatagcttttaaaaatttgttgtttgtatgatactatttaaaattttttttccagagatgagatctcattctgtcactcagtctggaaagcagttgcataatcataactcactgcagccttggagtcctaggttcaagcagtcctctagagtagctcggactaaaggcatgcaccaccaagaccggccagttttttgttttttgttgttttttaatttttgtagagatggtgtcttactatgtaccaagtctggtcttgaacactggggctcagaggaacctgtccacctctgcctcccaaagtgttaggattacaggtgtaagccactgcacccggcctgtatgccattttaattctaaataaatattcactttattcttaattttatattcactttattcttaattttgtattcttcttcttaaagagtgcccctgaaatttacaagcttcagattccaaagacctgagtctttgactaatggtaggatttgtttgttggtttagaaaataaatgttaaaaaatgcctcttcctccttccccccattgcaaacagagactgaaatctgcattgttatttcacaaaaccaaaatatttttcctccaggtttagctaaacccttcatcattttcctactttagagccccatgccaagtagaaaagaagttgcaaagatgtaattatcacaaaccttcatcttggatgaaagataacctagctctgacccttagtttgagattagaaggactctacctaggagacagctggtaaagactaaggtatgttgtaccaggaatctaggtgtctgggtgaccaggctgtctttcttcccactggggctcattttccttctatacagtgacaagaattggactaaataagatttccagtattttctcttctgaaacatttcattctttgttatccctgtactattttgttagtagaataaatcattgaagttgagttagaaaatctttagctaatcaaaatagaaaactaacaaaagtcatgacaggtcagaactgagaaataccacagacttccactggtgttcattggagatgactactattaaaaaaagagaagaaaaaaaaccatagctattttgaaaatttccgactacaggtgtctgagcatacatcctgactaaatagcatgtttacttcagctagagctcactccttcctaaataaaaggcttacttggttttggtggtaatattattcctctttggttaattatggtattttcattctccccttcctctgaattggttaaaatgtctgtgaaaatttttcctaaggtagaaagttatgaaatgctttgctatgcctaggagatgtaaagcctaaaggaactttcatattttttgggaaaaaaaaaaaaggaaacttgtctagatataattagtgttctgttgcctttcaaatatttctctaccacttttcttaaaatattctcagaaaagacagaatttgcaacagattggcagttttcagactgctgttttaggcaggggagtagctgccgcaacctctaattgcatttctgtagagtttgcagacacttgttagcgtagactaggaatctttcaacttttgctgtgagtgactaccttgttactacatatcggatttgcgtctcattctctaacgctcatagtattggggaagaaaaaaagacaatatgatataatttgtccttcaagtatgtgaaaaggaaaaaaatctaataataacattttatgttcattattttggaatcccttaagttatatcattataaaataatctaacaatctcaatacccctgggcactcttacttttatttttataatttatattgttagaatacatttctattctcttaggcctttgttcattctactttctcacttctttaggagcctcattccttcctgaatattacattttatgagttattatatgcatcaaggcccaaagcttgagctccagcattctgaccccgaaaatgatggtttcctatcatcttctgataacagcaactgaagatgttctaataccttgccgcttacaggaggtctggcatcactgagaatttattggaaatgaggattgtgggtcctctccccagacctactgcaacagaatgtacactttcacaaggtccccaggtgattcctgtacacatagcagtttgaaaaacactgctgtaatagcattaaagcatgttccaaagagtagccaaatgatctgcagtggttttagtggatcacatcaggcttgtttctgtcaataaagaagaggagaattcaaggaagagttggcttagttttatgagagtcttttgactcttcctaagccgttttaactaaagctagcagaagacagaaggcactggtagcaagtcaactaaatgagtcagtttttaaccagtctgtttccccagtcatccttcatgagtcttttgtccactgattgtccatcccttgaccatggtgaactgtagaacccaaggacccatttcttttttctttcttgttttttttttttttttgagatggaatctcgctctgttgcccaggctggtgtacagtggcgcaatctcggctcgctgcaacctctgcctcctgggttcaagcgattctcctgcttcagcctcctgagtagctgggattacaggtgtgcaccaacacacttgactaattttgttgttgttgtatttttagtagagacacggtttcaccatgttggtcaggctggtctcaaactcctgacctcgtgatccgcccgcctcggcctcccaaagtgctgggattacaggcacgagccatcgtgtccggccccaaggacccatttctatatcgaactcactgcattaatcatgtttacctcattaggcatttactcacagattgccttgacatatgtaggccctaattcattctggagctattataccacagcatttcttaaaataggtagcactctgctctatacaaagtaggtacccaataaattaatgattcgatgacaggttttcaggaagtggttttactcttcaacattttttaatcctcttttgtcttgaggaacttatttgtctgatgctcagtgaagacccaataaatttctcttgaattgctcaacatttgttttagacttttctgagagtgccactgtaggctttttcattgatttgctcctttattttaatatcataaggcagctttttgtgacttagttacttttgtcttccagaattatgggtccctgtcagttattaatgctcttaattaacagtagccacaataaccagtccttacaagcagtttctgatgtttccaaataattttattttctgacttttttttctttgcctttgacatctgaactatacttggcaagaaaaaaaaacataaaaactttccattgcaactcatatctcatggtgattcctgttgcatcaaatcttaagttatccatcagaaaagttacgcaaaatctataaccatttggttttatttttgcccttgaattatgctaccgtaacacaaacctgaactcttatatttgtcatctgtaaaaatcacctaattggtctctgcttatggacaccctttgttctttctctgtcaataacacaggcattgccctcagttaaatctccccccagatggcattttgaatagctggcctctgttagaaagccttccatggattttatgaatcctagatcatcacatggccttccctttctctttgagcatgggggctgcctcagtgtcccttggctcctaagagagtgccttgtgctgatgggacacaggaccagtttgatgactacgtgcacagatgaagccaaacctcttgcccatcatctattccacccttcacatccctcatgccctggttccacttgaacccagctgcctcacacatcctttttgcttacaaatttcctagcttgtgaccattctccaccacctccccccaagttttaccattctctatttgtgccctacaacggctccaccctttgaaataacgcctggtctaaatgttactttttctagtgggccttccttgattatccatcccactgtgattccttttcctgcccatagcctctccgacaagccttgcattctcattcatatgaccttgtttgccaagctacctgtgctgtctctgtgtgttttaaactattttactagccaggcgtggtggcttatgcctgtaatcccagcactttgggaggccgaggcgggcggatcacgaagtcaggagatcgagaccatcctcgctaacacgatgaaaccctgtctctactaaaagtacaaaaaattagctgggcgtggtggcgggtgcctgtagtcccagctactcgggaggctgaggcaggagaatggcgtgaacctgggaggcggagtttgcagtgagccgagatcgcgccactgcactccagcctaggcgacagagtgagactctgtctcaaaacaaacaaaacaaaacaaaactcttactagaatgaaaactctttgagggagaaacttctgtctgattttgccatagctcttagcacagattctcactaattctgtttatgtgttttgtttgttgctgtttggaattcattgcttttaaaggccgaggaaacttgcttttagatccaaggcggggagtgctatttttttttctcccagatggcttttcaccaccaagtgtaaatgtcaatggcttaaagccacctgtagtattgtttgacagaaccataggcttatggaaaatctcgtatgatctgctttgtgtaaattgttctttacagtggagacttgctctgtctgcagtctttagtttctgtgaattttggggagctgtggtgtgtgggtgttaaggttaattttccatccatcactggctctgcctttgattcatttattctctcatgtgtgaatcttttgcagaaggctcaatgcattatgactatagagaccaggcaaagtcataaagtaaatcacaccatctcacgcaggacaattttttgtcactcctgccttttctctttatgagtcatagatgatttcagtcattgggattgctggaatagggatggctgaaggggtcttggtgcaatgaagagtgcctgaagatactcttctacctacctgagggtaaataatcccatattgcaaaggtgacccctggttgtactttttggaaagccctgttaaaatgatacatgctaaggagacttaaatatgaggcctttcttacctgggtgcttaataggagtgggtttctaaggatggtcttgaatttggccttcagccttctcgtccaccatagtccccatccatcctgaataaacatgcagtctaggtaccacaagtagtgttctcttgtgcaagcacagcttccagctgtgttgcctgcctccctttcagccagatcatcacccatgtagccactcctctatgggaattctggagctaccactgacatcacattacatagatttggactggtagtgccctacctgctctatctatagaggaaaaggagatgaaataagaattttaatattctttttttttttttttttttgagacagagttttgttcttctcacccaggctggagtacaatggcacgacctcagctcactgcaacctctgcctcctgggttcaagttattctcctgcctcagcctcccgagtagctgggattgtaggtgcccactaccacacctggctaatttttgtatttttagtagagacagggttttgccatgttggccatgctgctcttgaacttctgacctcaggcaatccaccctcctcggcttcccaaagtgctgggattacaggcatgggccactgcacctgaccagaattttaatattcttaagtcttaatattctgtggcacttattggaaatggttgaaatataatgcttttaatttagcatgtcattggttcactctcaaaactactgaaaagcacttatctttcaagattttaatgatgatgttggtgaggacgtttgtggtaagtagataatcacttacattattcagcactttacaaagcattttcacaaactcttgagtattggttgttatcagtttattactgagatgcctgtggtgtcttcaggggacaggagagaatatgttaacttcttgaataactgctgcagccgtagttagccccctatgagccaagcctattggctttgttactcccaaggtataacttatttcatatatataagcaacttgactaagtattagatgtctgtgtaagccattttctgtgagtcaaaacaattttgttcttccttatgtctttcttcagaggtacatctttaataagttctgggaagggaagtgaaaaacaatgcttgacctctgatacaatgtactgttttgattatgatcagcactttaataaaatttatcatcaagaaagtctttggagtgagcccctgaaaagcttgggaaagtgattgatatggtgtcacttttcttaaattaccttcccatgttgctttagatgaccagggaggctaacttcactcttgtgctctctaaattgaactgtcctgaagttttaagaaaatgaaatgatcagactcagcagttcaagattgtgttggttgatagcagccacttagacctcagttcactatgggtttctgtgtactttattggtggtcaccaagatgcaatgaaaggtcctgattttgtgaacatttctgcccacacccttctttggtacataccttttgagaatatgtaaaatgtctttcattgttaaaatagctgttaaataatattaaaggcaaaaaaaaaagtcatgaaaatagtcatttgcgtacttcttcaggcagatagaaaactagtaccagccagtgcaatggctcaggcctgtaatcccagcactttgggaggccgaggcaggcggatcacgaggtcaggagtttgagaccagcctgaccaacatggtgaaaccctgtctttactaaaaatacaaaaattagctaggagtggtgggacacgcctataatcccagctactcaggaagctgagccaggagaatcacttgaacccaggagacagtggttgcagtgatccgatatcgcaccactgcactccagcctgggcaacagagcgagactttgtctcaaaaaaaaaaaaaaaaaaaaaaaaaaagagaaaggaaaaagaaaaagaaaaagagaaactagtaccaggaaaacagaaaaaagaagtgatttgaataatttcagtatgattgagacatatgggtgaaagatcaccagagggaaaaatgtctagtctgataactttgaagaaaacatattgaccatgtctagttataataatcttttaataatctcacagtaatagaaagcttcattattttcaaaacagtttcactttcctgtcatctgtaattttaaaaacagctctctgagatggatataattatcctgttttacagatgtggaaatggaggcccagaaagatgaaatcatctgccccagctgtaataggactgcccatccactgagacatagtaaagtatcattaattaatcttttcatcatttttctatttttagtcatgctccctcactgcttaatttgtaagtaaatctaagataaaaatctatagtctcctcgtattttcatattttcatagctaaattgttaaagaggcgatggcagtgtactcatcaggagacttgttcttgcctcgaacattaaaagcccaatttaagactggagaatttcttctttgagggttttgtccacccatcataagagatttcaaactatgtaatgagtcattttacttttccccttttcttatggggacagcttctctttaatacaccgtgtggtctgccctcttggaggttgtgtcaccattatcagtagacaaatgctgccatgtgtaaaaggctatgccagtttctgcagtcctgtagttttgcccctcactagaacttcaagttgcttaacctaatcaggaatacgggcatctttacataggaagtgcacttcttcatcatatagacatagaggtcaggtattattatctttggcttcctttctcagaaattcttaaacatgaatgtctgaataaacatacagagaagaggttgggcgctgtggctcatgcctgtaatcccagcactttgtgaggccaaggtaggtggatcacctgaggtcaagagttcaagaccagcctgaccaacatggtgaaaccctatctctactaaaaaatacaaaaattagctgggcatggtggcgggcgcctgtaatcacagctactcgggaggctgaggcaggagaatcgcttgaacccaggaggtggaggttgcagtgagccgagatcatgccattgcactccagcctgggcaacagaccaagattccatctcaaaaaacaaacaaataaacaaaatatagagaagaacagaacaagaagtgttttgagtagcagaacacgactcacacagacatctaatatttagtcaaattgcttttatataaaagaaggtatacattgaagagcaacagagcctacctctatgactgacattttcaaagaaaatggctaagaatcactttgatggccaggcacggtggctcacacctgtaatcccggatctttgggaggccgaggagggcagatcacgaggttaagagattgagaccatcctggccaacatggtgaaaccccgtctctactaaaaatacaaaaattaactgggcgtggtggcacgtgcctctagtcccagctattcgggaggctgaggcaagggaatcacttgaacctgggaggcggaggttgcagtgagctgagatcgtgccactgcactccagcctggcgacagagcaagactccgtctcaaaggaaaaaaaaaaaagaatcactttgattagcagaaactatttcacttgccatcatagaaagctaagctatacttctgcttttctactactagctttatataaatgttatttttcttgcaacataaaagaaaaattgagtcatattgttttatttaatttttcttgaagaacacattaaattagctctcacactgtggtgtggacttctttctgttttccaccagtgttcttcagggtgatttttccagtgggcttgattaggactgtgtggatcattgtgatgctttgttctcagtggggattttccagcaaagatgagcttcattaaacaatgactgggttcatggatttataattggagtgattttcttcaaactgtaataaatttcagtgttacctttttctgaacgccctttttaaaagggattccatagcaagtcttctggaataataccttttatataattctttaaaaactgtaatttttacatactgattcctgttaaggcagatgttattgtatcaagaaaagactcaaattttgaacatattaaaaatagtgtttcttcagatctggtggataggtgatgctcaatatatatttgtttaatggaataaaaaaagaaaaatattaaagatcctaggaagagaaattaagttgcagggatatattgcttgtgtaacgtctgtttagcattgcaattttctgaagggaaggctatccacaactgttaattctgatctaaggaactatttcccttcttaacttctttgctaggttatctaaagggagatatgctttctcacatttgtttccttgaacttacttttaatgttgccttgtagggtcaaaactttagaaatacagctttctcaggaaacttggtcctcagatctttcagacattatcttcctttaagcttattgtcctcttgggaattggcaaaggattcccaccctttaaaaagataggaaattgtaaaatccacacttaaaaattaatctaaaattatttttcaggaagaatttatacaatggcaactaaatgccctgcagccaattatgtttatgattcctgcctcatctccaaatggtactagagtttgagtcatatgagaaaattaattgggttgggcttgattgtacatgtatatgtatataataatgttctggttataatgcagtttgcagtttttctagttacagctcaaggcaaagatgagaagcaacacctatgggcctgactgcctctgtccagtactaccatgccccatctctaactactacattttttcctattgaattctccagtccatgtagcataagtcccttcctgaactcagtttatttttctaaccctggctgcacgttaggatcacctgcgaacttctaaaagaattccaaagcctgagccaagcacctagaagttctgactcattgccctggggtaggactttggcatcattattgttttaaaagatccccagatgattccgatgtggaaccatgttgagaaacactaatctagcctaacccagtgaggttacaaatgaagaatttcaccagagaggtcaaagtacttgatttcccacagcaaagaaattccatttactgggttgaaaactcccatctgttgactttaaatccagcataacaaatatgagcaaggttttagaaggttttggaaactcatctgcagaacagagcaaatacaggcctatctaaaagcatacctcacagtaaagatggttaaaaaccaaaaccggaggaggcagagtactcttggtggggctggtagtggggggaatggatgattttccaaaagagaaaacacttgacctgggtctgaaaggctgggtatgatttaaggcaggcactattgttcacttgttagccccagggccatgctactccacttccttcaaggaaacagagggaagccggcaagtggctgcctggggtgtgtgtccacacaccatatagaggcagttcttcagctctgtcagccatggccaaagcaggcagtatttgaaccaccttggaccactcctgaggggcagcatcagacaccaggcatcctttcagacaccattcttggagtctcttccctccatcacgtaaacctcacagccaacagtgaaggcactgaactccttccaggggctgagcaggctgccttgggcatgctcttcttgaccttaaaatccacctgatagatctggtagggaggtagaaattttggtggtaggaaagccagcaattatcaggtcaaagggtttctgataaaaggagttattcagcagaaaggtaatcagattatgggagccttaagtgccagtttgggctaaattctctgagtcactggcagattgtaagtaggggaatgacgtaataaaaccactgcaaagccaggagtttgtgatgggaagataggaaatccctttctttttttcccacatgggaaataaaaatctaaagatgtgtggggaagctccttagagtgccaggactttcagtatcccccaatttatcattaggttctgtccagacctcgttccgcacacagtagcctagagacacctctggaataaggtgtgacaaaaaacaaggaaataaatttattaattttggaaaatgccttctttttcctaggcctccctcatagacattttcctgacaagtccccacttcaggtttcagaaagagatgcaccatcgtttggaattctgaagaaactcaagtttcaattgagctgagtctcagtggcatgtattttattacatctaatgccattttaatgtacttgaaactggggagatgagggcaattggtacacatgtgtaaaccactacaaaaagttcacctgagtgtagaaggtagccagtagcctaaaaaccctgtattttggaggctgttacttcataatctctattatgaaattgggaaaaattatgtaattatctctctaagatggtcttagatccactgttcaatagaactttctgcagagatgaaaatatcttatacctgggctgtgttaaggtttaaggacagcactggtataagatattttcacctttgcaggaagttctattgaacagtgggtctgagaccatcttagatgatacatgtggcttgaaacgtagcaggtgcaaataaggaactgaatttcaaatatagatatatttttatttcagttaacttgaatttaaatagccacaggtggctcttgggtatcataatgaatagggcagttatggagcatcattaaagtccccattcttctcaagtcccaaagaggtccgttcaggtaatttcttagcacctataatcacagtgggacagattaaattacttgtacttttccattcctgtgctttggaattataggctgtttctttgtcctggaaaccagatagtctaatgtttgtggaaatactacttagtagtgcactgcaattataatactttattgtaggaggatgcagccaggccttttttttttttttttaatcatctgtgtttttagttttaatcttaaaaggattataaaaatagtactgccttgtgggagaaaaatatgcttaaagtctatgagcatggagtggtagggattataaaccgttacaaacttctcctggaaattctggggaaagggaagttaaagcggccaatagaaatctcctaggagaaaacttgccctgaagggatgcttttaattgggttcagtatttatcagaagaaccctgcaaaagtggtttccctgaaggcatttggattttcccctgtgaataaatttcacccaccttggtcacctctgtgctgtattctcctagaaactcacctttatttggcatgctgtgacttaaatcctccaaaaaaaaaaaaaagcctttgaaaaagcctgtgggtttttttttttttttttttttttttctctaaaatgttaatttcctttctttaggcttgtgtgggctttgactggaaacttaatctgtgtgcctgggctctgcattaggtttcagtcattgaaatggggcttaataagaattacttgataccttaggagtcagacgagccttacatttatcttgggctcagggatttgcattttgagaggttgtgccagctgacatgagcctttacaggtttcagcttgttgcaaacctagttgggtccatttctctcacttctgagaccttttgctgctgccactcatagctaacgtgttttccatggaacactactccttgtccctaattgtcttctctccctacctcagcagtgacactacagacagccagtcatttaatacgagactcattccttaagaagttgggatagaactttaattacacaaggcatccaagccagcagtcagggccctttccaatgcgattacttttcaagctctgccctgcttctccttccatttccctctgggccttcgttttcagatctcctcagaagccgaggaacgcaggtccttttgaatttctttagatcagtgttgtcctataggactttctgcaatgatgaaagtatcctgtctattcctggccacatgtggctattaagcacttgaaaatggctggtctgacttggaactgaatgtatgatttcatttaactttagttaatttaaatttataaatccatgtgtcctcatggctactgtgtagctctatctagattatgcccttgacttttgaacaatgtgtcttgggagagttctcttggctctggccctccactttcatgaaccagctcctcccagtggggaaagaagaactctctttgacttcagaactgacttccttttattgctaagttagacaggctaggccttgagcttaaaactcttcaccaactgtttataccctccatacctggcctcaacatgtccttttttctctgtgactatatccttattctttatccagcaacagcaaatatgcattaattttctgcagataaggtttcctttggaacttaaggaagaggtatgaaacttggctttggaggacttagggataggaaagccatcaccaagtgtttatagagtaccaaccaccgtgtgccagccaatgtttgagatttggggaatacagagtgaattaaagtccatgtgtacaagctaataaacaagattctatcaacatgtcagcagataagtacagcgcgagggtctgagaacaatggtagatgcttgtaattttagaagcggttgtcaagaatggcatctttgataatgtgatatttgagcagtaattggtatgaaatcgggatgaagaaggcagatctctgggttaagcgcattctagttggagggaacagcaagtacagtgtcctaaaaacagactgtgcttgtcatttcctcccctcctcccccatggtttctcatttttgcttctctttctaagagttacatttataggcatacatttttacactggacatcacaagaaattgagcgagttcacaactccactggtgctggtaaaaagattatgctaagatggataaaagactatgaaacatagtcaaaatgcacttctcagtcacctctggccatacgattttacacatctgggttctcaccccagaatgagataggtttaatagataagattcagtgtggggcaaatctaaggtgccaaagttaggtacatactagaacttccataaagagttgtcttaagaaatagaaagcattataatttgactttgtagccaaaggtcattcaaaacatttcaaagtttagatcacttattccagttttatctctagtactaaatgttatttcagcacacaaatgtggtcattccccatggatggaaggagccagctgtgttccagaactatgttggaagattgcaccttgaagactgtgtgcatggttctcattttccatcttaaaatcactgctggaatctatcttgacttttccacagcccattgacaactgtcattatgtaaatactgtccttttttctcaccaactactgtggctgatgtctcccctccaaaatttatgttgaaacttaatccccattgtggtggtatcaagagacggagatttgggggaagtgattaagtcatgagtggattagtcccacataaaagggctggaggtaaccagcctggatccttttgcccttccattttctgctatgtgatgacacagtactggtcctctctagaggacacagcaacaaagcaccatcttggaagcaggaaagggggctcttacgagacatcagaactgccagtgccttgattttggacttgtcagcctctagaactgtgaaaaatttctgtcctttataaatcacccagtctcacatattttgtatggcagccaaacagactaagttaccaaccttagtgggattgctaggacttggaaaggagtagccttttttttttttttttttttttaaatacagagtcttgctctgtcgtaaggctggaatgtagtggcacagtcttggccatctgcaacctctgtctcctgggttcaagtgattctcctgcctcagcctcctgagtagctgggactacaggcacgcaccatcaagccctagctaatttttgtatttttagtagagacggggtttcgccatattggccaggatggtcttgatttcttgacctcgtgattcacccacctcggcctaccagagtgctgggattacaggcgtgagccaccgtgccaggccgggagtagatattttaatcacaggaggtagcatcagaaaagttgcagctactcaccacaagagagacctttatgatgtttactgcaaattgcatcaaggtcatgacagcaatgagtaatgcccaggaaaggcgaagatcaaccttacactttttcatctaactgcactgtgagaaaacaagcaaaattgcccagtttaagggcagattctcagattttgtttcaaatttcctgccctttgttgtcctttctagaagccttaacaatacttgcaacttctttcttttttttttttttttttttttacttcctctgcttgaaaaacatgaagggggaagtttcaaagtgtttggtgttatcttagaaaccaaagtgaatctgaatgtgtctttctgtcctttttgtgtcatttttcaaaatgaaagggacctttaagttcatcatgtccaacccatttgtttgactggttggagaacaggcacagagagtggttgggtaattgcccttgaactcaaagccccctcatggtcgattcagagccttctccactgcaacctgctgccattcccagcatggtgaattctcctccagtagaagtcatatagcaatgttttataattaacttttacgtgagcaaatgagctccaggagagaagattaaggaatattgctttccatatatctggatggcccagaacactttttaactaggtacttaaaaatctactacaattgttgttgcccatattcttctgtaattctttcatcagctgtgaatgaaagtacagcagttttatttccttgaaaagtaagccaaacatgattttatttcaatattttagaattccacaatcttaagacacatcattgccttcccatctctgcatgtcaaacttactaattttattagcatgttgcgaaataacacactaagtgtctcaaagccaaagtagatcagctctcgcctgataaatgtgcaggagtaagcagaggatttgaaaattgaactggattctcaagttactgcctgtttgccagacctatgctggttatgaacaatatttcaaaaccagattatttggttctagatcctaaacactcttggcaactttattgtaacgatgattgattccattgtatatttgaaagcatcagggcacagtggtaacaaaaaattattatatttcaatttgtctattcattcaaatttcctgaaaggttttttagaagtcatcaaactgctacattctattgatgagtaggaatagatttaccaaactcatacttatcttgtcatttgtttcctgcaattttctttggtgtgagagagcattgcatggaatgttacctttctagcaagtgaatgcttgtgtggcattttttactgtctagaggattttcacaggtacttcaagcatgtttgctcttcatcatgatcctacatgggacgatttcataaatcaggaaatggaggtttcaagaagttaagtggcccacagctaatacatgtaagagcctgaattcacactcaagtttttaccttaaaactcttgggcttcaccaagctgaccttattatatatgtctcctaaaataagtgaagtaattacaaagaaccaaagcttttgtctaagaaacttattgcttccccaccccttgtatactttcttcaactcctagtagtcacacctgtgtctttgccttgtactggaatgtgtgtaaagttctactcttaaactttttgatggaatatctatttcattgtggagtatcaggaaggatgagggcttgtgtgtcaccattggctttgtcttttatttgctttctctcattgatatgatatgataagttatttcatctctttgacccttaatttctccatctataaaatgttaatgacaaaattgcatggtggttgtgataagtaaatgaaataatcatcacagtacttaatactggactaagcatttggtctgcattcgataaatcatgatcatggtaataataattattaacatcacatagatctgatttctaaagtagatgtcctctggccttgaactgaaatgtgattatacacattagagaattacatgcatgttaaaaatattcatattagagagttaaatcatgactttttgcattctagttaaaccctaatattagaagagagaattgaatgtgcaggtgaaataatcattaattgtaaacattcaggtggccacaggggcctggcaggggagtaggtgacatgaaggagtgtcagggaggaggcaaatttgaggacacagagactttctcaagaggagcatctcagctcacagtcagctgactgttgtcttgggatggtgtgggcccactgtttccaagtcttttttatttctttaagtggaattagaaaaccagttttgcatgtgaaatctctgaattttaaaacttggtttatattttaaaaagaaaagagttcaggccaaacagaacacatctgtgctctgtgtccagctcttgtacccactgtagcaatttctgctttagcttctcagtctgtgcccaagttatttggttgttagaaaccaagcgccttggacctcgttatattactttttaaagggatgcctttcccaaatatggtagtactctggcccttttccagagaaaatatggaaatcatctgttttgaccaatattttcacatgtttaataaaactgtaattgaaaaacctttcaggtaccaggcatgcacaagaaccccgcagcatattttgaaaaactgaagcaaaagcctccacggagaaatttatcagtgaaaattctgctctcacagaacattgatattcggaccaaatcccatgcttagttgaggcaaatggttcatttcaggggctgatttttcagattctctaatagtcactatcttttaaaaatctgttcttaccagattttgtgttagtttctgcattttccattaagctgcctcagtactttgagataaagaattgtttaaatcctaaatgaataacttaattaaaaagcacatcttcatttagaccatccttatttccaaagctcttttgatgaaaatcatttcgtgcatttttaaaaattccctagaagaacttaaagatcttgaggaaaggaccatgtcttatcctgtcccccttccctcaagggtttaaatatgagggctgtcagaaagcagcacattttcgtttaggttgactaattttgctggtaagtaacaaattactttagttgaattggaatgttgtaaaactccgtcagtcgtgtatcattatcttgcctctatcagtctgtgccatttaccaatgttttgaccatcaccaagagagttatttaatcatcttttattttcaataataaattatttccttgttgctacagcactccaagtcctgtcaactgagggagaattgttttctcagttgctgtcactttaggtaaagtaccaactttaaagcacttctcagcagaggcataaagttattattttgagagttcatgaaatagtgctccattctactctttcacttgatctaatataccatttgcatttatatggcttaacttttttaactggcttcctgttcttctcagccccaaaccctacattctggtttttgactcatctcatagtccctgcagtcagtctttgccagataaaggcactgttaaagtgagctttatcaatgaaaaacttaagaatttcatgtattgatgacagtatttactataaactgcttgcttctccccagctttcagaaatttgttttattcactgggtcctattagagctgaaagagcatgattgagaaagttacaattgtttcagctttttgaatatggcacaagtgctagaattctgaaatactgcctttggcaacaatgtgtagatatttccacctgcaagagtcattttaaatgtttagattttgtctcctgttatgtggcctgtatctcagagaggtcccctgccactaaaaacaaaaacaaacaaaaaacagaaaaataaatgaaaattcagcaagcgttggggggactcaaattgtacttcattcttcaatgatacaagaaagcaagaaaaccaagtatgcatttttaggatttatttggggtcattggggctggtaagtgttaaataggaaaggatgcaattgaaattccagctcagttattttatgtttgtcactggagaaagccaattatttttccgttcagctacagcttgtttcattccgtagaagactaaaaaaacttccttgtaaattgcatttaaaaaaatttgagtttaaaggtacagccaagatttcaatttaaagtacctcattggatgaattcatttgagacacaagtaatcattccttaatcccttaatttgtttggtaaatacaaatttatgtttatgcagttttcttaaagcaatcatagcaaactactaaattcatgagccaaaatgctagtgaaactcaaacctacaaagctaaattccctcagttgaacaagtccaaatgaggaaatcacacacataaatgcataaacacacacactcacacacacacttcccgtatcagctctgtctccatttctgacctcatgtttgcatttaaaggcaagtaactgattcacatgaggttgccgttgttaatgttgcctctcaaactagaatataagccataggagggtagggaccaacctggtgtttgttttagatgtcttgttgtgtggagagtatcccagacatttgatatccttaattgttggccagatggtaggtagtttcagtgtgaaaatatatatgtatgtgtgtgtgtgtgtgtgtgtgtgtgtgtgtgtgtgtgtgtgtgtatagtactgggattacaggcgtgagccaccgcacccggcccgtactaggtattttactagaattatttcctgctctaagagattttagagtattgattatgtcattcttgacaggttttaaaaactatattagtattacaaaaacatgtgcatgaaaaggaaaattgatgcttttgagcttatctctttattttctgcccacatggtggtctccctattaggtattgtttctccacttctgatcctggtgcccagaggctatgtggggctgtcacttgaatgaaagctgcatgcatctgccatgacagaatctgccttgcatttgctcatttataatgaaaacattttttaagtacagaaaaataatagaaaattcaaaagtaacagaagggtatgaaataaaaagttgcttctcaacctcagttttctacctatttattttccttttacagggccaaataatgtttgattctcatgtccttgcatctactcccagagaccgtctaaatatataagcatgcatgtgtgtgcacgtgtgtgtgtgtgtgtgtgtgtgtgtattccctttaaaaagcagtaacaggccaggcgtggtggctcaagcctgtaatcccagcactttgggaggccaaggtgggcagatcacgaggtcaggagatcgagaccatcctggctaacacggtgaaaccccgtctctactaaaaatacaaaaaattagccaagcgtggtgttgggcacctgtagtcccagctgctcgggaggctgaggcaggagaatggcgtgaacctgggaggcagagcttatagtgagccgagatcgcgccactgcactccagcctgggtgacagagcaagactctgtctgaaaaaaaaaaaaaaaagcaataaaagcaataacaacaaaacagaaatggtggtgtgtcaaccagggttccagttgcaagcagatggcaccctcaaattagggagatttaaggagagtttagtaaaacaagtacttacaaaggtatggatagagtcaagggaaaccaccacaaaatgggagaaaccatagtgcagatacttaggactagtaattgctatgttgacttgctaggcccaaagtggcaaggagagggaagaagtaaatcttggaaatgacctcctgaagagaacctgtgacctccaagtgagggacttggccagctggaaaagattccacagagggagccagaacacagataccttaaatgtgctcctcattgcttcccttagataccgctgggtcaccccattggccaaacttactggaagcttgagggcaagagagccggttgatgtagtccataaagatgagcctcctggggcagacagtctggtgaccaagggtggagaactgatctctaagggcaatagaagacacccagcccaagtaactctatacattggtctctaccttgcttattttcttgaatgctatagcctgggcttcaacacttataaagatagccacatggagctgccctctgctttttagtcgttgcgttgtgttccttgtttggatttgtctaatttattttactagtcttctcttgatgagtggttaaaaaaaaaacctgtttgtccttacaaacaacactgcagcgaatttatcaatgaatatcataaatttttagaagcgaaagtgcgaggcaaaaggctatttgcgtttgcagtgttgattgatatcaataacatgtactcctgagatgttatacctgtttacaacacagcattatgagaatgtttgtttccccatactttacccagctcactgtgttatctgacttattgatctttttcaaaatgagttaggtgaaatatggtatgcatttttaatctgcatttcacttgttagcaatgaggttgacatgcttcgcttttagagcttattctctggtgatatgatcaggaagtaatatttaaagtagcgtttttttaacacaatatagagaactcatatgatttgttatttgtttccaataagcattgataatgattttaaatggcattaattcttctggcacttgtagaatacttactatttaaaagcaagaattataaggcattgtcatttcacagagattttagagtattcactttgtcatctctgaaaggttttaaagtattattactacaaaaatatttgcataagaaggagaattgatgccttcaggtcacttgtctctgttttcttcctgcacacgccatagtctccctgttagctaaatgatggtatctctagtattgaccttggtaccccagagaccatgtggactgtcagttgaaggaaagcccgatacctctcttctctcaaggtataattagataaagcattagggttcaaacacatttttaaaaactaaaaagaaggtattgtattagaagttccaattagagtgtgcaatagatgttcagcaaaaagaactattcctaaaatgttcctatctttggtttaatcacaaggtgtttgtttggttggttggttggttgtagtaattggccaaggtatctgattggcttggggatgtctttcctgaagaattatacagggaatcctctcagattgcttgactttcttctttgttctgggtgggaggaagtgtgtgactagccaatagccttgtcccaccttgtctcaagggtcggagctgctgttgctagcatcacaggccacagcggctttctgccagatggctgcctcagtatctgactcggaaatgctgcaggcaattaaaaacctcctttcagagaacatgtctttcaattctgggcccatatggtgatcagggcctctgggtttgcaatcatttaagaggtcaggctcaagagaaaagcatatggaaagaactggaagatgagaaatgcctgtaaaaaggtgaagaataggtatttaatttcactaactccaaaatgactggagaaagggaaacaattattaaaaactgggttctccacagccttcccactcaacatatagtgggctggcatcacccagggcagcagctcccttcctatctgtaaggtcagtttcgtgtgtacttggctaggttctggtgcccactaatctcattgttgctgtgaaggtatgttgtagatgtgattaacagctaaaatcatttgactttaagtaaaagaaatcattctctataatgtgagtgggcctcatccaatcaactgaacagccttaagagcaaaagctgaggtttctgagagaaaaaatactgcctcaaaactgcagcattgatttctgcctgagttcccaggctgccagtctgccctataaatttcagacttgccagcccccacaataccactatgctacacctgcaggttaaaaatattcccaaagtacttgtgtattaatatttgagaagcagtactctaaaacagtaaattctatccaccagtttccatggattattctttgagatgttatttaattgtgtcaatttcagtggtcttactatgaatatataacactaatcaagacatccacaggtatttgtagaacaaataaatttctgagtttccccccacaaaaaacactccagaaaacaacagtcggtagatacatgaattcaatgatacacgaatgcatgaattcagtgatacatgaatgcatttctgacaagtgtttatggttattgttaaaccttgagattttacctaatggttcagctaataatagacactatttcaaagatttggactaaggtcatattcagaatttctaatatttatctgaaataagtctaaatcttattaggctgctcatctgaccctcaaagacaatagtacagttccagaaatagacacagctaagcagtcaattcatattctcaagacctggaacctctgtctgtaggcagtgagtgtggggaaaatgtgagataaaatggggaaggtggtatgacctagagtgaaggttttgatattactcatgggcttatttgaagagaagtgaaatattatgggccatgtgatactatcatatgctgagagatgctacccatgttcacttcctttagtggatggctttctaggtgacagatattcttattggaacttctttctggagaactttatgaataacgaatttgcctattaggggtagaaaattctctaaagatggttagctgctcacagagagtctataggaatcgaagtacagtcatctcttggtacccatgggggattggttccaagactcctcgaggagaccaaaatctacagatgtttaactcccttatataaaattgtgtaatatttacatataacctacacacatcctcccatatcctttaaatcatctctagattacttatacataatacaatgtaaattctatgtaaatagttgttatactgtgttgcttagggaataatgacaagaaaaaagtctgtacataattcagtacagccacaatcatcaatttttttaaaaaaatattttgcatccacggttgatggaaaccgcagatgtggaacccacagatacagaaggctgactatatactgccttaatataagaatatcttaactagagagacttagactaatataacaatctggattaaaagtaatgttgaagttgggttagggtttgctatagggttaattaggtgggttttgtatcgttgtttagaggaatatctttattcctagctatgcacatgtatgcacttactttccttcccattcctttggctttttaaacattatgtattaaacgtaaggagatgttgtttgatatctgaggtcgtggctggtaacatcttttcctgtggtttggagtgcacagatgcaatgtcccatacagcaaatgactgttacccttccctcccactggccctcatcccactctgaccagcagtataccacttagcatgttattagtgactcttgaggattccggggttggcttgggatgccttaactggatcttacgggcctcagagaatctgcaaaccttctcagatgatctacaaattttgtatttgtttcttttccccaactccaaagtgtgttcataaggcttttatcaaacttaggtgactccagcaaaggtttagagtagctttgccctctgaacttaactacctattccaccagtacatatggtatgcataaaaggacctgaggacctatatcatatagaggaaaagaatactggtttaaaacaaaggttggaatgtatatgacctcaagggctacctggaattgttaaggtggggagtctcctagggtcaactaatagggagtcgatggctggtgctgaacatgtcctgcatacaggcttttgaaaaaaaattctggttaagctcttgcagtggtagcttctgctgtaacaaggagaaaaatgtggcatccctggctgggttcttgtgaagtaatatgctgtatcttaggcaactttcctcatatacagtgggtgctcagcatgtgcaaattcttattgtacactgcccttcccaccatatgcctgtgtctatatgcagtacagttgcttgtttggcttttcttcaacattcaatggaaaggctttctcttgttgggtctacccatcaagtaacatgtattatatctcgccaggggccccgttacagtggtgctcctggagctgtgcaaattggtggaccttctctctctttctctctcctccccctccctccttgtttcccttcctcccttccttcctctctctctccctacatccttcttccctttctctccctttctttcttctaatggtccttttttcttttccctgttgattgtgttctgcaagcatcggacttaaaccacttgcatttgtcaatacatctgtggccaccactgctcccagcacccatctcatctgttttcatttctgtcttatctatcgctgctcactcctgtcactattctcacgtttctaaggttttgctagaaaaggactggccagcacggagaagaatttctatctgaggtgtgaaagagctaatcacctctccttaggtgcatgtttttcacaagggaactaattccagctatatccaggtgctgtcccctcagcagcataagttgtatatgtgtttgtggtggtggggtgggagtgggggggttgctgttttgttttctgtttattgtgttttttccaactaactataggtctgggttctcaaccttggttccacattagaatcatctgggcagcttctaaaaatcctgatgcctcagttaccttccagaaaaattaaatcagactatctgggagtgggaccccttcagtattttttaaatttcctcaggtgatggatttcaacatgctctccaagttgataaccaccaatctaagctaaaatcctaagatgttggaagactgaatttcaagtaatggaaatttggttttatatttacaaacaacaaaccttcctaatcagcaaatagatgcttgtccaaaacatactctatacaaaaaatacgtatgtatgaaataaacaaaacgtggtttcactttttttttgctttaaacaatgttaaagaaacctaaagtgttattagttgtttcaaaaattgatccaagtataaccatgttagaaaaaaatacatattaattgttgtgtttctcccaaatttcacacagttcagagagtatttctgcctatatttttagctaagcatagagctcttggtctgggagacactgagaatttcaaaatagcttgttacctaaaaataaacttcctgaaatgaacttgaggcccgagagggatgaatggctttatttttttcttctatatttactgttaccacaagaaagcaaatcttaaatttatatacgtttatatttttagagacccaggaaacaggtgctatgcccaagctacaaagacagttgcagggcaaagtatctatgacagaatcctaaaattcacaggacagagagtgactgtggaaaggcattgaaagtgttcctctctaggcaagagcggagggaacatgaggcttttcttaggcctctctaagggttatgccttggaaaagtacctcacaactttctgtggcccagcaactgttccagcaccccatgcggtctaagtgcttaatgtttcttagtctagcatgtaagtattaattcatgtttgctggttgagtgcctagtagccttgtcatacttcactgactgtccaaactcatgtcttaaacatcatcaccatctcattgaggaagaaaatggggaatggggtgttacacctttatttgaactgcccctagtttgcagcctgtattttgcaaagaatagtctgtcttccatattttattgaataaatgtgaatgaatatcacatttataatcacattcctctctaatctgagtgaagaagttctgtatcctatcctacatggcatcaagggccaaacatggactccttgtattcatcctgtgttcactcatttatccaataaacatttttgtatgcctgctatgtgaaaggttctcttcctggcactggagatatagtaggtaagtgaggtggagaaagtttcatggagcttacatttttgtggatagattattagcaagtatgcgatgcagatagtttgtgcagacaataaataaaacagagttgctataggatgaagaggtggcatttgatcagagatcagaaaagtgacaggaagctaaacaaaggtaatagcaagtgaaaggcctgaggagggaatgaacttggcttcttcccagaagggggcaggagattggtgatggtggtgataagggagaggtacagaaggcagatcctgaggtggattcagcttttatttgctgcgatcataactccaatgcctcaccaatgcttgggattgtgtctaggaggcactcagtaagtgttagttaatcaattgatttgcctcaaacacagagagagatcagtagaactagtcccttgaaaagaagacccttatagctctttcaggagtaggtcaggaaaatggcggcaaaatcttgtgcctccagcaacggttcctcctttggtgtggcacttcatgactctgtgaggttatagcctccctgcccagctgagcggtgatgctcgcctggctcccacatcctctgtgctgccctctattttgggtcaccctgacttggtctgtttcctgtcttattcaccagctaaactataatttccttaagggtacttttatttgtgggcccagcactccgtactatgcagtgggcccatctaggtttctttattgaatgataagatttttgtagaaagtggaccttatgacaaccattgacaaaagcaaatggctactcaaccaccccaacccctcaccacccctcaccacggtacaatggattttattacaaattgcatacaccagataattctaatctgatgtgaaggaattattttgcctttcttcagattcattctcatgacatcaagttcatttgaaattgcataacatcttcaggaattcattggcaggctgcctggcagttggataatcatttaatatatctttctctctcctcagttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggtaagcaagccttttaagaagttattctttcttttcccctttttacataatgtattctcatagtacacacagtcagtgtatctctgtctcctaaatgtaaacacctgttccatttccctttcctttagaccatctctctttcgattattaaatgtagtttctaggggtgttctctgcatgtatgtgtacgtttatgtgggtatataaacgtatcatgattataaaatgatcatgataaatgtaaagatcataaaatgatctttaatataataaatctggaaactctttcttgtatcaagaagagggatttgccgcttagtagtcatttaaccgacacctcctcagcaccccatagtgagaccaggagctttgttctcttgaggcaatctcaggtctggaagaagaggtgatgaaaggttggctgttggaagagaaaactaccagccaaaaatggggaatctacttggagaaccacaaaaacaacctgtttttttagtcagaaattctggttatattattcatataaccattgggatagatatgacttctttctctcagctcagaactacatatttcttttttttttttgagatggagtcttgctctgtcattcaggctagagtgccatggcacaatcttggctcaccgcaacctccacctcccaggttcaagcgtttctcttgtctcagcctttcgagtagctgggattacaggtgcccactaccacacctggctaagttttgtatttttagtagagacggggtttcaccatgttggccaggctggtctcgaactcccgacctcaggtgatccactcgcctctgcctcccaaagtgctggaattacaggcatgagccaccatgcccgaccagaactatatatttttatcggatcacattttctcctctctctctctctctctctctcattccctccaactcatacatacatctcaaataataattatacatacacagtggatactcatgaatcatttgattaattcatggttatagattgtgagcatgaacaagaaataaccttgatctttagaagagttgtaattttacaaaagtacataaattcattaatgagatatgacattttgcagacttattctgatgtttttaatttattggccattttaaaaaaagtaacttatgtgtctcctggctagttgacaaacaagaatataaacccaaatatctctcccccttttttgggaatgagtcatttgagacccctagaccatgtaaagctagccttgatgatagatctggaaaccttgcaaacttctgtacataccacgggatgaactggtttcttaagaactgaaggaatgttaacagcaaagacttgtcatgacatacttgccaatatgatatgatacctgtccatgtccacttctaggtaacgctttcaaagaaaggatttggacaaagaatgtgttcagaggagagggaccagtgtggttagaggcctagaaatcatgctgtctgaggaatggcctgggcaattagacatggttagtacagtgaagagagatcgtgggttctgctgatgaaattgaaaggctctcaggtagaaaatataataaacatattctgcataactctgaagggtagagggaggatccataacatttgcaaggcaggcagacttgtgctcagcataagtttagacattttcacaatcatggtttcccaacagcagaacaggcttccttttctgtaagcaccaagtgaagttcaggagaggctggatgaccatatgtcaaatagaatgcaggaaagattgagacaccagactagatggcctcaaagcttccttccgtggtttcttaaatatctacggtggtgtgagcacttgcttttgcaacccaaaaaggctcttttaattaagatttttgttttcctgaccagtaatacaagcccaaatcattaaatgtgaatcaagtctctctagaatagaggctttgctagcctcaaaaaaatgtgagcatgtcgaagagaggaggcctccctgtcttttctgtgtcccagctataaagggtaaatacaatgaacattattttgacctgtgctggccaaagaaaattctcccgtgaagccaggggtgttgataatgagaaggggaagtatagggtacgctatagtgccctccttgatcctccttcatgaccaaggcactcattccctgggagtgttggctgttgaaggatcactgctgagccttccctccagtgatgggagctgcctcattcacgttggacacttttcatgggtagccatcatcccatggctagttgatgcagagaaacaaattcctggttattttgccataatgtggtacatctttgaaggacatcccattttcagagtttccaaggcattcactgaggcctttgctgcaacctgcattatagtttagctttttccttctgtgcaatactgttgcctttagtcgcttacagatgcatctccaaaaacctcctgcacagaactctcacagcctcaaggtctgtttccaggaaacctaaactaagacaggaggctattgtaaaaatagccagtgtggaaactgaaaggctctactatgattgtagatttcagtgttgttgtttttttaatcagttttagtgttttttcattcattcattcattcattcattcatttaactaatgtcagttgtgtgcccattccatataaaatgcttaagctgcctccaaggatagaaatattttataaccaaaattattattattattatttttaaattgagagggagtctcccactgttgcccaggctggagtgcaatggcgtgatctgggctcactgcaacctctgcctcccgggttcgtgcgattctcctgcttcagcttcctgagtagctgtgattacaggtgcacaccaccatcacgtggctaattttttgtatttttagtagagatggggtttcactgtgttggccaggctggtctcgaactcctgaccttgtgatccgcctgcctcggcctctgaaagtgcttagattacaggcatgagccaccgtgcccagcctccaaaattaattttatcatgttggttcttctttcagtggaaattgacaacctcttcagtggctcagagcaaatgttgcaggacaaaaaaagaagtccgtatttacttctttgtatttacctttcctatgctcagctatatccaaaaagagtttgaaaagttagctgtgcctggctgttacaggagtgagtggagaaagcagttaagggctttaccaggtctcaagtattacagttgttttctctctgtgatgttagttctctcagtagctaagaggtagaaaaccggaggctctggaagagctgcccaataattatagagcagctttctttcatggctcacagttccttcttaggcctctataagcgtcacaaggaaaagagaccatgcctttctgtgggcacagcataccttcgttttattacccaaaccaaaaacaacctacacacacacacacacacacacacacacacacacacacacacaaaactgtgggggcagggaggaaggtgttcttgttccatgactacagctgatttgaagactgccaagtagctttggggttaaagatgggtagatttccaaattatacatcatttgttgtatgatcatgccaactttcatttagtttcatttggtgtcctgatagccaccctcaaccaattattctgcttgtcactcttcctgtcacagcagggaccaacttagcaaagccttgctcctcttgtgtctttcggaattctagtttaagaacccttgagccccttcacaagcagacacatgtacctccactggagtcaactctgggctgcatggatgttgacactggcaccattcctgcctggattgtcctaacccatacccttgcccttatccctttgtcaacatattgtcctttaatgtccttgacttaagcactaaaaaagtggtattggtcaaagttgctctttctctcatggggatggccccgcatcttttataggtgcaagctgtgtcttagctgcttcttgcttctagcctgccttccgttttccttgctgtgagcagtgagcctttgtgcatggggcagggaggattaggggaaaattggtgagtgagtacatgcatgcattggctcatgtgtgcactcagaatcttcatagaagattactctagcaaaactgactggaccagattagcccttccttccgctccctctctagacagagagaatgcgattcaagacaacaggtattttgcatctaaaaaggacagaggtgaaagggtggatgtcagactagccttgttggacagtcatccaagatagtatgttcatgagggagcagagggaggtagatagagaggtgatacccttttccaagagagccaaaatgttcttttgttcaattataatagtgggcattaatcatgttgtttaaaaatctaatgtacactgacggccaattgagcatttcctagggcccaaggaaaatgctatgtgagaaattctctgagccctgggctaaattagtcttcaaatatgtgctatgaagtgatactgtcaaagtagttagtttatgacagcataaaatatttcattgaactgtaaatgaagaacaccctgacatccctttccatttcttttatttatttgttttttttgtttgtttgttttttctgaattgctcctttctgtaatttgggaaagactgcagttctttatctgcgatgtttcttcccgtttttctcagcagaaccagctgttgacaaggagtataccctttacacgcaatgctctggggcccagcaaacaaaaaaaagaggaactgtgactatttccccaggcatgctctttgaaaacagtatagctagacaggacagattttgccacttaaactaggggtgtgatgtgaggtttgcattacattcaggatggaagatttaaaattatcctgagtacctaggaatgttctttttttccatgtcttcccctttaatgatttaattaagacttaaatatgtaaagttctccaccaggactgccccgtggaacgctgtctgctccaggtgatgtttataatcacaaatgggttccaagaataaacaaaggaaaaacagaaaagagtagaaaagcataggagactataggacagcctgcgaatgctggagaacaggaaccagctgccgttgttaggaacaacttcatgaaggaaaagtattccagattgcctttctgtctggaggccatattattcatttattctctttctctctctccctctcccctcgcttccaatgaatctcttcactctaggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaaggtgagttttcttctcttaagggtgtgggacctgagatctgtgccaattttttgtatccttggtctgcagtgtcatagagcacattcctcctgtggtggattgcatacagtggattaggagctcattcagctggtggaaagaggggcttggggagtagcagggtttgttctggttctcatcaaatatggttgactggggcaaacattattatttgtctttgacaaatagtttctttcacctagagcagtgtttctcaaagtgcggcctcttgagcagccagcatcagtatcacctgggaacctgttataaatgcagattctcaggccccactaaatgagaaacatagagggtgaaccccagctatctgtattttaacaagccctcccagtaattctgtgcagctaaaatttggtaactattgttctaaagatttggatggggttgtttaatcttggaggaggactttctttataactgatgttgtttcttgtacatagtcccaggatttgtctttagggtacttgtcatcgatcccatttgagagaaacattgcaatacagagaggaaataataagccaaagtttacccctagagccaggagaagagtagattagatactagcctccatctttgaagttcagcgtttactcagcttgaaaggaaggcatacactattccctcaatttttaataagaagagaattcagtggtttttaattacaaaagtagtatatgctcgtcatcaaaaatttcaaacaatccaacagtgtgtgaaaattaaaaatgaaagtacattttcgtcctcccctcactcccaatgcaacagatcatctgtattgacaatgtattagatgcacacacgtctctatcattcattcatattatctcccactccatcctctctcccaatctctccctgtcttcctttctctttccctcctttcatccatctgtccatccttccatccactcatccatctttcagtacaactatctgatcatactataaatattattttgcaacacttttttatacccaaccacttttacaattccttctaaacaagatagaacacatagatatactgtacatcttttaatttagtctcgaatttcatattatctcccacgatggatcttatcatgtccctgttgatggattgtcttcagtttttccacttaatgctacattgaatatctttgtaaaaatatctcatgcatttgtgctaatatttctgcaaggcagattgccagaagtgaaatttctagattagaaatatgtgtattttaaatttgaataagcactactaaactattctcctcctgaaaaggatgtaagcatatggatttccgtgtaccttctccaacactgggaatggataagtcttttaattttaccagcgtggtagtgtaaatgttagtttagtcaacaataggtctgatttaattaaaaaatctttttgaaatacaaatgctggctctacaccctatctctgcggccatgtgcattccacctgcgagaagctatgtgtcctcgtgtttcgtgtttggtgctcagtagcactgcagatccagcttgttctcttcctgtgtccttcacctactgccattctccctatcttcctgtccaacatcccccaggccaacttctcagtgaactgaaggcaggcatgcacatcttgtcagggcaacgctttccagattactcttccttcctatgttctcatcctcatcctgtaaatggtccatttctctcgttttcttttctggttgttttttttttttttttttttttgacggagtctcactctgtcgcccaggctggagtgcaatggcacgatcttggctcactgcaacctctgcctcccaggttcaagtgatcctcctgcctcagcctcctgagtaggtgggactgcaggagtgtgccaccatacccagctaatctttgtatttttagtagagacgagtttcaccatgttcgtcagtctggtctcgaactcctgacctcaggtgaataacctgccttggcctcccaaagtgctagaattacaggcatgaaccactgtgcttggcctcatgttctttatgtgatttgagttaggagggaaatctaaatagtttaatcacatgaaacatggtaacacctgatattctgacttaccaggtcagctttcttcaagtagatcaccttttaaaagaaggcctaggctaagccaaaggaattaatctctgacagtagaatacccaggcatgtttactagcattgaagaaacttttctctccttctgtataccagcttgtctacagtagacaagtttatttcctccaaaaggacaaaagttgataaatggcctgcaagttggatctatattttatcattgaatatctttgtcaaaatatatcatgcattttatattttactatgagcctttcagatactaatgacttccattttcagagtctttcaactcaagtgatcatcatgggcatccctcatatttttcctcttatttattctcagactttcttatgaagtgagataataagcataaagacaatttctcactgtacagtacaggaagcctttcacagctgacgactcaaatgtctgggtgatttcagagtcttctaaaatgctccagaaggtagggggtgtttgctttttaagcatctcttttctgtgtggtgggatatttcttccacctaaaacagcagacattaggagcaacattttatattccatttctccccttattgccaccatctcttctttatcttgaggaatgaaaactttttttttttttttttttgagacagagtctcactctgtcacccgggctggagtgcaatggtgcagtctcggctcactgcaacctctgcctcctggattcaagcaattctcctgcctcagcctctcaagtagctgggattacaggcatctgccaccatgcccggctaatttttatgtttttagtagagacggggtttcaccatgttgatcaggctggtctcaaactcttgacctcagatgatccacctgcctcagcctcccaaagtgctaggattacaggcatgagccaccacacccggccagaatgaaaactcttaatgttgatttgtctactccaagtccaacaaggtggtgaacacaaaagctatgaagtgcattgtggctgtattattagtagtacagtactcttgttggcaagttcctgatctgcagctacacaatggatgataattatgtacatctaccttttttaatatgtaagaaaaaaaagttgagccacaagattttaagtatggatctttatttctagtgctactattaatgatagttaatattcagagaaaacatactgtcgctgtgcagggagctcagccctttccaagcatgacctcatttaatcttatagccaccccatgcgagtaggcactgttaggatccctgtttatgcatgagaaaaccaggcttagagaaatttaacactttgtctacaatcaaacaactagtgggtatcaaagctaggatttataatgggatatgtaaggcactaaaacctgtgaaggttttccttttttccttttttaattctttccttttttcctctttttatttccttctttctctttatatctctgtatgtttccaaagagataatatatgcatatgataaaaaattcaaatgctagacaaattcaaacatctagacaaaatggtgcagagatttaacatttgttccttttgttgttgttgtaaatgaggcttggttgtctgtagaggcagaggaacacggtaacatcttgacatcagacactggtgtcatagatgccctttcctcagaggactgagatcatggtttttagaatgaaagagttaaagaaaccttgctgtttttttctttgaaccgggtacctacccttaaccctggaatccctcagtggggcctagtgccagttcccctgcctccctacagtgaccaagggcaggcaggggtcaagaaacaactagaatggggctggggtctgcactgcacaactgttctctcacattcatgcttccctcccagtctctgaagattccctcctgccagaacattttgtgtagaattctaaggaaatcagagtctatccctgtactaaccaacatataaaattccaattagaagagaagttgtttggattggtcatgatggatggcctggtgacagctgtcagtcagacgagacctgatgggcaccaggactgaaggcagcagcacaggaggtaggagaggaaggaatcctgagcaaatagccatgctgtttacttgccaatgacatccccactttgcaaagacatgatatggttattgatctctcactgaacctgtaagaatcaaacacaacaactcagttttattcatttcataaatggtttccaagtgcagtcagacatttaatttgtggaacactgagcgaagaggtgatttctgctggtttaggtaagagagaaacggtctagtgtaatactcaagaatgagctagatctcctggatttaaggcttattctacagcttattagctctgctatgttgggccagtgacttgacatctccatgcttcagtctcttcatctgtaaaatggaaatacaaagcgggtgggaggtgttgtgaggattgagtagattaatgcatgtaaagtgcttgcaacgttgcctgacatgtcactgtctgttagctgttagcagtagttgggctttttatagagggctggtgacttgtgcttgtctgaatgcaggaaaccaggcctgtgtagccttcggtctgttctaacactgaagttttgtagttgagtgctgactgtggtgcataaactgagcatttggatacctacatatcacaccacaaggttttggaggggctcactttgctttaatccctgtttcatccagtttctctttttctccacatgccttcacagaggcaaggggagcatgctgagtctagaatttctaatcaaagctaaccacatccctgtcattgttggataatattacaaattagacacgttgttcctgttttgactcagaatcacagcaggaagcagctaaataaaactgaaacaacccacaagtgcctttcacataagtgattagggtaatcgcagttctgtacttgccaaagggattcattccctcttcattttttccatggaaagcttgctttgggccacaaggccttctctttgaatgactgcgccattattggccaagtagtgctgataaatggtacctgtgggttgttgtgggatttaaggagatgatgcttgggagcgcccagcacagtggctggcacacagtaggtgcatcctttcttacttcttcttcccctgattaacgagaacactctacaccaagacacatacctcttctgaacggtataaaccgttgctactgaaagtgtctagaccagcagcagcaggatcacccgggagcttattagaactgcacaaccttgggtcctctggggcctattgcattagcatctgcctgtaacaaggccttcagtgatttgtttgcacactgaagtgtgagaagcactggtgtgaactcaccaggtagggatggaaccagagatggaggtcttattaacttcatgctggtaactccctgagctaatgggcccatgaggaataaatttggtctaaagcctggtcatttggaaatgaactaaatatactttactcagtcagcttgtgtaacagagctctccagtggcatgtgggtctttttcagcagtgacaatagtttattttttaaatatactccacaaatgttgttctggtgtggatcttaatgtggagaaaatcagacaccttttcagtaagcatttcttttgtttctgtgatcatgttcatgttagtttattgtatttgtattagtttatctgtgggactatcccttaatatttcccaaaacaagaagacatttgcgaatgttttcaagatgcattgtacaagatactgttttgaactggatcaatgaaggagatgtttggtggccttggaaagccctggagagtaatagtgtggttctaagaagagttggcctgaatcagttcattcttgggttgtttgctaagattgtctgctgaaggtgggtacgtggaaaacaagatggtaagccaaggaggatgaagggaggcatgctgctggaccacttccagctcccaaatgactggatcttggccatcttgcttttcctgctaacttagaactgaactgcttattctagaaaatgagaggcactggggccatataggaaagggatagcattggacccaagtcctagactttcagtagtttgtttgcaggaccagggtcccaccccttttccaattgaaatgtaggcaaggtggtggcaagcccatggcctaggctgtgggaactcatagaacaactatagtgatgatcgctgccttggattgcagcctactctgaatgtgtgcacctgtgctaactactttcaggtgtgttgtcttgtttcatagactcattacatttttatgatgaagtgaaacccgtgaattggctcctccagacttctcattttaatgacaaaaaagtgggtctccagagaggagctgggattttccaagatctcatagtttgttcctcactttttgtccgtaggagaatcatagaagaaccagataatcttgtctcttatagaaggaatacccttacccttccacattcccgtggtggtggtgtgtttgcttttttatcagtcttaacccatgggaggctgcacaacttacataagaggctacctgttctgtttgccaaacggcagcccagacccatcactgagcatgtccttggcaagaggcacaacctcaggctgacactgtttccatgtccgtgagaaatgatgtgtataaacgatggccagtaagatgctcatctgttgggaagacaacagagggcagggctgagagcatggcttccctgctgattgcctgtgttcagatcccagctcagccgtgtgtaagctcttggttcttggggtaactacttgtttacctctctgaaaaatgggagtagaaataatgaatacttttaataggattattttgaggataaatgtatttatttatgtagagaacttggcacggcacctggcacagagtgagcacttaatgaattttgactgtaaatagttattactgttccactagattcaaatttcttatctttgcctttagctggatgagtgaggagatttgtaccaacgtcatgtattctcctcttccctgcaaattcctccacctgagtcctattgaggtgctccccattataaggagtcctgtgaatcaaagtggtatgtttactgtaaagaatgtggaggatgctgttcactgcattgtattgttatcttcatgaggaagccaggagacatttattttggctctctgttttagaaaggtgttctcctcatgacgacctgtttgcctctgatcttaaggacactttgaagcataccgagcaggggtctgcaaacttctttgataacaggcaagatagtaaatattttcagctttgcagggcagagtctctgtcacagctactcaactcttctgtggtagcagccacagacagtgtgtaagtgattggacgtggctgtgttccagtacaacttcatttacaaaaacagggctcaggccaacccctgatagagatattcatggtttttgtgtttctctctcaaatgctaactaccagaaaagcttagagtcaaatctgaatcatgcttctagcaaatatgtacctacacatttagcatactaatatcactcttgcttaccagtttttaccctgttttctcacatttatattccatttgtcataattatagctcctgtcttgactgtatcttctttcactgtgttttttgttgttgtcgttgttgttgtttttgggaatgggataggactgtaagtaaataaatcaattatatcttgctagcttagaaaccaggacttgagtaaccacttctgactcaaagttcaatctatgtggttaaatagggaagcagaccataagatgtatgcccagtggtgcacgttgctgactcgcaagctatgtgcaggctttagcatttagtgtggtgatgtgtgccctctaacctgagatgttgagagaggggcagagaagaagacttcttgtagccacaaagtttcattccttcctctctcattgttgtagcatttcttttaagtgaaaacagcctttttggtttgctagcctatctctggcaggaagacaaattatttttttacagtatcagacacgcggtttcctgtctatgtttaacttgctagcagaacatctcagccagctggttccctctggacccattgtgtccttaatgtcgttgctttacaccatccagcaaacccactctgtgtactgatcgcatgcattgagcattttgttgacttccgttgttttccgagtaagggaagtcttagaaatgctgccctctttctcccaaatctcattttatgtttgttcagctccaacaccagggagctggcttcttggggaaatgattagttcttgcatgtaagaaatgaaaagagtaaatggtgttttggtagctctgggggattttaggtatgctgccttggaactgtgcactcacgcctcaaaatagctggctttccagctgtgcatttttgtttcaaaagaaacaaaccagatttactttctggtctaaatgcagaagaaaaaataagtgtggaaatatggttgagaaaagttgttagaagaggaagaaaattatggattaaagttgctagtctcattcctgagaagagaaatcagttatttgaggtgatgactcagagctgaagcagctttttgttgtgaaccagccttggttagaaagcacacttggaattcatcaatatggccctatgtctggccaaggaaataataaagattttgcatgatagaggacactgtgactcagttgaaggaagcttagaatgtatttgaactgaattaaggcaaaagcaactcgcttttcaagatttttttttttcctaagtagcaaagtaaacaaagctgcactgaggccagatgtgctttctggttgtgaatatttgtactctagaacctcattctggtatgaatcagcagagtggaatctagtatggacacaggctgtctcaaattccatccactggatatgagtggccaagaaagcagtcggacccatactgctggtgctgtagcaaggttcgggtggttcctctgcagcctcaggtctctcccactgcggcctccatgtgttccataaactccacacccatgagtaatggcaagaagggtccactgagaccttttgctgctttgcgagtgtctcagtgtcccaccaggggaaaaaaaaggctcagggaggtggctaaccactgtgaaattgacttttatttccacccacgtatactccagaggctgtattcaccaccatttggacatctggatgacttgcctttggaaagtccttttgtattctaaatcgctcctgcatgttacctgttgtggaaaatatcaattttgccattacaaattatgcttttttttaaaaacatgttaacttttagagaaataatttatatttgcttatctacttttaaaaatatacatatatatgccttttgttgcctaattagaggatatagttggttccaatgtcaagaacaatttctctgaaatgtagtcattaaaattattcccatgtctttcattttccaggccccatcctattcgaaatacctgtttcttccaccaggctgatgtagttatgcttaggcttggctgcacattggaaacacctgagtagctttaaaaactactcattaactgggtcttactcctgcagtttctgacttaattggtctggggcctggtatcaggaattattttttaattcttcaagatattttaatatgcagcccacattgggaaccactggactcaagacagtttgttctgccaaatctttttatatttttcgtcacgttccccctgtagcctggaaagggacggtaacaattaaagaatggcagctaccacaggaaggagccaaaattatgccttcgaaggttagaggaggagaaaaaccaacacctgttttaccccatccttggaggaatagcaagacactttaagaggggatattattttgttttctacaacaatttacaagcaattgctttggaacaaggtcaacggcctcattgggaataggcatcttagcttttaaaactgattaaattatacgttaaaggaaagcacattttaaaccttaatgtgtccaaaaggttggatggcaaggtttgggtgctactgccttggcagagacaaggcagggaccagggaggctgtgtgcatgattttaggaggtgagaaactcaggtgggaaggaattgcagaagcctgtggttcacctggaaagccagggagagagagaggatgtattctggtgacctaacaggtattgtgaataatgaatatgcttttccaaagcgatctggtctccctgttggagagcatcctgaaataacttaagaaatgtaccttgctttcaggtttcctgagaacatgagggcccctagacagagtacaaggtgtaattcagacagccagccagaaaaagaattaaagaatcagggcaggtgtggggatcctaacaaaacctaagcttttagtagtcagaaaactgcaataacacagaaaagaaaatgaaaaaaaatcttgttccaaagaacatatatcaggtgtgaaactctctttgtgggaggacagatgtgtcatcatttcctggacaaagcctggtaccttgtaggcaccctcctaatgttggttgccctccttttaaagtcagagcaagagaagtagcaggaatctatatcctaaggaggaacataaagggtgaaaagcacagtggaagggatgcctaaaagagcaaaggctgaatcagggttttaatggcctgaaatgaccaattttctaaaacttgacaggtagatgtaaaatcagacatataggttcaaacaatcgattgcaaaggagcacttgtcaaaacactggctgggaatctgctcatgtgatgaagaccccagggtttagaggtgagttaaggtcattttgaaatcaggatgatctggctgaaagaatcaaaacaaaacagaaagaacaaaccatcaggagccttaaactccacttggtggaagaggaggtgagagtcctgctgtaatctttgctacacaagttatattccaagtattatatctgtgtctatcaaaacacatgatgaagaatcttaaatagcaagcgtggtttcagagaacagatcactttacccttagaaaaaaggtcctggcatttattgggcgctatatgctgggcaggctgattttagggtctgataaatctgtcagactttagagtctcatcaatgtatctcttgaaaagtaaccgaggaaaacatggctgttcaacctgaaaatgaaatgatctaggggttgtgagtttcatatccagcaggagtttaatagttctcatcccatagaaaacggattcattttgttactttttgctttagagaacagcagaaggaccaataatagaagcacacagaggctacatttgacttaatgtaaagaataattttaaacatatcccaatatttagactttatcccaatatatctgcagttagaaatattgtgatttgattatggaatgataacaaaggaatgatgtccttctaccataacattttcaggcagaggtttcacctctacctctcatgggtattctagaaagagattatcatactggattagaatacatgcaaggcttttccatctgggagagagataagaaggaaataatacaaaggagactgtgccatgggataggagaggtggcgaatagctttgttctgaaatatgtgcagttggaataaaacaaccacattgattggagagaagacttctttcatcatttgaggaaaaaatactctcaaaatatatccagaatgtcaaacagtgctatcaatagctagaagttaaattaaatccttcattgctagtgagcttactgtccttttgttgtttaattgaaatgactttttattgtttgcctaaattggtgtgctttttactaggatgatggatggggaagcatatctcattctacactcctccaccagttaattgactagaaaattatcatgggccattttctcattggctagtgctgaatacagctgtaccagagctttgcaaacaattccactaagaaattttttgtaggaggaaagcatctctatggcagagtaccaaagaacttaactttatttttgctaaactgtttagcaagaataaaatttacctctgaaacttgaatgtgtaaatgaatcactgagagaacttttaaatgtagattctgattcagttagttgaggacagcgctaagactctgcatttccagtaagttcccaggggatgctgatgactgctggtctgcgggcacacttagaataacgaggtgacaagttattctttatgtaacatgccaacaaaatttttaaaggtacagaaaatgatggcaagatctttgaactctgcaatatgaagcatatatgtgagtgcttagctttcactctctttctgtgtgtgtgtgtgtgtatacagatactaagacacagatacattcacatatatacatctaaatatatatacagtacagtccatattcagatttcttcaaggttaatgggtctattgtttaaattcggaatccagtcaaggacaacacattaaaattgattgttttgcctctacagtgtgtttttttggttttcatgacattgactttgatttgaataggtcagaccatttcatgtactttataaaggcactttgtagatttgtctgatgatttgattaattcagattaaacattttttaaagattctggtgtttttattgtaggaagtttttttaaaacagtaattctgcaaaaaagcaaggtttgccatttgtattcagtcatattagtagcaagacgactacagatgcatacttggatgataaaacaagtttaaaagctcaagaaaatgataactataaaagccaggaatagtgattactttttagaggaagggagggatctccgattgagttggggaacatgaacagacttctggggtggccagcaaaattatattttctgacctgaccagtggttacaagagtgttgatcttatagtaattcactaagccagacacttgttttatgcacttttctgtatctgtgttttattttggaatgaattctttttcacaagagagaaatcagagtaatttctctagttttgagggccatactgtgctcttgggccaagtatattattttaaatacccttaggagaaaggaaagaggaagagagggctaacttttttgggggggggagttgggggggcagggggagatgttctcgttctgttgcccaggctaaaatgcagtggcaccattatagctcactgcagtcttgaacttctgggctcgtgatcctcctgcctcagccttttaagtagctcagattacatgcccacaccaccacatccagctaatttttttttttttttatacagacagggtctcaatatattgcccaggctggtgtcaaactcctgggctcaagtgatcctcccacctcagcctcacgaagtgctgggattacaggtgtgaggcaccatatcttccccccatttttttttaatcatctgagtggcttcaaagcttttgttctttccataccaccaagctatctccttaacaatgaactgtgagatccatttaataattctgaaaatttccagtcacttctgtcactcatagaggccagacttagttgcaaataaggagccatttgcaaatgtcagagtcttgttacataaatatttttttaaagacaaatgtcaaattctttttttttctgtcttccaaagataaatgttagtatgccataaaaaaaaatacaaactggcagaaaacctcaaggggaaatcctgtggtatactttcctttggagtgattgaaaagtaaacaatttgtcttataacttgagtatgcatgtgcgcacacacatgcacacgcgcgtgcgcgcacacacacgttgctctcagcctcttttatgtcctttgttatgccgacaccagttcctaaaaggaacttaaaactgaacctccctaatccactattttaaataaaagtcacttggttaaaaaaataaaagcattaaattaaggccaacttggtaaataaaatcctatgtggatcagttaatgtgtcttgataaaaagcaaatcaacatagctgaatttgggagataggctcctactttaatatttgaagtagtttggcaattcctccactcggtaaaggagtttagggtgaacatttagtgggatactaatttatccgagcaatagaaagggacgtggatgacagtttttcgcacaccttggtgtattagtgcactaatgagcctcagatgccaagagagattcttgtgaagttggcagtgaagctctagccgcaaggatgttcacatgccagcatgttcacctaaagcgagagtatatatgcaactggctgagatccaaagaaggaaactgtgctaaagagagatagctgaggggaaggaagaacttcctgtctcaagtcatgttaattataacattaaaaggacagcattcatttattgagtacttactaggaacaacttttacttaacaagaatacttatttactaagtagacaaaaatgttgtagaagcaaccaaggttcagtatcctcctctgtaaaacgggggtaagagaatctaactcatacatagggttattggagaaataaagtagatcatgtttacaaaataaattgtccggtgcctaacccaacaaagcacatcgtatatgagttatctttcttattgttacaagatttcaaaggagggcttctcctcaaattctacactgcggagctcccttcccactccacagaagctccgacagcatccacagttgtccatgtgcagcacaacaaatcaagccaggcagatctcccattggcactagttaccaacttcctagagaaacccatcaatctcaaaattcctgctctagcaagtcctggaaaagagactagagcccaaatgccttcactctgccaagggagcttccctttttgtgtgtctgtgccatggacttcttgaagtagggaagcctgtggaccccttctcactgtgatgttttttaaatgcataaaatagaacatggagtatttcaaagaaaaccaattacattgaaatacaatgaccaaatattttaaaaatgaatttgtgttatagtaatatatgtttctataataatgctttaaataacaatagcagcagatctaaacaattgaaatgtctaaatggtgagcgtaagtcacatgctgagacgtctgcaacaacaaactcataggtacagctgatactaggaaatattaatttttaattaaaggttagagaaaataaaaaaagatgcaatttttgcccattcaaattcacagacccactgaactctatttatggaacccaggctaaaaatgtttactattatagcctcatttttttatgggccttggataaattccacccttatttttaatgcccttcagagctatatctggttcaatgttattactattcatggaaggtcccaatagtgcaacaattatgttttgagctctgctaagatctaggccatgagaataggctctgagaaaagaaaaagatttgggggttctccttcacataaaactttttatttcctggcaggaaaaagatgcatatttacagagacactactaaactgtggttcttagttcagaacaaaggaatataatccccatacccaaaatatactcctttagacacattatacaagaattgccaatgtcagtcggtggatggctgtaaaatcacttagtccaggctacactaaagaaaaacactttatcaaattgggagcttatataaagtcattcttcccctcccccgcaacccctacccccccatccccgcccgcacaaacacagggtcttgctctgttacccaggctggaatgcagtggcaggatcatagtgtgctgccgccttgaactcctgcctcaagtaaagtaatcctcctgcctcagccaccgtaatagctgggactacaggaagcaccacagtgtctggctaattttttttttttttaagtttgtgtagagacagtctcactatgttgcccaggctagtctcaaactcctaggctcaagtgattctcccgccaaagtgctaggatttcaggtgtgagccaccacacccagcctaaggtcattgccattcttagttggctctcaccaatatgaagtttagagatcaggtatggggttgagatcagaagtctctccaatcaggcaatgctcattgtaaataccagctttgctgttgcctaaatttatcatctgggaaaattacttaaactgtctgatctttagcttccctatctgtaaaatggggtttataataatagcagtttctacctcatagggtttttctatcaattaaatttaaatattctataaaatccttagcacacagccaggaacttagtaagtgttcagtttatgagtttctctgtaactggcggctgatgaaaagaagcatttcctgttggtcttcgactaaaggagatgctggcttgtacctacaccaacagctgttgggttttctagtagcaacccaagggttaatactgccagagggtgtgggtggctcctgtttagataaagccacatcccaaagcttccttccagccctggttgctattgttagagtttttcaccacctctttgaagtttcaagattgacagatgttattcaagaattcctccccctcaaattttttaagtgtaagtcttctaaagaaataacaggaaattttaggagaaagtaaaactttggtttctgacattgaactggggatttctagaatcttcttcagtcagtgccacacataaacttaaggggatttctgtttttgtgtttcctttaggctaaaaaggaattgaaattagcaaatacgactgtttttatagatatttaggaattgtaaaataaaattatccatgatgaatcaacatttcatctggacgttttagtgaattaaggacaaagctaagtaattatgcagttaatatttaaattttttcaaattgtatttctcatatgtgaaaaaaaattgactacatattcacatttggccaaagtgaagtctctccagattctgccaatgaggttattaaaataacacctctagaacaggggtcagcaaagtttttctgtgaagggccagatagtaaatattttaggctttctgggccagataagatctctgttgcatgaacctcttagttttattgttttttaaacaactctttaaaaatggggatggaaatcattcttaggtcataggactatacaaaagcaggccatggacttctgagccatagtttgtcaaaccttgctgtaaaatataaaaaatttgagaagtatcattccacgtaagtaatcattcagcttctaaaacaaacgtttgttgaataccataaattgccccattctgccccaggtgctgtgtatatcatgatgatcaaaacagacctggccactaccctgctttgtcaggagagaagcaatcagataatcaagtggatttctgattataagacattccatgtagttacagacacagagaccggagacaagtgggtacttcaagcaaacacattcattggataccacatataatagaggtggagtttcaggcagggagcattgtggaagtggtaagcctaagtggaaatgccgactgctggatcggctgttgtgtttgaatttgtgttgtgttcatctgcccccttaattttgtttgctgtacaacagggacagtccatacatctccacaagagcatcttttttttcttttgcattcaatcattctgtaattgctttgtcccaccccatttctgccctactcttgcctgttctttgtcccaatccaagcctcccagtgtaagaatttatgtttttaaggatcaatcaccaaattttctcactttccctatacttttaaaatgcattcatatatctttccaaaaaatggtgattttttttttccctcttggttgctggaattctgatatcttggggttacttctctggttactagacccaagattttcatctagaatatatagtcagtggaagttggcatttccactcagacttaccttaagaacaagtaatcatattacacataaaccttaaaaatggatatgtaccagcttcatttctcactgtttcgttagatgaaagtttcagatgctgggccaagcgcagtggctcacgcctgtaatcccagcacttttggaggccaaggcgggcagatcacaaggtcaggagttcaagaccagcctggccaacatggtgaaaccccgtctccactaaaaatacaaaaaaaaaaaaaaaaaaaaaaaaaaaaaaagctgggcatagaggctaaggcaggagaatggcttgaacccaggaggcaaggttgcagtgagcagagatcgtgccattgcactgctgcctgggtaacagagcaagactccatctcgagaaaaaaaaaagaaagtatcagatgctgaagtagctatgtagactggggtatataacctggggttcatcatcatgagccaggaaaatttaggatatgaacacacatgaggagtttaggagtggaggtttaataggcagaagagaagagaaagagaaacaattctctctgtagagaaaggagtctccaagcggaaaggacgggccagtggtgaatgtgctggattttatagtcccgtttgaagaggcggtgtctgatttacatagggctcacagattggttcaatcaggtatgacgtttacatagtgcatggggaagactggtcaccccaccctaatcttattatgcaaatgggctttccagttgatcagcaccatctggtctgttctttgttgtacacatggctgacaaagagaagggaagatggagctgccatcttgaacatgtccttagttcctgctggcattcacccgtgcaagctcccagcttgcctgtctatgtctgaagctcaactttacaggctgctctttgttagaaaatgatttggggctgcttttcattaaaaagaaacaccttaccgaggacttccatacccttactatctgcccaagtaatttcttcttaactcctttatcagtatcatttaggtaatgggttccccttgagagaatttggttatatcctcattctacctggactatattctcatcacttttttttttctctttaaacacctactgtaggtgaaaactgacaaatgaataatcaaaagatccttttctgacacggagtttggttccataccacctacccatttttttcctttctattccgcaggtgcagagtggtcagtatgggataattgctcttccttaagtagatcatatattctttctccttaacatagcactctttccactcatcactgacttttcccattcttcagagaccaacttaaaggcagttttttgctactgtgccttccatgtttctctaagcttttccacattccactaatatatagattacattgtacatttagcccctatcccagatgccatatattgcttacttgtatatatgccctaagtcctctactgggtactctctgagggcagtgccatgcccatcatagacactcagtagtgatatatttaatgaatgattctaggatctgagcatgaggcctgctcattaatgggtactttggagggcagatggatgacacataaagcaatagaattctgcatgtttgcccaatgaaagcagcccagcacaagctcccagtgaactagagctgccttttgctctctcctgtccactgtctgtttctattcatgtccttcttccaaaaaggaaaactatttcaccagagccaacaaggccagcacatgaaacaaagtttgaggcacaagatattatagttagatatctggtgctaaggactctccttgtcagcccacaggggcctgcttcagaattccaagtcaaaaaactgcagcatttccatttttaacttgttttacctttgcggccatgtttccattgttgctattaaatatttcagttccatgaaactacaattcgtatgcacactgaaaagaggaatgttgggtggatgtaagataactgtccaaagagatcctttccatggactcctctccctgtcacccatgggcccagggtagcctgaatgctgatcagagcagaacaagttggagtttgaaaaagagcaaagattttggtgcaaactgtggcacgctctgtgtttttaccagatgtcatacatgcagattttttgaaggcagaagctgtgtcattttttttcatgttcccaatgtcctgagcttagataacactcagtaaatggtttgtctttttatttggcaatattgaggacctgctgtgtgctaagtgcagtttacagtagtgaagaagacatggtaccttccagcatggagttccctgtccgtgggggatggcaagagtagggaaagacagatgtgaaatcaagaggtagagtcatagttcatttagtttaagttgtactgaattgttacctaggaaaagtataaggtgctatgaaaatgtataaaataagacagttttccaagtttttctaggcctctcttaagcagtgacatttaagctgaagtttgaaggaagagcaggggatgacgaacagatggccagaggcagggaaggctgaacgagcatgcacttgcatccctgaaataaaaattaacaatatcgtatctacaaaaactatgcagatgctaaaatctatagatgctcaggcatgaacccacttcctgacagtacttacctaccacatccaactccttctctccttgttttgtttccccatcagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtaagttagagctagtgctagatcccctttaccttgagcctggcctcaccctacctcttgatccatatctcctggctcttatctcaaacagccctgtactctggacactggtctagggaatctagccaaagtatggagtctgccttgagcatactctgctctgtcctgcctgagcatttttgctaatggacagcatttctcctcctatcttcaaatccttcccagttcagcacattttttcctcctggatcaatcctcatttctcttccagcaaatgttttttctttgtttcaagcactgttagtactttacctctattttttccctctcttatggttgtactcagtcctttctgctctatactagctgtagttgtgttggtttctttgtattaaaagcatcgtggaaggcaatctccctgaagtccaaatctacatccacatggtcacccaagatatgtagcacaatgccttgaacattgaaagtaaaataagtacttgtcgactgagtgagcacttccactcttgaagcactctcacagattaaaatggaaatgtttttggctaagaaactattggaaggtgattggaaatcaccacaacatcccttataaatgatgagcccagtgttttcacacagtggagtccatggagagcagcactgtcttctttagccaggtggcaggacacactttgaagcactcggttactgctcagtcagccctgtgtccatggcagcgcacgcagtgttgaggtaaacatcgaaatatggacagactaatgtgccagagtaatgagccatgcaatgacctcttgagaagaaaaaaactctctaatacatgccaataagaaacattccttggaatgataatatcaactcacttggcttccctagatccttgggaaggtaggactttattgttatttagtcagtttatacatactacaacactaaatatttaagtgagccattctctggaatatttttttcctttttcatatggatccgacgtttgcatattatcagtcatagagattagcacaggcctaaaagtcaaaataaaactacatggcccacaagttaaaattataaagtgatccagatttggtcttttactgtgaaaatgcttttatacaatttaatttagtagagatgttatgcaattgtactatatcctttgcacactggaatgtgccatgggataaacaaagattaagactcagtcctaaagtgatcaaaactgatagcaattattatttttaccataagtcttggagtttcaggaataaaaaaaaattcaattttggaaagcaaaaataaacatttaaaatatcacaaatattgtctctcaggttatctgtaaggatgttattgaaaaatgtgatgacataagtcatggggttagataaggcagctctggggtttggcacttccttattttggcatgctttgtttatggtctttagagggttttcagggagagaacatctattttaaaaaataaccatctatctgtacctttctgtgcatttctcattctttaaaacagcactttgattttttaaaaaaatcctctgcacgtgtcaggggccaccatcagctatattgtgaaaataaaaaggcagctggaattaaatgatgggcctcactgtctgtttttgctataggtgggaactgcaagatacatggctccagaagtcctagaatccaggatgaatttggagaatgttgagtccttcaagcagaccgatgtctactccatggctctggtgctctgggaaatgacatctcgctgtaatgcagtgggaggtaggtgtggaccagcatcattgtgtagtggtaaacttgtcttcaaaataagatcatgtgttgcttcgagcattattccaggggttacaaagcagttattagagctagttgagatctgatattatacaaccatcccagaactatttggggttatgctaaacagcctaggtttttaaactgaaagccacatttggagcataaagctttgtatctccttttataaacctttgtataattactcttctcttgacacatctcttcacagttatttaaatatctggcaagagacgaatactaataaatgtataagaattatctctaatgatcatgtgggtaatattcagataagcatctgatttcttttactttgtgttttaagatttttcagaattatgtctgggaaaaagatttgattcaaaatttacttttatggacatgacattgttttattgggcaaaaaaaaaatcattgtttgagatatttgtttaggttttgaaaattctagtgaagaggttattgaggaaggccgtcttcttactgcttaagcctgcaagactgattaggagacctacttttctcctgaaaagctggcttgctctttttatccccaagttcagccacctactgttttttttttcttttaggatcatttttccctgaacacactgtcatagcctcccaggtgccctctgctatgtcttctctgcagttgtatgctgagtccttttcactgttagaggctgttactactattgaccatgagactgtagatagaatgggcaacaaacatctggggtgccagggtgaggctattgttctaggaagtattatcccttgttgtccagaaggcaagaacagttgaggtctacattactataccctttcctgactctcttctcagtaccttggaggacagatgcatgacacataaagcaatagaattctggcatgcttgtccaatgaaagcagcccaacgcaagctctcattgaactagaactgcctttcgctgtctcctgtccactatgtgtttctattcatgtccttcttatttcttaggtgagacagggtcttaggtctcacctgagaaatctgtgcacccaagttcatcctggttggctgccaaatgaagccaaactaactccaccctttttttttttttgagacagtctcgctctgtcacccaggctggagtgcaatggcgcaatctcggctgactgcaacctctgcctcccgggttcaagcaattctcctagctcagcctcttgagtagctgagattacagacatgcaccaccacgctcagctaatatttgtatttttagtagagacagggttacaccgtgttgatcaggctgatatcgaactcttgacctcatgatctgcccacctcggcctcccaaagtgctgggattacaggcgtgagccactgcacccagcctccattccatgtttaactttttgttttgtgataattttagacttagaaaatagttgtaaaaatagtggagtttctgtatactcttaactcaactttgcctgttgttaatatctaacctaaaccatagtatggctatcaaaaacagcaaattaacctggattcagtgttcttaattaatccatatacgtatttgtacttccaagtccccagtaatgttcttttctgaaacaggatccagtctaggatcccgcattgatctaatgtgcatgcctccttagtctccttgaccttgtgagagttcctcagtcgatttttgtcttttatgaccttgacacttgtaaaaagtttaagacagttatttagacggtctctcactttgggtttcactaatgttttctcatgattagattgagattacatattttgggcaaaattaccacagaaatgatagtgtgcctatcttcagtgcgtcatatcagggggaataagatgtccatgtgtctggttattaatgttaaatttggtcctttggttaaagtgggacctgctgctatttgtccatttgtaagtaatacatgcctttgacctgtttctaaagatactaaatacctgtttagcaaaggtactagaactttcttattcatcatttacccactaatttgatgatctatgactaattcctgcctataacaattattactataatgtttacttaaggaagattttctgtttttcttgttccttctatatttattaatatgcattctcctttaaaaaagatctgtctcttctgacaccatcccctgttctttgtttactaattatgtatttatatcagcaggggatttggggtatttgtttcattatatgagtatccagtattgtcattatttattttgttgctcaggttgccacagcttgggtcactggtccaaactacccaacattttgcccaaggcagattcagttggcaccactgctggctctgattcttcatcctgttcagaatatgcatagccaattctccagcgtgggtccgggtcaccccctcccatcctgcaccctgctgaacctcacatgttttcctgagacccccgcatggggatggcacttcctatctagctgacatagttattattatctagtttcttgactgagatttcttcccccaaaacacttccaaaagttaactttgtttttccttgcacagtgaaatttgtttaaccaagtttcagccactgagaataattttatgcttgaaagctttgacagttccaaaatgaatctttagccgggtatgagttgtatcagagacaatgctgttgtcactgtcagaataaatttacctagatttcagtatcattccctatcctttcaactctgttattctataaacatgagctggagattgtgtctctgtctttccctctgtcagtgcagccagcttattaaggccctaggtgagctcccagctttcattgttatcactgactaaaacccttgcctgttgatatttgctgagtgtggaagaatttaagctaatgaggaaggagttcaccaaattttacaaggtctaaaaacagttagaatataaacaagttttcccaaggaaggaacaggatatggtttattcagctagtctcaaaaaaccttttataaccttaggataagaagagacagccctggggaaccggaaagaggccatcccagttctcatttcgtttgatcttaagcccacagtcctatttctcccatctttgctcgggctgcagacaccaaggttatttatccatcctcacgttcgtcctgacacaaagccgttcacttgattaagcgtgtgaactcacgtagtaagctccttctcccaccttgacttcttcttttaaaagcattagtggtttttgtttgtttctttttggcatgtctcaaaaaccttaaagacagattttcagcctagtcttagtttcagaggcttttcttttacattcaaaaggtcctttggaaagtacacgaagcctgaagacagatggattccctccaactgcattcatcttgatgttgtccctgctgtagcttttgtagaaacacagatggaaggacaggttttgacctcaagaagcttgtagtctacaggaaacagttgtttgtttcctctcccttctttttaaaaaacttacacatgcagatatgtttcttatcttacaaattaaataatgaatccccctgtttgatgttagactttaattttaaggtataaggaagagggaaggatgtaaaaggtctttccttaagcttgaacttctgcagtttgcagtatagcagatgtaattaccatttttttaaaatcagcagtcttatttcaaaaaaggaaatgtggaatgtgcttacctttgtatgatgaatcatagatggacagtaaagggaaccagatctccagagtcatcttctctgtaggctctgagtctgtgtgcttgtgggatcatggatcagggccacttctgtgacatgaaaggcttatgatctgacccatcgagccagctaccaagcacctgcagagaagcctgctcaagaggtatggtcctgccgggcgcggtggctcacgcctgtaatcccaacactttgggaagccgaggcgggtggatcatgaggtcaggagatcgagaccatcctggctaacatggtgaaaccccgtctctactaaaaatacaaaaaaattagccgggcgtggcagcaggcgcctgtagtcccagctactcaggaggctgaggccagagaatggtgtgaacccgggaggcagagcttgcagtgagccaagatcatgccactgttctccagcctgggcgacagagcaagactgcgtctaaaaaaaaaaaaaaaaaaaaaagaggtatggtccacctcaactgtgtgcagaaggatgatgggatgcaagtctccagtgaaaacagctaatctacatgacaagtatagtggatctacccactgaaggagagtaagtgtggctgcttggatttctcgggatgactgccattggtaatatggatatagcaccccatcctgtactgagagagtccctagttgtattgatacttttttaagctatggaacattaacctctctgttcccagttgttaatgagctattgcagaggtgactatttgttttactttcttggatgttaacattacagtactcactacttgaagaaaaatgttctaagcagcagaaggtctaactgaatgaagtaggatacaaggattagggacagaagatttcacagaaaactgtgaagtcccacctagcctgcctttaagtgactcataaacatggatattaaggctccaagctcacctccacgccacattctcattctgtgttcatcacttcatcatgatggatgtcttttaggtcttacctccaggctttgtctcatgctatttactggcactggaacacttaactagtctgtttttaacaggcaagtgtggttcagttgtgataaatgcttaggaagggaaggcagtgagctcaaaggactgaatgcccaggttggctacagggagtgcagtgttatggtcagggaatgagacttaggtcagctcttaaaggaagaggaagactctggggcatccttctgagttacttctttactagccagtctcccctgaatgcaggggagcacagggaaaacagagaaagaacagcactacactggagaagcctcacttttatcaggtgagaaaacataaacagatgataatagagctcttcaaaagccaggtggtacagcttcatttcgcacaaaattccaccaggggcctcgggagatgtgttgcagttaggtgaagagagtggtcagagagaaaggcttcttattgaaagtacatttggtccagataaagaaagccataaaggaataattaccacttcttaagcacttgctccacacatcaactcatttaatctaccaaaactctttgaggcctgtactgttattaatcccattttacaataagagaactgaaggctcaggaagtgcgaaagttgtggagccaggaatcaaagccctgttgtctgactctgtagctcacaggccttagtattcctggtatactgctagcctggccaatggagaacgtatttaaaatagtagctatggccatgtacaggtacaggctcacgcctgtaatcccagcactttgggatgctgaggaaggcagatcatgaggtcaggagtttaagaccagcctggccaagatggtgaaatgccatctctactaaaaattaaaatattagccaggcatggtggcgggtgcctgtaatcgcagctactcaagaggctgaggcagagaattgcttgaacccgggaggcggaggttgcagtgagctgagatcgtgccactgcactctagcctgggcgacagagcgagactccatcccccccgccccccaaaaaaaatagtagctatgattcctatgatcagtatggatacgatagtcagagctactctgtgcatcctggcagtagatatgaagccttccagcagaagctgaggagacaatcacatgtttgaggaacattcagtgatggcctcacttctctgggtgaatccctgttaacagaatccaaggctgttaatttgtgtagcaggtcacagtattgataccttaaaatttgagataactgttttatctttatttccctaaagatatatttattcattcattcactcaaaaagtatttattgagtacctattgtgtcgcaggcattgtttaaaatgccagggatacagcagtttaaaaagcagtgtctttctttgagagacaggaagtctagtgaagagccagtattttagggacaggtaatgaacaaagagattatgtaatataatgttggagttgggtggggtgggtgggatgattttagaaagaaaaatagacttgggggatagataatgaaagaggctgtcatttcagacattttaatcctctgaaagaatacaaaagaaaaaaaaaagaaaacaaatctttcagaattgtttgaagtaagaacaagacaagaggaggtgattggtgtgttactgttctacgaaaaaggagaaaaagcttcatgaaatcgccattcagcaaggacagaactggagatggcttctcttttacaaagaaatctctgtcccaggctttcagtctgtttggtgttcatacaagtgtttgtgtgttgtgtggaaggcgggtgaaggcgggtgaaggcggtcctgttcagggccccctttggtgaacacagcaggcaaaatactctcgtcatccccagccaaactggcctgcaagcacactgacttccacatccctagcatttaggcctttgaatagaagctgacacgtagcagccagctgaacaagtatttaatgaggagcaacacaactccaagaagggctccttagtgtattgtcaagttgctgcagccttgtgagatgaaaaaaaaaaaaaaaaaaaaagtgcaaatgaaccaaaaagaaagggaaggggctgggggaagaaagagacagaaaaaaaggaggcgttggagagacggctgaggagagaccaggattgaaacgcttcattttcctggatttcaagggagcacagtctggaaagcagatatgaaaactcgggggtactgctttggggaaaaccatcaacaactttgctgccctgttacattgggactacagtcaaaacagcagctgtgcaccagatgctgactttccgaggaataccattgctgtcccagagacctgccctctgagggttgtggaactgggaagagacaggcaagcgtagttttctcttaagagccttttgagacaaattaaaagaagctgcgagggccgggcggttgcgggtggcttccatcagtgaaaagactgcagagagaggtggcgggagggagatggaagtaagagaaagtcgttctcaagcagtgaaataaagaggttttttagaaaagatgccgtttgaggcactcagggaaattctgaggtgttcagccccgtctgtctggcttcagaaacagtctgagggtgagacaaagacttggtttgatgaactaattctgctgtgtaggcatatgtcttgggtggagtgcctccaaccctggaacaagaatttgagtactagtagtttatttgggaagagattgcaggaaatgccagtaagagaatgaggaaatgagtcaggaaagggaaggaaaccagtaaaggatatcttatcaagtgggttaccaccatgggcaactggagtataactacgagcagaacacacacctcagtgtcataccacctgactcaaaggaagctgggtgttttatctttccaattcccatcagtttgctggagggctgctccaggccgagctgggagggttcactccagcccttctgcctgttcctcctggagttgggccagcctaaccggaagagccagtgcaatggggttgggaggtggcggtgcagctggccctgcagcatcacactgaataattgtagggggcatatgtgactattcttattttgtggatataggaagtgaggcacaaactcttggcatctcttttctaagtcctcatatctactttttaaaggagtcagggcaaaaacaacaaataatacttacaatgcatattgttagctcttccacttttgaagtgctaaactcagtcatactctctaagccttcgctttttctcttagaggcaattccaattttttttaaaaaggtggttcttgttataggttagccaggtgtaacattttctctggactcagcccacacactcctgaacttgctttttatgcagttcttcacaagagagaggcccaaggtcaagcatcatttgatcaaatgtgcaaagaggaactgcattaattctattgccaactatgccccaatctgatgcctgtagctaaaatgagattctcatccttacctcacctccaccaccagtcacatctacttccctaaacccagaaaggacaagtgtttgggtttaatgtgggtaaataataccagctaaggagagggctgctctttgtaattgtttttttgcatagctggcttagaaattacaaataacaaccacccagcagatcccataaggttccccttctcaaggttgtatgctgaggagggccccatcaaggcagggagggacacacttgtcacatttgggaagggcatgttcataccagggactgccccagctgtacttgctctggttaggggagaaatctctgcaatgcttggcagagatgagcaagcatgaaagcttcctaaaaaggcaaaggcaaatttcttcagagtaacagtaataaagtgcacaattctaaatgctcttcctggaatccagtgtactatttgggcctcagttttctcaactgtaaaatgaggatgttggatcccgtctctgaagaccttttcaatattctttgtctgactcatttgaaacccttaaaatatgtttaataacttgtgctcttttttcctgtgtcaaaatgcatctcacattccttaagaagcatttagggcaatgttgctccaagtgtggtctttggcaggtgctggtcctcaaactctctgttacagatttgcaatataaggacagaaaccaagatgtgttttgtgcctttaatagcagtttgatgttgccacaacactcaagtgggattcatttttcttgtaattcatttctactgtattttaccaaagcctttattcccaatgaattgagggcaaaacatctgggcttttataaaaaattgattgagaagtgctcatttgcaagtaataagggaaaaattttaatcacttttaatctcactattccacctaagccacttttgtgaaagaaacagtggttaggagttggggagagatttacatttctttatacatatttgtttagtcatttcatagttttaatcacatgcattttccaaaataaaaatattttaagcaccatcatgaaaaataaataagatacacagtttggacccaaagattttgccaaagtggattaaacatcccagtctccagctgcctgaaaccctggggaaaaagttgggagtgtcaaaggtctcaggccatcaacttgttgccaatcaccagctctgtccagttccccaggactgcctgggctctgttacatgaggtctcatcctaggaacgaccattggtacccacctggctggcagagggctttctgctttctaacctcctctcgcagggttcaggctatctctggccacgatcttcccttcttctgctgagtcaaagcaaatatctgaggcattctgagggacacttagaactgaggagcaattaagaaatgccctccaggagggactggcctccatgttacatggtcatcctacaagtcctaatggaggccctgagaatggcattgccttaatggccatagtaggaaaaatgagcaatgttgcctgatcgctgcaattgaatatcaaagatgttaactgagaggcacatgtatacacactgccaaacattaaaccatcttcctacacattgcagggcatgagaaaaaaaaaaatggaggttgggagtaggatgtccaaaatgagagagaagggtaaagaaagaagaattgcaaaaatccataattagaaagaaaaaagcaaacatgcatttagctgttttggaaaatctatgttacataaataggacatttttcagaagttaaagaaaggtcagcctaaatcatgcacacactgcagatccccatccgtactcctaatctgaaaaactaatattaaaggattagagtatgacagtttaggtcaaatgatgatcctccctccccagacttgtctattttaagcttaggaggaggcagaagagtcataaattctcccagtggggcacaaggagccagtccttttgccagcacctttcagactacccgtgacctcccttccttgtgaaattacccataagtcgaagatgggaagcaggccttgtatcccttgggaatattagggagtctcacaactttccaagattttaggaaaagtaggaagtaacctatttataagtctgtttgttttgggaagggattattgcctttgtcttcctttctaaaatagcattcattaatttttctttaagtaaaaatatgcccaatgccatcttctctcattccccatggaaacttgctttgatccacagagtacctataaaaaaaattacaataaattgtgtagtgtttgtaactaggaagattaggacttggaatgaattggctctgcgtttatagtctcaaggacaaagactttgtctttgttctcaaggactatcagccatgagattgacagctggggtttattctgatcccaacattttcctcctctgatgttggtcatgtcctcctctgtcacttctgaccatgagtatagggattgttgttgatagtcagaggagaaagaactctctgaaatgcttggtagaaaggaaaaagcatgaaagctttctagaaaggtaaaggagtttcatcagagtaacggtaatacaatgtgagattcagaatgttcttcctggtttagtaatttcaccttcacaagaaggggctacatcaaggcttccccagggtagctttgcagctacagtcagattgtgcagattcactgagacaaaggcctagggagagaggagaaagcacttccttggcggctgtgttgggccagctttactagaagtggagtctgacacacttttgtgcaatgatttattgaggataagctctcatgagaaggaagtaagagaagcaggaagaggcatggaaggagttaagtgaacttgtatttcaagagaggtctaacctcagcttgatctcactggaagctctggagagtgtgaattgcaccatagttacccaccaagagccaagagaattggactgttaaacttcaacattaatttgtcatcggctatacgctgcctctgagagtaaggcggtcatgtccacgaatctctaggataggcaactcccattggccaaggacaatcccccagaaaagggtgaaggtgtgagcccttatgagccaacacctgtggcagctgtaggctgctggccctagcttggtcaaggggaccttggcaggcaccaactgcagctgctacataagccaaaacaattgaagatggaaggtctgtggactgtaccttatctaaggaacaatttatatcatatacaaatcctatcctttactattatatggtagtacatatatctcaaggtatggtaccaagggggcatcatatttgattagattggattacaagataaatctgaagaggaacatggaggtagctcagttcagtatattcattttatagaagagaagaagtacatgagagtaaacacttactgggaaccagatctgattctcagttttctcttttgcttgaattcaaccgaactcatatttattaaattcttactacgtataaggcacgattttaggcactgagcagataagtgaaagacaccaaattcagccactgccttgtgccttaggcatttacagtctggttgaagataaggaatgaaagaaaaaaataagagtataaatgctatgcaaatcacaattcagatctcacccaagagcaatgtggattaaatgcttgggtcctttgaggcaaaaagcatgacacacaggaggatagtttgtggtttgtcttaatgtgatgggaggccttcatcccaaattcccctgtatttaaaactataaaaaagaaaatatcctggcagctctactatttggtgaagctgaaaaagataaatattcaagtagagttctggaaaaggggaaaaaagcaaatgaacaaagaacaaaaacaagccgtcccttttcaaaatgtcatcttgccatgaaagcttcttcaattcgttacctagaagtgcaaatgtattgaaagttttactcattaaataagattattttgaagctaaaggccaaagatcctacttactttggagaacagtgttgaatccagcccaatctctcctttcagcccaggcatgttttagtactgggatgttttctatctttttaagtgtcctgtgctctgtttacactatattaatctgctcatttaaattggtgttttgttttaatgtttggccagagtttatgcactgccactttggagagaatctaagattcattcattcattcattcattcactcactcaacaaagcatttgttgacagcctgttggcatgggagacccttgcaattggcaccaagaatacaagaatgagaaagggactcaacttgcacccaaatgctcacagtccagttaggtgagaaaaataagcaggtgaatatattaaataaaatatggtatatgcacgaatagagccctgcccaggatatctaaccaagattgaccctaaggatgttcaaggaagtttttataaagaatttgaccttagttgaagcctgaggccccggtgaagggttacctcctcctttatcattttctttattgaatataccatcagaggaaaattatcgttttaaaattttgttgatgttgttaatctgtcccctctgtcttcccactaaaacagcatttctcaaccttttttaaaatcagtgatatcgtaaggagcctttttaaacaactttttttgtttgcttgttttgttttttattttgtatagatagaggatctcgctatgttgcccaggttggtctcaaactcccggagtcaagatatcctccttcagcctcctaaagtgctgggattacacacatgagccacagcacctggcctgtagacaactttttttctaaacactactctccatgatgtttttctgtagcaaaataggcataatataaaatgtaccatcttaaccatttttaagtgtacagtttactggcattaagtaccttcgcagtgctctacaaccatcaccattattcatttttctgtactgaaatttgctcaactgaaattctttaccccttaaaggataacttttcgtaccctttcctcccaggttgccccctggacaaccaccattatactgtctctgaatatacctgtacaaggtacttcatacaagtggaatgatacaatatttgtccttttgtgtctggcttatttcacttagcataatgtcttcaagattcatccatgttgtagcatgtgccagagtttcattcctttttatgcctcaatacctacatgaaatttaataccacattttaaatctctttgtatactctgggcctttggaggctcacaaaccattgtaatacataagatttttccacttcccaagaaccagtttcacccttttgctgcaatatccccctgtagaaaatgcctgtgttaaaacctaagctccgtgaccctctctatcttgttgtccactgtgtcccccagcgtaacacctagcacattttaagtactcaacaatcatttattgaatacttctctagcccttccccaaccactccttccttcttatcttagccattattattaaaatttgctcttagagtaattacgtatgtatttgttacttagtgcttcatgctccccagccaggcatctcaccatgctcatttcctttggctgcacatgccattctcagtgaccctgtgtttgctggctttcttcacagaagtaaaagattatgagcctccatttggttccaaggtgcgggagcacccctgtgtcgaaagcatgaaggacaacgtgttgagagatcgagggcgaccagaaattcccagcttctggctcaaccaccaggtaaggagtgagtgtttacaaaggtcagtaagattcaaccaagttgcctcttaggtggcagagaattctggaatattgagcttaaatctgagggaaggtcccattgtgttctatggccctgttaaattttgtttataaagcaaatttcaatacagtggataacccaattattataggctccaaccagctgatatgtactctgagagttcacaaatagccattcggaggacatttgccacattttccaagcccccttggtcctgggttaaaacattttgtttgcagcctctgctacttactcctgggccttcacgtcaggagtttatatttgattccctctggattccaaatgttttcttctgggaatcttcagctccataaggaaatacttagcagatgcaaaacaagcagggtttgtcaggcagctgtagtgagaagtgactgtggcatgcagaaggctgtgtacaggtgtttgcaggctgtgctcacagacttgggagaggcctgagtgagcacgcgtgggaaagaggagaccgactcctcactctggaattaaggaaagcaaagaagaggagaatgccctggaaggaacgagaaatctgtctgttgggaacatcctaatggcctcttatttttccttgttaagaaatgctagctaaggctgtccatagcagggcagtcattctggactcataaagaggctgatccaaattgtttgtttgggggcactttgatgagggcaatggtcagagaaaaaagaaaacgataggttgtgagtgagtcagaaccagctatatgtctgacacacccaggaaggagcccttagtgaagaatgagagagaacagtgtggccctatctcactgagaagactgttctttctactgactaaaaccttttattgcctcttttggatgaattccctcaaccatgaaggccgaggctaagttgttggtttccctaagggcaaggcaaattcagataagaaacagaaacaacaaatcaggcacaatcgggaagacaaatggagcaggaagtctggtctgtgccagtcctggcccagagccacttcagcagacagaccttaataaagtccgaggaggttggcgagggggaaccaggctgtggtgggtcacaggcttctctggagttttgagcaaatcctctttgacactaaaactgtaagaatattttgcataaattctgaaatcagaatgtgctggagtgttatgtttctttcaaactctgttgcctcctctgctgtatagttctcgtaatgatgccattattcatgatgataaaattctgaaaagaatttgcataatacattttttctcataatgagatttgttgccctattgatttcaagttaatgcttaatatttaatttaatttactgcctgtaattacagtgccagaataaaataaatgttacttgtgtaccaacaatagcactctactcttaacagggccatctgtcaatactgtcaattaggtgaattatgcaattaatttaacatcatgaactcatcgggtggggagggagagataggctcctaggtgtgtttggaaagttgttggtattagaaaacaagtagaaaaagtgccagctctcccaggtagttttgagatttatccatcccactcccagccacctgtgtgagggatcccattagcaatgttgatcttacaattgggaggagcacactctatttccacctatcagaccatttacttaactcctgcctgctttatttccaaaaaggatttgaaatgataacaaaaatatttgcaatgcaaaataaaaattaagccagtgagagaaaactcttgccaccttcctgggcaggatctcctggatggtctccttggatgggagcttgattcggttagggtgaaccctaggaaatggcatagagttaagcatgcctgacccacataggcagctgtttcacagggttcaacccaatgttgttggagaggaatggagcatcccagaggtcatccttggcagctcgtagaagctgctactgaatcactctacaaaatgtgtggcctatagaaaatgaaaccatgctaatgcctgcatacaattctgacgggggtaatcagccctgttaaaatagaacagtgtatatgacccaactatatgacactctggaaaaggcaaaaactacagagacagtacaaaatcagtggctgccagaaatttaggggaatggagggagggatgaataagtggaatgcagggaatttgaggggcagagaaactattccgcatgatactataatggtagatacatgtcattatacatttgtcaaaacccctggaatatacaacaccaagagtgaaccctaatgtaaactatgaatttgattgataatgatacgtcagtgttagttcatcagttataacaaatgtacctcatagatgcatgcatgatgtcaaggtggagaaggctgtgcctttatggggaaggggttttgtgaaaactctctgtactttccactcaattttgctgtgaagcgagaacttctctaaatagaaaggtgttgaaatgatattaagggccactacatggggaattttcaggtgttgggagtgttagtgtaccccagaagcccagcagaggatcattgtgctgtcaggacctattgtgatcagatagcaccagagccaaaaagtatggtaggttttgagcacagctgccaccagcacaaaccccccaccaccctttccacatggaactggctggcctgcagcagcaggcactcagtcagcacatgttaaatgcacaggcacttttggaccctgcttgcactcactatagcaacaaggtcagcaggccaccttgccttccgcggagcccaccaactcatggtgccctttggatctctttcccgctacagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagcatcctgcctcctgttcccattcctagtagctaaa

SEQ ID NO: 96 - DNA, 50155 bp, Homo sapiens
ctgaagaaaggactagtctgacaggaagaattacaaatctggagctcattttggcgtcgcagagggaaggtgggtggagcgtctcgcagtaaattaggaattcagaatgaaaacgtagagtttatttgggtttttagtgacacctcaggattattatacagcagtgtcagacacagctcaaagtaatgatgactgctccccctccgccccgcgggagctgggtgctaagaagggggaacccctcctttgaggggttggggtggggatcctccctttccaacctggatcgggaaggggtttgagaggagtgcggcttggatccccatcctggatctgtgctggagggaggcgggaggctatttgggggtgtgtttgggctcaggatctgggtctgacgctgggatctgaggactttctgggtttggaactgggtgggggagctgggtttggggtgaccgctgggagcaggaggaaataggagagtgagtcgcatgtgaagggcactgaggagggatcttcgggggaatgctgaagttgatgcgtggacttggagaggggaagttgaagtggatgcaggggcctggcgctgcagcggatctgggtggcatgtgctgggattgccaatgcggagctgtgaatggggtcagggtggggctgaggcagtaccagatcttccgcgcctagaggaggttagaagaaaagagcgtcgaacggccacagcctttttccgaaagagactcacacagacacacccatcgctctacccggccctccggggctagcggctgagcggtgctggggctggcagaccccgcccccacgcggcctctcggagccgggagccgatcgggccggggctggggtctggcggcccagcccccggggagcgtggggcgtggccagaaaccggcgctcgcggctgcggattggctgcctggcgggcccgcaggcggggctcccggctgggtcccgcttggcagctcgcggcggcggggaggcggggccggcgggagcccggcagccaatggacgcgcgtcctccgagcagttacaaagggccggagcgaggccgccgcggcggctagggaggtggggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacgggtgagcggcggcgcggcgggcgggcgactgcggggcgcgcgggccggacccggcctctggctcgctcctgctctttctcaaacatggcgcggggccgggggcgcaggtggcggcgccggggcccgggccgggctctcgtggcgccgcgcggctcggcggctgccgggcgaaccgcaagcggggagcggaggcggggcaggggcgtgtgtccgggcgcgggcggacgtgtccggctgcccgaggccgccccgctcgggactccccggggaggtggagtcgggcggagtcgtccgaggtccggggctgccctctggggtgtgagtgggcgagggccaggggcggagagtgcgaggccggcggggactggcagagccgtggctgcccgccgccgccccctgggcacggcgtgaccttgttctggggacccccgccccaagagggtccgtgccagaggctgccgaacccggggcggggtttgaggttggggtggaaggcggctcccgggcggggtgtgagctccgagcctctagggcttcgtccagtgggagtcgggggcgacgtgtggtgagacccctgggtccgcaggccgccctgactcccgcccggctcgacccgagccgaccctgctggaaggggctgctcctccagccaggggggctttgtgtgagaagaaggaagcgcggagatgcgcggaatgtttcttctttcgtgcgtctggggagtgttgaagtgagtccagtaaccagacggctacggattgttttcatagtggaaacttgaacgtttgctcattctgcgggttttggaaattttgggaacgactgtgaattgattaaacgctttttatttcctcgaaggaacatcactcacgttgttccttttcttgagtgacagttaatagtttgattcagacatctgtatagctggttttcaaggaagactgttggctggatttttcaaaatagtaaatcaggttggggtaggtggttggtatccacaaagggatgagtgaaaaacttcgttagcagctgaactgagacactagaagctaaaatacacagcctcagtgttagcaactaaaatgcagtgaaagtacatttctgtttctgaaactggacaaaagatgttgaaatttttttaaaaaatcaagactgacggtgacgattataatcagtcctaatagctaccgtctatgtattgtgcattactacgatgtaaatgcatacactattgtataattacattatttaatcaccacaagtaaactcccaggagtagtggcatttgccccactttacagatgtgcaaagtggggtacagacacgttaagtacccaataacttaagtgctaaagctaggattttcactcagatctcagtttcccaaacctgtatgtcatatatatatataaatatgtatacatcatactatctggcgtagcccatttttcttcttcagtcgtctgatgagcaattggtctttattatccactttggattctgtcctcatgatttgagtatcagataggcttcattccgactcttagcacattgttgagtcccttcacgtgggcctgcattagaggaaacaatggatttttgacattggcctagggaggaaggcaggataactgtgtggacatttgggagaatcagtatagttaggcatgaaacacaggtaacatttccacaccgctattaacttgaataacacagtgcactcttttccaccagaagtagcacaagaagcgttcatgtattcaagtaacagtagtggacttagttgaagacacagaacattgctcagtccatgtcctggaggagtttacagtctccatggtatgcacaaaatacaaagctgtccaggtgcttattactctaagcccagactgcctcagcttgtctgcctcccctgttggttatgatgatgcctcagtccacccttaaaaaacattctgaaaaaggtcaaatgctttttatttcctctgtaacttggcttcccttttaaagacttgcacctttttatgttctgagtatgttttaatgttctctgcccaacttctgtctccaacataggtttctctagggaaattgattccttatccctagtgcacagtttagtaccactatgtctatatgtatatcccatctgagaatgctatttgcttcctttctgccatttcataactttttttctttgaaaacgtgcccccaatccaactcttctatgaatgcctcttgaatgtctcctcctttcttggtatgcagccttcagcttaatcctgcctgttatcctccaaatctagttgctttcccatgtttttctcatctaggcttttctatggctactgccaaactaatcttcctcagccttccccgtgaaggtttataagatttcccatttgtattcagcacttagaacaacacttagcagcttatgattggggccatctctgagtatcctaccagggatctcatttctcattactgcagaccttcgagcaatttctctttctcactgactcctgactgttcagccttttcactacacatttagttttgcccctttttttgggagtgcgagaagttctcagccctgacttcctgtgctggtttagttcttgaattctttgtcttccagaactctgcaacacttaacagtttgtgttgtccatttctactgcctgtgctgctacttaactctacttgaatgcgttataggtacccagaggacaagattcatgccatttctttcttttgtggcctcagaacttagcactgtgttttatattctattccacataaatgcttgttgatttctatttgagcattcctttaatatttatactgttttatgtaagtccagtttatgcaatattaacttgtaattccgtataaataatcaggaaaagttgtatggcgtgttgaaagcaattggttatttgtcctaccttcaccagcagttatgcagaaaatggggcaatacctacttttgcctaattcatgagattgtgaagatcacatgagaaagtggtatttgagtttgaggttgctattctgtgttgttgctaaagagcaggactgatgttcaataagcagttcccactgggccatgtgtgttttggttaaacatcctttctgattggttggtacccttgtagtgccagttgttaaatatttttaatatcatttctatagggaggcattagtattcaaaaagggaaatgattagtgtaagctggaatgattgggggaggcttcttggacactttaggacttacactgactttgaagggtgggtagaattcagagggggatttgatgagtgtgaaagttcttttgaagttgtgtccccaactgtcctggggcctactccaagggaggaaacaaggcttttactgactgactggcaagttactcttcagagttaggttccttattctgtactgtggaatttggatgtattaacctctatcattttttccccaatcctaaaagctatagtacatagctggaaacaaaacataaaagtaatcaaagtggaatgagtgagggagaataacattatgggatgcccagtaggactaggcattcaaatggtggaagtcctaagtatattatcacttcaatttacagatgaaaaaacgactcaggtgaatttcttagggtggcacaggggcagaacagagacaggaactttgattttctgattccatatcttgtgccctatatggtgctttaaaatgtgaaggacttggaggtgggagtgggacagggttgggataggtggttggcatccacgaagggatgagtgacttccttaagtgaagtaggccttgaacttcacagaatttatgaaaagtgaattctaaaggtggaagggagggggaatgattaaagccttaaagttctcaaggaaaaggtcaatttttttttaattgctgataaaaggacctggtatatacttattgattgagaaaagtaggcctatagtagtttggaagatggtcttgagtaagtacagttaattgaattggggtgtagttagaaggctttggtttagaatattagatgatccgctttgttgttgaaattaagagaggaattgacataaaaataatcaagaggaagataaatcttgttcctgtgaggagggccgctcatgtagggaagacccctgtcaaaaggttctaggccttagttgagcagttacagggactcaacaccattcttgtagtgtcattttattgcaccaaatatgttcatgtgtaataaatggaattttgaaaatgccattatcctatggatggcccttctgatgtgagaacgtgtctcttcaaaccacagagccccttgcaaatgtcgacacacctcttgccttttgcagttcttccttggtcatggcttacgtaacacagagttctctgaacagatggactgtggtttgatatcatgtgattgggtcacatctttgcttcctgcttttggaattgagggcagatgctggcatatttctcagggattttttaatgctttgtcccatagaactagcttgaggaaaagttttggagtcttctcagaatttatggtcagttttgacccagcctaactccaatacttaggattacatttaatgccattcttagctgaattttctcaatgtcaaatccaggcagtctccataaacattaaaattgtttaccactctgaattagatccaattttatgtgttttgtttgctttccaggtaagtttcttatggctacccttcttcatcatgaagaaaattggttggtagacttgtaattattcatctcagacatcactttcttaaatactagtggactaagttcagttggttttatggtccaattttatagatcagatcaagtcttttataaagctgctccctcaaagaacaatttctaatctaacttaaaaaaaattgacttgcaaagtatacacacaggttgctttgaaatttcttgaagggttgcaagaatatgctacatattctatctgtcttgtctcgtttaattctctcttctctctttttttttctttgaccatggctaatacggcatcatttagttctcataaccaaccttgaatggtagttgtatagagtaccaaaacttcttacttatttgctgcttaatttccaaactcttaagcccatttgttcccagatacaggtgaccagtgctcagaagataactgtaggttttgataacatcggctctaccccaagattcttttcaactctaaacattatccaaaggtgttagtattttttcatcgtctaatcgtaaatatatatataaaagaaagacactgctttgaatggcacagatgtagactaacagtagttcagccactgagactcaaatgattttgtattaccataaaccccatctgcctgggcaggcagaattgacacaattttgctcagattggaacctagttcatatctatgaaagaagaccctctttgtttccattttatagaccaggaaactgaagttatgctgttaatgaaaggtggagccttcagttaagcactccagggtatgtactcttttcctatacaaatgctcctctacttatgatggggtcacgtacgtccatgctcctttcatatagagtaaatacattgttagagccacttcagcaggaaagtttcctttcccttttttgcaaaccatgagaatttgcttcagattgccttgattacagttttactatttctttgcaactgcaggccattcagatactaacagtctttctttaacattatatttttaggtaatttgaatcttcctgacgagtccagtgatagttgatcacttactatttgtattgatttatacatatattcatagcaaattcttttcttctaaaagttacataagcacaggactgaaaatttgtattagagaaaggaaaaaaaccatcaccagccattattaacatttggcatatcctgcacccatgcttttttttttttttttttttttttttttttgagtataaaaaaccattcttgggctgggcacagtagctcacacctgtaatcccagcactttgggaggccgaagtgggcgaatcacgaggtcaggagttcgagaccagcctggccaacatgatgaaaccctgtctctactaaaaataacaaaaaattagctggacgtagtggcaggcacctgtaatcccagctgcttgggaggctgaggcaggagaatcacttgaactcaggaggtggagtttgcagtgagccgagattgcgccactgcactccagcccgggcgacagagtgaaactccatctcaacaaaaacaaacaaacaaaaaaacagcaacaaaccattctttaatcattctatttcagcagtttatgaaagctaataaaagtgtttaaattgacaaacagcttcagtttacagaggaaagagcttcagtttacagaggaaatagctcatctattcttagcaaatatttagtagtgatcaacatgatgagaaatataggaaaagtaagaggcagtcttgcttttgaaaaaattgatgctgaggaaatatgactacagactcagtactagcaaccacagggactgctttacagaggaggtaggacttgatctctctgccttgcaggaggatagggctttgagtggatgtgtggtggaaaggaggcacttcttggctggagaggatggcatgtgtggagaaagagcattctaagtttcaggatttctaagaggagaaatggaagttcatggtgtaaagggtgggctcagagaattatgggccttgaaaatcaggagagtggttttaatgtggaaaaagaatgtctaattgtgccgcagagggaatggatcagggtggctacccagttggtttgatggcattgagaacggggtgaaatggtgactgtatgacatttgaaacaaagaaatcagaggaattagtagtagggcctgtgtgtggctgttcccttgcttgtgtgctcttccctcacatacctgcatggcttcctccctcacctcctgcaagtctttgctcagatgacacctttttctcagtgaggcttatcctgccaccttttaaaatattgtcatcatcctacagtgctttccttctctgtaacaataccttctaacatactgtatttatttacttatcatatgtacttatttactgtttattgtctccttcctatcattctatgctttgtgaaagtggatgtcttcgttttgttcactaatgtatctcaagtgtatggaaagtgcctggtgcatcctaggcactcagtaaatatttgttgagtggcagtaggtcttagctgtaaagaggtggagtacagaaattcagagtgactccatgaaagaaaaaagaatgactccaagcttttttaggctggataatgcctttaacttaatgagtaatttggcacgaggattaaggggagacgaattctggtttaagcatgttgagtttgaggtgaaggtagccaaataaaattgctcagtagtcagcaaagattaaaaaaaaatggaacctagttggaaatgggagagcaccttaagcaaagaaatggctactagcatctagcattcacctcatattctctctctctctctctgtctttctcttttgggggtaggaggattctagtgtcctaaaacgctaccttaaatggagtttttatttagaccctgaagtcctagcttgtatctggagtcctggtccgtttgctgggatatggttctttcctgttttgcaggttcatgctatttttcccccacctctcttagtaaagatgtatatattcagaattacttgtgatcttctggttgtattgaaattaaccttcagacagtgctgctttctctgcagtaatgcgtttgatcttttgggagtgtggttcttggctgagataaaagagaggaagtttcctgcttgcggcctaggcctcaggtcatggttgctgatgttacaggtgtcagctttactatctcctggagctccctgatggctatccttttaaatgcttttcctgttgtttttctcaatgaaccaaacactggtgcagttgtatccctagaccatctctctttttctatttggattgatctaacttaagtttttctttcagttttgaaggcagattaaattcatgtgacttggttgtcagaaatttaatgaaatatttgtttataggagtagtatataagcaccaacatatctggctgtaattagagtctaatcagtgtatctgtgactcacttttcaaaagaggatagttcctaatttacctgatcgttgtgaagatagtgtacagtagtatttacacttagtacatagcctgacaccagtaggtgttcaataaaggggaattattatatatttaaataagtgaaagaatgtcttctgaaagaagaaatacatgtctgtgtaatgaagaactagaattaattggtagactgaaaggcagaattcagctcaatgtaaggaatgactctctaccatagctgtcaaaatggaacattgtaaggtagtatgttccctgtcaccctggaactattcaggcagaggctagataaccttctgtctgagaaattgtagaaggaatttcttacattaggtaggaggtcggacttgtttatctctaagctctgtttctcctctaaaattctgtacttttgggcataatccaagcttccttgcttactggttttagccaaatatagtctaaatatccctaggattcatggcttcaagatgagcagtatcttgttgctcctgtattatacgagaaaagttagtttatccattgattggcttttattttggtcattttccaaaaaaggattttggaagcttgaaataatagcaaattcagtaagaccaaatctactgaccacaaaagataagaatcagtaagtcaaaaagggaaagaaaaagagaacaattatccgtaagtttagctgaggaaagctttagaagttgaacacaatacttagctctgagttttctggtaaccaaggcaagtaaggaagactgataatttgcatagatctcattgcctatcgagaattcatgaggagactgccaccttccttaataaagtggagccccaaatgccaagattgtcatacagggagaatctccaagtggtaaggggttattgctggatctggcaataatctgattcttgttctgaggcttcccctttaacacgtattgagggttcaatttagtgctgctgcctccatctttcttctccagtttaagtctctgatccaagtatgaacacattagtctttccctaatgccaatggaacagctgatgtaaggctaggacatttaaatcaagctttgctaaaagctggaggataatgaatagagagcaacatgaaactatttagtctggcttacaaagacatttttctcatgcccttatcttttggtgtgtctccatttgatacacttcatcagagtactgctaccaaaggcagagccagacatttaccttcaaacaggtgcaagtcagtaagatccagagtgtctttgcttgggtttcttgtttgaagaactgcttcatttctgagtaatggacgttcggaatgattactttaggagagaccacacttatctgagagtgtggccctactgtactggtctcacagtaatcccagtattcatggaaaagataggcacgtacattagcatgagggcattctgtggttagaagcattctgatttcattgggaaaaacaagcttctctctgttcttgagcagaagcttttatagaagtctttgtacatgggccattgaaaaataaagtgaacaattcgggtttatcactcatgatttgtaaggattcacttttccttttttctgcagttgctgtactacttcaggtctgttccagtgtttccttgttctcaccaccaagactgaacctccttatttttgttcatttgcttcaggaaaaccattccatctagatttcctaggtgtaaacctcactgattacataatagtgtatatttatagttctaggacaccttcttcaggcatcctgttacatttctacattataagattcttaaatatgcattgaattacaaataggtccccagggaaaaggcaaaaacgaatggctttttctgcgagaaactaggactaatatagatatttgggagcactgaacatggaggatagagttaaacttgaaaagacatacagagatagaaaagcagcaactgccctttcatttgtatgcaagcacacgatatatgtatgggttttttattttttgcttgatgtattcatttccaaatcaaactataatgtgctctaattgggtctctttgttcagcacgtggttgttgatttgagtactttctccagttgaaaaactgacattttaattttgttattcaatgtgtgatagatttaaataaaaacacccaagattgtgtattgtagatttccttcaacaataattatatataattattttatcaaaataaacaagttaaagtagttttagttattttgtctcattttacatttgggaaaaaaattacaaatcaggggccagagtctggtcatgtttgtcagtgaggaaagacaatttctgattgccagtcccaccaaagcgttggcagattaacacagcattgtagattactttcctaggaagagatgctccttttttctccctttccattattttgctttccttctttccatggtgcattgtccttttgttttcttccctcttatttcgatgcatgtataaacttgagcctttctgctctcacattctttctccccatgatcataattgtttcttcactttattcttaaaaaaaaaaaaaaaggccacataagtattttatgtagatctcatctatcatttaagttttgtcagatccagcctgctcttgccttaccatgggagaagggaaaggagggaggagttttaagggattttaggcatcaggcagaagtcttaagggaaaactctgcgaggaccaacaggctcagaattagctgtgcattgcaaacagatggtgtgtccctgaggaaatagcgtagttgccctaagcaattgggtgcttccatctgatttagcttagtctctgtaactgggaaaaaggaaaatcttatggaagaaatgagtataatcacctgtgaaccattctaaactattatctagagactagtgattattgacttacatatagatttcataattctgcaagatagtcttcggtgttgtatcatcagttatccaaggtataaataacatcaagacccttatgcctctgagcctgatagatccttatcttttaataaccaaccccccactttcttcagtagccatgatgctactgtatcaatgctaccagcaattggaaacccatattcctaatgccaagtctcggcatgtagattttgaggtctgaaaactttattagcttggttacagtacatctcaagcctaagttttcatatacacatagtttagtctcaaagggcaaatgtttccctgaaaggagttcagtcaacactagatgcttatatctttaggctccaagggagtccaaaatttaatgattaaaaatattataaaaatgcaaatatagaaataatacaaaagctccttccttttggtgggcttttctgtccttgcttggttcaattcagctgtgttcttctaggagactgcaaccacaatttaactgctttgctttggtattttgtttgacaagggagatgaatgtttcagatgagacggagtctcactgttgtcacccaggctggaatgcagtggcgcgatcttggctcactgcaacctctgcctcctgggttcaagtgattctcctgtctcagcctcccgtgtagctgggattacaggcatctgccaccacgcctggctatttttttttttttttttgtatttttagtagagatggggtttcaccgtgttggccaggctggtgtcgaattcctgacctcaggtgatctgcctgcctcggcctcccaaagtattgggattacagcgtgagccaccgtgcccggccttcaattttttgctttaagttagaatcctgtttgcttactttttctgacccaaatgttttaaaaatgttttcctgtgttttcatttaaaagattggttttacctctcacattgagatgtatctggagttggttatttattatggtatgagatttttattatttttaaaatacggatatctggttgactcagaaccatttattggtaaaaccttttttcccccagtgtacaatcaccttcatcataaatcaagaggttgtatatgtgagggtctgtttctctgtaatctctgttctgtttgcccatttgtccttgtgccattaccatactgtcttaattattatgatgttaggagtcttgatatcgagtagtgttaagtctttcaaagattgctttggttattcttgcgatgttgtttttccatataaatttcagaatcaacttgtcagttcccactgaataaaaaaaccctgtggggattctgatttgattttattgaatctacagatcactttatggaatattgacctctttacagtattgaatcttccagttaggaacttgtcacttttctccatttataaatacattttaaaattttattttatctcctttgtaatttctatcaataagtaatattttttaagctttctctgcagaggtctttacctgtcttttgttaggtttattcctagtttttagatttttaaaaaacgttttctatttattactggtttaagaatgattttttaatttaattttttttggtatagtgagtaaccttatattagtgaccttgctagattgactaattgattctaatagttgatctgtaggtcacttttggattttccatgtacatagttgtcctctgcaagtaatgatagttctgtgtctttccagtctatcttccttttgtttatttctgacttactacactcagacttctaatacaatgttgagaagtagtgatggatatctctttcttatttgtgatttcaagggaaaatgacagtcatgcaacattaaatgtaatgcctacttttatgccttttatttaatctgattatttcagaattttttttaaattctgcaatttactgaaatttttaaatatcatgaatagctgttgaattttatcagtttactaagatttttaaaaatcatgaatagctgttgaattttatcagtttttttgtttttgtttacatcacctaaactgccaaactcccttactgttttctttcttttttttttttttttttttgagacaggatctcactctgttgcccaggatggagtgctgtggcctgatcatggctcactgcagcctcaaactcctggggctcaagtgatccttgtgccccagcctcccaaatagctgggactacaggtgcgtgccaccacacctggctcaaacttttattttggcatcttttgtacaatgtttttgtatatcctctacctaaaatgactttcctttcttcactagctttccttaagtcttagtttaggtgtcatatttcagagaaatctcccttttctgtcctctgatctgtgcactttgcatcatcatttatcagtggtgtgttctctgcattgtgaatctgagggcaggaatctcaatcctaattatctctatcctcctaaaggttttttctttcttcctacacaggttacattcactgttgtgttctgagaaaaggtgttcaggccttgctttctgcttctaaaattactaactgcccaggaccatcagttcatttcttcaactgtggctccaacagatctttcgctgtttgctggcccaggtattgctctcctctgccccgagtcaatggcagctgggagtggttaccacttccttctcttaccacagttccttctctaccacagttctgttttgtatgtcattcccctagcccaggatgatcagccactttcatttacgttcattattacaccttattatctgtgcaaccaagccagtctctcctacagccactcgtgctttccaaagggaaaggttgaaattttcggttttgtcctacgtgaggggttgtggggagtaggggtggaaatcactgtagattatcaagtaatcctttttttctttgtgtacttttggaataaatctagattatgttgatgtaactgttaggacatttctgtttcttcatctctaaaggagctgggatctgatatttctgttcatattccttccagcatgaacattttatggctaattagatattaacttatttattagggatattacatatacacactgggtgtgtccctacactgttaatttgggttggaactgaaaatatactttctgtgtgtgcctactgctactgtagtgaagttcttgagccaggtctgttcagtcatattgttgaaaaactgtatgaatatttatgaaggagaaagagctgataggtaccatgaacattcactgttgtatatgcatatggtttatattgtgttctgtgtcagtattgcctaccagagctgtctcaacattagctctgattctctgtctagcatctagaccagagactggcacgtaataggagctccaaagaaatacttgttgaaaaagtgcataaactaatttttgaacattttattatgtgctgggcactgtgctaagtattctatgtatgttatttcattaaccctcaaaccttctgagattggtactgtttgttagtatgttataaatttaggaagtaagttgaagaaatttaggttcaaataagttaagtgacttcctcaggattactcagtgcctgactggcaaagataggattttaacttaagtttttctgtctctgagttccatcaacttaactaccatatccttataatacctacccactagtcaaattaaaatctaataagaaactgtgtaaaagcatacttagattgagaggaaataagaaatttggttattgttttagcactcacctttagacatagaagtttctccatttcttttcagggcctggggtaaggcaaagtgtgcacatctgctctgtatattaaaatatcccctcaactcattgaagtggaacaaaaacaaggtcacttgacaggactgtaattgtaatcacactatacagctttacttcctgccctttagtagtaggaccattcccttgtccttaaacatgcttctaaaataccagttttaatggctatatagtctttcatttatgattgtataaggattcattctgtcattgtattgtcattcacataggttgttttcaatcataaaatactgtaatgaacatctgcaagtttagatttttgctctcacctattgtttcctcagacaactgtaagtagtagaattgatggattaaaagatactttttaaaggctctgactcttctaaaatgtgttgttaaactcctcagatctgctaaccagatctttatgctgtacttgtgtgatttatttcgaatctaagtgaaagcctttgtattagttaccctgttaaatcccatcttgccatttgggcagcctattcttagtgtgttttctctgatatcagttaacattatattggctaattccatagaaactaggagactggaaaatgaagataatgtggaaaaacaagagcttgtgaatttgggagtgccctgttcttttaagatgtgatgtgggttaaatgataaacaatgcatcttaaattctttaaaagtggcagaagtaaatggaatttatctggaaaaaaatcaggcgtttattctgatgccctaaattcaggggtgaaatattatctggactagaggaaaattttatgtacattatatggtgttctctattttgacaagcttactttgatattactgctgcaaggtagccccaggagggttgaattgagaagaactgagtattttgaggaacaaaacctaggatagtaggctggagggaattggaggtcagggttttagccatgtatacagagataagcaacatatttaataaaaagaaaaggagaatctatatagtatgctttactccaaagctggatgagggagaaaagaggacacgtctccttgagaagggggcatgtgttgagaatggagaaaaggggtaaggcagattactcagaagaactggggtagaagaataggttggatgataaaaggggctgacattagtccctgaaagttttttttaaataacttccaacttttgccttcacctttgccagcagtgatgtgatctgctttcagctgtagtgaagcaaactgcataaaggacattgtgcatgttaggtcttttacttgcctgttggtacatgtttgtaatatttggaaatactctcactgcgaagaaaagtatagttgtgctgtagtgggtagggtgaggaaaataagggtcatcaccagcaaagtcagagtgatgaaaaaactggattacaacactctgcttgactttgcatagataagtaagccaagcagagtgtttcctggatgtagttaaaatacaagcttggagcacaggtaaaaggccaagaggcttggagatgtacatctgagatgtaccaaagggccaagtgcaaagtaagtttgggaagtttagtgtcatataaaaactaataaagaaagggtggtactctgtctcatatcctgaaacgttttgaaaagaatattgaatttgaccagaagggcattgctagtgaatttcaaagagagatttcagttgagctctgaactggaggaagatgggtgatagaaggctggagagggccagtaacaagggttgaaaaaggaaagagtattcaagcgtatgcataaaaagactacgggtaggttgtgtagatgatgacacactaagcctgggaagacaaggtttcggtgctaatttttatttctttaacaagggtgatagaaatatctgttccatatattaatactatacacaactgtttacctctcagcttttctagcaagacatatgggcttgtgaattaaccctgggtagccctggcattagatagaattaatagtgcttccatatgtgacctcgagacgtactgaaatgaggcaaccaaggaaatcctttatattgggaccaagagccaagatctcaacttgggatatgttaccccgagagttgttaccccgatactataataccatgaataataaccccaagggtcctgttgtctctttttcctcatgtcacttcctttggtactaactgtcaccatgctaacatctgcaaactttgaaaattctgatttattctgcaatatttggaaatttcactgctagtaattgtatttcctggcatggttctgatataattttctgtgtacacagtagcttttccttttagtgctgaatcacactgaaatccttgtttaacctaagttatagttgcaagggagctatcaagacaaataattacagtgatggtgaagtgaatacaagtcaaacatcccaatctgaaattcaaaaccttttgagcacaccaacatgatgccacaagtggaaaattctgcacataagtacttaacatgacctttgtttcatgctcaaaattatttcaaatattatattaaattaccttcagactatatatataaagcatatatgaaacatgaatgaattttatacttagacttgggtcccattcccaagatgtctcattatgtatatgcaaatattccaaaatctgaaaaaaatcccaaatccaaaacacttctggtcctgagcattttgcatgagggatactcaacttgtaatcttttctatgtatagccaagtttgcacatacataggttacaacaacccatcatgtcttaacctttcagtctggaggctggagttttctttttactttgattgtaaattgtattcagattttagaaatgtaaagcttagagaaatgtgcatctcaagattaagaaagctatgcccactgttaaagactggggcatggaaacaaagttggacagtgtagtagaaaggtcctaaacaggggatttggttcttatttttgctatcaagcagaagagtcaaaactgtaggagtctaaaccaaatcaggtccacctgggagtctttaaagttcagggttacttagcatggggatagtggtatagcaaatagttgcgtaggtttcactcgtgggctggtgataatatagtgaggattcacatccgcctgtaatctgggtagaatatttgtataaatcattttggttttttggttttctttttaaaatttttaaaattgttttgcttttcttaagttttggtttctacattaataaaatgacagaactgaattgcctagatgatattcaaagtttcatgtggttctgttagtctgggattctacagtggaattttgtcactacttttgggaagaagtttacctttggtggcctacgaataaaaaccacattggcacaatgccatttatcatatgggataattctgtgtgtttatataatcatttatgttcgtttccaaatgtgttaataaagtacagtatctcatttgattagctcagatgatgaaataggtcagagaggtattatgtttattttcctgatgaaataaaacatcgtagttagcatcttgaacaatttaaatttgatcatcttacttggtatgccagccactaaggatgaaatcctgccactgagaaagaaaacccagtcaggaaagctttctcacccttatctatctaacaaattgtacatattctccaagttctgacttgaatgctggtgaagcttttcttgataatctcttctaccgcagcagagtagaaacactttgatcattcttctcaggactcaggattttaattatctgtttaatgcctttcccttccaccctagtgaactactcaagtgcaaataccttgtcttactcatctctgcacctcatagcccacactgtacctggcatatagagatgcttagtgaataattgcagaattaaatgaaagagtcaaggtgatgtgttgcagagtgaggagaacttgggctttgggctggcggaaggaggtgtcttcgtttacgttttttagattgaaattttgccatgtatatgcgtttaaaaatttaaaacctagttgaataaaaggttggggggggcagtatccaggggccaaatctatctattaataaaataaatttgaattttttaaaaaaatggcaattaaaactcatgttcatggaaaaaattaagttcttattttagtttttccctaaacgatcttgccgtatcacataacagcagtcttgtagtcaatcaagactgacttcaagtggtgaaatggaattttttaattccctgaagagagaaatctttacctagttaagctttgtgttatcttgatgtttttatttgtctagtgacctcttctgattgaaagagtagttaagaaaaaccctttagtactgactttttcaaatttaccgtaatgtaatgacctctttgaaaggagaagtacagagtgtatttttcataatgttacttaaattctgtagacatgaaactagatataaaacccttatgttcttggctcatacaccactataaaccaaatctgcaaattaaatacaaagacaactacaaaaaaaaacaaaattcaaatgaatacaattattccatgtgacagatgatgtttaggttttgcagtagaaaaaaatagctttaggtctaattccattttaaatgtgtttctgtattttaacttcagtgataataaaagctgtgagtagtgcctcttctcatcagtaatgttatgcaggagggcattaatgacttcaaggccttgttggtaagttcaggatgagacatcatacctaaccaaaacacttgacagcaagcattcctcaaatacaggcttataagttttactgagatgtcatccattttgttcattggaagataaggttaatatcttgacattattgaaatcttcattaaatgattttctaaaccagttattgctggaaatgagaatggaaaaacattgcatacctacaattatatttactgctaacaaatgtttgcaaattgtactacacatgtaggacccatatagcacttgcatataataaagtacatatatggtattggctgttaggctattggcttttgaatatgcatgccatgcctgtattgccatatggtcgattcaaattccctttattttttactctttcttttacaatgaccatgaaacttatgctgtgtgtagtgtgccacaaggacatttggcctgaaggggatcttcacacagctgaagaagcagcagtgaaagcctagtgccagtgttgagacagtggctactcatgatcttgaatgtttatccttgtttttagattatctttgaagtgaaaatatgttctcaaaccttgtacccaacttatacatcctttttttctcccagcatatttgggagacattgttttagcaaatatttttctgatcactatctaaggagccaggattcagagatgtgaaaaacaaaacaagcttggcccttcctgaggcaatgaaagaccctttaacagcaagctataaatagattgatttgtgctgttctaaaggtatgcaaagagcactatggaacatattgaaaggagataccaattattgtgaaggtaagggcgaggtttagagcacataatggcaaagatcctgttgaaatagggtcttaaaggatgagtcagataagaagataggtttaaactagacagagagatggtatatgtaaagaccaaggtcatgaaagacattattattataatggtgagaggtgtgtggccctagatagcatttgccatgtgagaagtaaattggaaccccaaactaaaagtcttgttaggctaggtgtttagcccttatctcatcagcataggggagccatggtgatctgagaactgggagagtattcagggcaatattttttatgtatagcggttaccacattgtattacagtgttctccttcacttgtcattggagctcttcaagtgctgtgaccattagttattaatctttgtgtgctaagcttttggtagagtaactgataaaagtaatgcttagaaaacatgggttgaatgactaatcatgagtaaagaggatttaggagagaattatgacaatgtccttcggtggtagttttaatgctttgtgggtcacagactccattgtgattgacttggaaagcttttccttgaaaatgtaaatacatataacatttggcttatagttttatgggattcatgtacctctgaagccagtccatgaattcctggttcagaattcctccttaggaaatcatacccagacagccatcaccatcacaccttgtcatgaataattactgtctcttttagcagtctttattacgattgtgtctctttcttgtcatttccttgagtttctttcatacttaggaagcaaatagctgacctgtctatgaataaagaaagcgtttttaataatgattaaggtaaaactttactggtctgtaaagataatagacaagtatgtgaattaagccagcaaccaagaaacagctacttgagggagaacctgacattcctgaatttgagttgagcaagtgagttgggagtctgcagggccatcctcagacttggtttgctagaaggactcacaggactcagaaaagctgttacagtcatggttatagtgtattacagcaaaaccatacagttaacatcagcaaaagcaaaaggcacccggggtgaagtctaggagaaatcagacacaggtttccaggtgtcccattccagtggcatagcatagatggccttaattctctcaacaacaatgtgtgacagcatgcacgaagttgtcaaccagggaagttcgcttgagccttggtgtccagggtttttactgttggtcagtcacttaggcttgcagcatctgcatgacaggcttcagcccctcagacttctcctacccggccccccagcagtaataggtgttcactgtaaatcacattgttagaataagctgtctgacaaaattggtaccatgtgacccaaggcctcaggcatacagaaatattcttatcagggagaatattccaaaggttcagagctcatctaccaggagccagccaaggccagttttgaagacaagtctttcttgggaatatgcagggtttgagcaactcagtcctgctgagttaaccctttcttgtacagcaagttagctcttcagggagttagctctgtctatcctgcccctgtctgcctagccactccttttctaggtagagtggaccttgctgttcacgtcatagatggccattccgtgtacctagactcctttttattcctttgccaacaagtaattggaatgtttggatttaagaacatgtctgtgctttgcaatttcatgtgaccatggtgaaattatgcacacattctatcattgtgattcaacaagtattttttgaatgctgctgtgcatgaggcatggtgttagatggcagattgacagaaatgactaatacaggtatctggcctcaaggagtttacagtttcataggagaaagaaaaacaaaactagcaattctggtaagcagtatgtgttttggagagcacttaacttcatcagagagcatggttgaaggtgtatctgtgtgtatgagaaggtgttggtgataattagaaggcttccctaaagaggtcactcctggggttgagccataaagatcaagtagatacaagtgggcatgaagctagtattttgctgccagtcatttctgtagttaggttgcctatgtggttggagcatgtatgtattgttacaggtgtagtctgcttggcttccctaagagaatgccccagtcctggccagaatatacatgtcttttttagggtttgcaccaaggggaatagagagtgtctggctcagtacaaatctgtttccgttactccattatccagaaagccactgaaatggcattagcctacacttaatgggtggtagtgttttcacacattgcttctcaaaggaggagtatgtgaatgtttagtttgggcctggtaaaaaaaaaaaaaaaaaaaaaaaagtataaccattacaaatttaaatgtactttgtttctaatgggaaggcaaatgcttgccttgctttgatgaaattgaacataacaaaatttttctatacttggaagcaaaaaacttcaggaaaaaacctgggtccaaatgttgctacatttccttgggcttccacgtgtatgtggttcttaatataatttgaaacttctaagagcaacaaatagttgttttttgcttctaagagcaacaaacagtgcatagaaattgtgtgataataggatcaagaatgtattattagagtgaatattggataatttcaaactgttaaccttgagattttttctaagaatctttctctttttccagcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactggtaagttgtataaaatttttttcctagatactacaagaaaaactcttcatactctgtgattttagaactggaagggatcataaaaattgtctaatccagctcattccgtttagaggcaagaagtgacttgtccattgttacagacttataagagtaaccaagatcctgcctcctgggtatgtgttgtttaagaaggtggttccagggtggacttcctctgaggtctgttatacctaaaaggatagataaaagcaaactctgacaaagcccacaacaacatcttcagattgtctctactttgttctcagagtgaatttcttcttccttgtataatgctcctatcttttaaagcaatcacagtcttttaatgagtggggattcagagcagcacttaacagtctagatgttttcattttgtaatttcagcttgttttatgatctttttgcgtaaattaattatacatgatttctagatttttggtccttcacctgtagtttacatttaaaatttcctggggctgggtgcggtggctcatgcctgtaatcccagcactttggaaggcctgaggtgggcagatcacttgaggccagaagttcaagaccagcctggccaacatggcaaaaccctatctctactaaaataacaaaaattagctgggcatggtggcacatgcttgtaatcccacctacttgggtggctgaggcacaacaatctttgaacctgggaggcagaggttgcagtgagccaagattgtgccactgcactccagcctgggtgacagagtgaggctctgtctaaaaaaaaaagataataaataaataaataaaatttcctggcagaaccagcagtttgaagacttcataaactttttaattttaagattccggtttaatatggaagtctgagcacatgtatttaactcttacctctttccccagatcccaaaggaatataaaaatgagggcaacctgtattaatgctagtgggattaatggtagaatgccacccacatgccagcacttgtgaggaacttctgcaatttacagtacagatgacaccagactagtaaagaattgactagccatataagaaaggttagtcatcgaaaagtccagccaataacttagacaaaggatttggggggtgaggttagggtatgggggcaaactctcagttcccttttaggaagcacctggcttcagtgctcagaggagcagacacagttgctcactctccactcaaagttggtccaggccttgtgctaattaaaggaggaagcactgctgtagcgcagaaggaaaaggccagtcctccacctgttcagcatgataatgcagctcccctgtggtaagggttggtcggactacaatatctttgtgactttgatgaaagcatctgcagttataatgtggcaaagaaaaggataattccagaatttcccatttccatcatttgagcttgaaatatctgaatagatatttacaaaaccttgtgaagaagtcaccttatttctcatgtttctaatgaacatatataaacttctcatttccagctctaggataagcaaacagcaaaaaattaccaatgaaaagttaggagttcaaaagaagtagtctgaactagatagattagatgtcatcctgtgaaataggtttaccacatgatagggaagaactttcaaacagtacagggtctattttcagttattcactatgaaatgagaacatttcacagttgttaaaggttgctttcagaagaaaagcccaactgatgaatgtttttaaaaatgcactattgagagcgaacaacagactggatgccataattttatagtcaagtttgggacaagttttaagaaactgtgttacaattcagagaaaagacagttggtgagcatattaagagatatagggaacagatttagatgatccaatatgcttattatcagaattccagaaaaaggcatgaaatcataaagaagacagaataccaggcaaaattaatgaaaaaatattaatccaaacacatataataaaaagtatcaatttcaagaataaaagaattatataagcatttaacacacataaacattggttacctgtaaaaggtgaaaaaaaaaaacaggttcagattttctgcttaaatatcaaagggcaaatggaacatttttacgatcacctaaaattcttgaaataggccaagatttttcatatacaaaggcaacagccttcttgccacaactaagttcagtgtacaagggtgcatggactcttcctgaaagaaattactagaaataggattctgtatgataagagattaatctactgaagatcttaagaatgggaaagatgtgatatgaaagaaatggtggtaagcagtaaaccagtaagactcaggatgaatgtcaaaataattgtaattttctgaaacaaccagaaaatcttaattattaatagaagttacaagaaaatgatctggacttaaaagtccaggaggttaagatagtataaaaagtatatatatgcaaactctgttaaaaaaaaaaagtaaaagatatgttctgcctttaaaaaattggtggacctattggccgggcatggctcatgcctgtaatcccagcactttgggaagccaaggtaggtggatcacttgaggttaggggttcgagaccagcctgagcaacatggtgaaaccccgtctctattaagatacaaaaattagccaggtgtggtggcacatgcctgtaatcccagctacttgggaggctcaggcaggagaatcgcttgaacccgggaggcggaggttgcagtgagccaacatcataccactgtactccagcctgggcaacaagagtgaaaatccatctcaaaaaaaaaaaaaattggtggagagatatatactgaaatgtgagttgtttagaagtgatgaagatgtatgtggttttttttttcgcttgttttgatattttgttgttttttttgttgttgtttttcttgctatgagcatgtactggccttggaacaagaagacaagccaaacattaaaaaaaatatgatttttaaggagatgttaataggtattgttacaggttattggtattagtgacctgatgtgataagtggggaaggtcctatgatattggcggcagttggccttgtaatgatggctgaagaatacaggagtaagtgggtgctgacagagctggtgtgcataaaaggaggcctagtgggagaagactgattcacttgttctgggtttgagccctgtaaactgctgtaatgaggctctttggctaagtggtggcagtggccagctgcaggaattgtgtaggattgggaaaatgggggttgccacctacagtgtttttgtcgttgttgatgtttatttcactcgaggccctttttcagtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtaacataattgtttctcctttttcctaagacatctttttaaaattaagcgatacttattttattagttttctaataagccaacttgctagaatgtgagatagtataaataatattgcaggtttgaacctaataaaaatctttaagcttgatgtatatatgactgtggctggtttaaaatagattggaacttaactttaactgttaaagcgaatcaataagtcagctccatggtggtataaatttcaaagcgttctcacttgtataatctaatttgcttttcatcactgtgaggtagaaaggataagaacaattattctcatatagatgaagctgaaggtcaaagatattcacatgatctgcagctaacccattctattcaggattgtttagcagcttgatgtttacatttgaaaacaggcatgacagaaatgtattcagaattgtgaaggttatttactttttaaacattatatgaaattgtctttcgtataggcctggttttttaaaattaaactaatgaactcttatgtcattttctcacttgagaaaaatgtctaaccaccttcttatttaatgtagttttggcccctaatgacgttttcttttctcagttctatttgttgatatttgtggcatcagaagtagatgagctaattgtcagagtcatcccaaggtggattttggcatagcagtgcttcatgtttaaactgaaagggggttatcttttactttttcttgcatgtggtttggaaaaatattaagagaggaacactcctatcccctgtgtttttagaatttgacacttggtgaagaataaatagatctaggtttcaaggcaagctttgtcattgattggctgtataaccttggttagaacatgtttcctctttgggcttctgtttcctcatcaaaaatatggaacccatactgttgataaaaacacttcaagtggtttgttaagacttttaaatgagatgtactatcctttgaaaagtatgagtcatcttcaaataagggctaaattcatgaataaagtgaaaatttgtaaagcgtatataatgaaaatttcactaattttggtgaaagcccatctctattaaaaatgcaaaaaaattagccgggcgtagtggcatgcgcctgtagtcccagctactcgggaggccgagacaggagaatcacctgaacctggggggtggaggttgcagttagctgagatcgcaccactgcactccagcctgggaaacagactccatctaaaaaaaaaaaaaaaaaaaaattttcactaattttataattgagtgatattaaaggaatgttaaagcagaagttgtgactgggtaagaatataattctgaagcataaaatcacatctaatgttgcagaaagctcatataatgacaaatgtctatttattttaaggaaatgaatatatattggtatgtatgcatatccattcatttaagaatgaagaaactgattttattacctgaattattcttctatagaatttggccatatgtattcaataagagagctctctccttgactactaggacacacacaggctcgcactggagctcacgtcccagaaggcaagcttagggattcctgaaacagttgtgcaaggaagacaatgagagtttggacttagatgaagcagtcttagtactgaaggtgtgatagtctttaggcaggcctggtggacagaggttattttagagctttcctgggacttcccatttattctcagttcagatcttcaaaaagattttgctcattctggaagtcatcctgctcaaaactgtgataatcaaggaccagagtcacagaaaatcaggatggctacagatatttggaattaatccctcaaacctgttctcttgtttctaaacttatactccggaaagacacagcactcatgccacttgccacagtggaataagcccacctaactgattaaaggaattggtgggtgggtggcagttgattactggataagaatatcttcattaaccttttaagatataaacatgagaaacaatggaataattctgtttccattatatatatatatatatatatatatatatatatatatatatatatatatatttctagatccatgagggaccatagctctctgttctctgaaagcttctctccctcctttgatgccttaccctgcaaaaacttgtctgcattgcttgctagctctgtggctttgggcagttaaccaatgtctcatgcttgagttatttcatctttaaaatgaaagtgatggattctgtgcacatcattggattgttgtgagttcaagcaagacaaaatgtttgcatgaaagcacttggtaaattgtagagttatgtccaaatgacaagtgttactcttattgaaaacatacttggaggaaaaatctaacatacagtatcagttgaccacattgtacaaaacttagtttaaggcctcctttgcctgtcatagttcattgtgtactgaattccctccaaacctatccaggcagaagccatcttctggtgaataatagcagaaaatgccatctgtttcccttctattcattataaatccttaatgccaccttaggcatgagactagtgcctgtgaataagtaaactgtgtgtttgtaatactctgtttttagttctttcattaattgaggaaaaggtataagcatttcacattctgaattcatatgtttattacttagtaccgtgaccataattaaggaaaggccctgtctctacctctaaagactgtgcttttaacttgggaacttcagggaatacaatgaagagctgggttctggcagctgtacgccaagtgtgtgagtgtgcacatgtgcatatgtgccagcttttgtaagtgagtcttctaggccagtgtttgttatggcgtgtgcagcttatgagctcttgtaatatatgcatgttgttcgggtcttatttcctgttcactgcatgtaaagctgtggagtccctgtttcccttttgaagttttctctcaaacagttctaaaggtacagaagagtagagcagagaatatagagatctaaattaggcctattcagttttgtctttagaagaaaattgttactttttttttttttttttttggagacggagtttcactctgttgcccaggctggagtgcagtggtgggatctcagctctctgcagccttcacctcccgggttcaagcaattctcctgcctcagcctcctgagtagctgggattacaggtgtgcaccaccatgcccagctaatttttgtatatttattagagaccaggtttcaccatgttggccaggctgatcttgaactcctgatctctagtgatccaaccacgtcggcctcctaaagtgctgggattagaggtgtgagtcactgtgcctggccaattgttaactttttaaaaatgctcaactattcatgtgaagtaatccaatatagataatacagtggatcaagatttgctttttaattttaattgacatctagaatccagtgataaaggggaagacaaaacctttcctcgtcctgttggcctttcttgaccataccatttacacaagtcctgaacctgtcaggtgttttcagaatttgtgtttgtgattcctttttcttttttattacttgtctttgcaatttccagattagtctcctgaaattaactcttaagtgtacttttaagtctgtggtgtggccctctacaaggctttcataaaatgtaataaattagtatctacactaaacaacataattagaattgattatacatagtgcgaaagagctctatgatttaaataaggatttctgacagatctgtttctaactagcagcctccttataaacacaaacagttatttatagttatactgctaactactttacaggaggtggggagggtagagcaagaggaagaaaggacccgtttgagaaacttaagaagaagagcttctgatcgctttaaagatttaacgtttggatttataagcatttcacatcagggaaccaaagagagcagataatttcatttactgtcattgggttaatttgatctagtaagcagctttgagtatagattataaatgacaccaatttatatgtacatagattgtataaataagatatgagtgaggaacatgatgtacactggcattttctttgttagtgtcaatgtaatttaaaatgacacttaccggatggtggataggatattaagtgatggtctcacatatagtgccacttaaatgttgcaggtaagttagtaaacccttttaaatgaagtaagtatggcaatacttaaaaatacatattttggagaaagccaagttccattagtggaaaaacagtgctccattaccaaggtaagttacttagccttgttcttcaagatactagtgttgtctatgtagccagttgtcagcaagtaaattgctttccttgaaatagtttctgtggtgatttttactgacttatcaaaaagccagaatttacttctgtgtttctgcgttcacatccttttttcctcccatcagtgaaactgttacgagattcatctttctaaaataagattttaaaattatcttgcttccagccatggccctttttctcagaaatctttaaaggttcctcttttacctaaagctcttcattggttattttgagcttggtattcagtactcttcatcttctggtgacagcttactttctcttttcactgctttgccacatatatcctctctctgattgcccaagctgcttccctaaaaatgtgtcattcatttccctctacctttgcctgcacattcttcctgcctaaccaccgtacttaagggatagtcaaaattcaacttacttttacaaagcctaccttgaccctctagcaggagtttctggattcttttattatatttattatcttattttccttttttaattagttattttattgcaaatataatatctccccagtgagataaattcctaaagggatagcttaaagtatcagttttctgggtcactcattagtgcctatcatgatgtttgaaacatgtaatattgttgattgtgttgagtactatttatttttacctttaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaaggtctgtaacatttgcttttccttatgttatatataacaagatctctttaagtctttacagatatggtgactaaccatcatcaaagtagatgagacatagatgtctctcatgtagattagacccattaagtcgaatacaatatattagtaacttttagaactaggaacttcttcaagattttcttgactcttgatagcattcctaaaatctcttaatgttttataaaatataaaagagctattttaaaaagccatgtactttgttggtttagtttagggcagttagttattgagagtactcatgatatagaaaagatatataaacttgctcaaaattttgagaatagggctcagatagctgtttccttttaatctcttcctgaccagtaggatgtttcaatatggactattgaccttattaatggggagagtaaaaataacttgtcagtgttctgagttgccaagggctaaatagatgaatcttctggcaaactcaaagagataaattgtttcttcaaccaccctggtaactgtacggacacttttctgcctatcatgctggtgcctgaggcccagtgtcaggtcagatgctgaagaaggaaggaagcctgtcagcagggagtcagaatgagtggggactgcaagcagtgaccttagactgtgctgctgccactttcttagcttccgttaatacctttatgcccatgattcctactttttttttttttgagatggaatctcgctctgtagccaggctggagtacagtggtgcaatctcggctcactgcagcttctgcctcctgggttcaagtggttctcctgcctcagcttctcgagtagctgggactacaggcgtgcaccaccatgcccagctaatgtttgtatttttagtagagatggggtttcaccatgttggccaggttggcctccatctcttgacctcgtgatccacccacctcaccctcccaaagtgctgggattacaggcatgagccactgtgcccagcccccacgattcctatttttactgcctctgtcagagacttgtgtttcagctccactcttgtcatccctacccctgaatcaaatgtatttcccagctttcctatttaaaaaaaaaaaaaaatgctgtcattatctcttagcttggccagacctgtagtcatctttttccttctcccaccttccatttacttcagcaatatttatttattcaaatattaacagtgtttaacctcagttggtaattatgggtgatttttattatttttcttttagcttctctgggttttcaaatttatttacaagcatgtactgcttttttttgttattgacttttatttgtagaaaatttccaatatgtagaaaagcagagtagttacagtgatccctcatcgtccagcttcaacagttgtcaggtcactgccaatcataattgatgtctgatcccacctactctgccctaactgtgttatttgaagctggtcccagacaatatgttttcatctgtaaacacttataaaatgtaatttgtatcttcaaatgatgaggaaatgtttttatgaaacaaccacactaccattgtcagttttttaaatgttatcaaatatccagttaggttcaattctataattgtctcctattaaaaaaattatttattcaaattatgattctaagtccacaagttatatttagttgatatttctcttatgtgtcttaaaatttaggtccccccttcatcttttttctcctctcgcagcttatttgttgaagaaattggattgtttatcctgaagggcctatcacattctggattttgctgattgcatttccatagtgtctcttaacttgttcttctatcttttctgaaaactggtagttagatttagaagctaaacctaattggagttttattggttttctcaaaatacatactaaggatattatatacatcctattgcatcatatgtggaggtgtatagtgtttgattaagacggggcagtgaggtatatgatgaatgtaggtagcgattatcagtggcacctgacaatgtaatacctcttaagttaaaaacaaaacaggccgggcacagtggctcacgcctgtaatcccagcactttgggaagccaaggtgggtggatcacgaggtcaagagttcaagaccagcctggctggccaagatgatgaaaccccatctctactaaaaatacaaaaaaattagccaggcatgatggcaggtgcctataatcccagctacttgggaagctaaggcagagaattgcttgaacctgggaggtggaggttgcagtcagagctgagatcgcaccactgcactccagcctgggcgacacagggagactctgtctcaaaaaaaaaacaacaacaaaacaaaacaaaacaaaaaatagtaatcagtctgaccaaatccttagttctcattttcgtttctgcctttatcaccatttatttcctcccccaactcttaaaacaaccttttctttatttactgtgtttgatgaccctagactttccttgttccttcttacttcttcatagttgtctttgttttctcaactcttactcttctcactggttcatatgaaggtactgattttataagtggtaatttcttccttaagaacatagccacattcatggtttcaaactctaccatgttggcaactctcaaatctccatttgaaagcttaaacctcacccagggtctggattttgtcacattccaagttacaaacacagcagcacaaaatgttggtgagtctgtgccctgaacttctaaccaggctgatgctgtcatctggtggtcaccatgggaactagctgaccctactggctcttccctactccccttctttcttctttgtcaggggttaatgtactttctctgagcctagcccctccacctcagttcctttatcttctcctgatttagttaattccacccccggcagccctttatatttatggccccttacatataaccttccttctatcttgtccataacctgtggtttccctttcttccatctgcctgtcttccactttgtttcttgtatttgtgagcttttcaaaattcagtaatggttaagaggcatgcaaataagctagtgatgtgcctatatcaaggaaaagcaagggtgcgagtttggtcagaatcagtttataaagttcatgaagaacaaattaatactaagtccttttaaatgtacccagaaatctcctccagaatcttctgaaaagtttctattcctttcttaatctcttctaatcagagttggttttcttcttcaaccaaataccttcaaaatagaagctgtttcatgtcaatatggattttttcttttggtttacaaccagcagggaaagaaagagcacagtttatgtacttcttacctaaagaatctagcattccgttttttaaatcttaacagtcttacaaagtaagactttattcttgtataaaaggagaaacaggctccttgtcagtaacaggcaggccgtggattccaaccaggttagaatgactctaagcgtccatcttttactggattgtgctgtctcctaatgttgtaatgctttttttcttcatggcttaattaagcatgtggttttccagctacttctaggttaaattagattgtcgtggaccagtctagcttaggagcctagctagtgtctttaccattattcctatgagaaaacatgttttaaactcgtgttttggcttacagaggaaattttggaacccacgttcctcgttgtttgagtttagtcccagcttttccagttttgctcctgacatttcagttcctatttcagcttccccatgtgttagaggtatcactatttctgtttttctaagctagcaaccttggaatcataatcatcttgtcttgcgtctttgtgaactgtgtacacaatctgtcactaaagcttgtcatttcttgttgaaactcactttcagttttgtcccatactcttccattcccactgtggccacactggtctccggagacttctcacctccttgcttccctctctgttccttccttttttttaaccttctctccttccaggaacagccactgagcacccaacccgacccagagatttttctaggcacttaagagtgccagctctgataccaattatctgtgaagactcaaaaaagtcaccatctttgtctcttaaatgggattaattatacttgccttatctcaagaagaggggcttactctgaggaactaaaggatgtgtacataaaagtataaaacaaacaatgtagaagaaaatgtgaaggaaatacagacttaaggtggcattatattgcagtgtgtgactcaggattgagagtaaaaagtaataaccattgaacaaataaatcataaatggtctgcagcccaaccgaaatgttaattctgttttacagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggtaattctataagcagttctattatttaagctttaaattttcatgaataatgtctatgaaaatagaaggtggaggctgggcctggtggctcatgcctataatcccagcactttgggaggctgaggtgggcagatcgcccgatctcaggagttcatggccagcctgggcaacatgacaaaaccgcatctctaccaacatacaaaaaattagtcgggcatggtggcatgcacctgtagtcccagctactcagggggctgaggtaggaggattacctgagcctgggaggtcgaagctgcagtgagcagacatcatgccactgcactcccagctgagtaatagagagagaccctgtctcagaaaaaaaaacaaaaacaaaaacagtaggtggcctaactggagatatttaaaacaaattttttagatgagaacattttatctttcagttcaaaatttcaggtagagctaggaatctggaaatttgtttagagattctctagtcgttgtaacaaaactgtgattttttttgagttcttaaaagtagcattcaatcttatgatttttgaggatctcagtttcagaattcaggtccaactgaatatatttttatgtgtagtatcaaatgaaatgtgaaagtgctttgtaaacatcaacatgctaggtaactgttatctggccatctaataattatatttgaccttgagataaggagactgcatgagatagttttacagttgaaaaattaaatactaagttttagttatgacatttgtatgctgtagtttttgtgcatgtgggatttcagatgccagtatatctctctgctctagcagttgtccacttgcaacccaatggctcccccactccccactttacatacagcataagtgctagttcacatcttagctccatctttgtagttattattattattgattgtaacagttttattgagttataattcacatcataaagttcacccacttaaagtgtaaaattcagtggtttttagaatactcagagttgtacagccagcaaacactacagtcaattttagaatatcttcactccaaagagaaaccctgtagccactagcagtcactcccctttcctcccaaactccttagccctaggcaacaactgctcctttttgtctgtagatttgcttattctgcacattttatataaatgaatcatacaatatgtggtcttttgtgactggcttctttcacttagcatgttttcaaggttcatttatgttgtagcacgtatgagtacttcagtcattttgatggctaagtaatacttcagtgtatggatatggcatatgtcatatatccgttcgttgatggacatttggtttgtttcttttggccattgtagctaatgctgcagtgaacatttgtgtacaagttgtatgtagtttcatgttttcagttatcttgggtatatacctaggagttgaattactgtatcatatgataactctatttaatggtttgaagaactgccatactattttcttaaagtgcctgaaccattttacattcctgccagcagtgtatgaaggttccaggttttccacattataattattattttttaataacattttctagtggttagcatcaaagataatatacttaatactgagtacattgcagttgatagggaagtgatgttctacatgcttggttcctgggctgctggaatatcagtctatggctaagtttcttaaaaagaattcataaggcaccaacagataaactgataactttttttttgccccagtctttgagttgttcatcttttaaagcatgttattgtccacattttctttaaagaaatataaattcagtgacttttggtgtagtgattcacttgagtttaataatgccgtaagtattgtaggtcatgtgggctgaaatgctttgataatttgggttgggagaagagacttttgaacctaaagatgtgagttgtgattggtattaccttttaagcagtcatgtttaatttttgattctttaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtatacttttgaacaactatatttaatatcttctgaaatcaccttttttcccttctctttcatatatacatatcattgctgaaactcagcttaaacttgcactttattagattgccaacaggtaagaagatctcatggtcttgcctgctctgaagccagagttacctgacttaaaaagatgcctgctgatgaaaggttgcccttccagaaaatatcattaggcatgttaattataataacagtagtaactaacgtttatagggcacctactatgtgccaatcgtctaataggtcttttacgtatattacctcatttaatcccttctcaaatactgtgcagtagctagccctgctattttcatatttcagttcctaaaaatatgcctttcttgctttcttagaacttttgcacatgctgtctcctggagcatactttaccctactgtttctcagcctcatacccacctttcccgtaggaagttttttctagtcctcaaaaatcttaggagtccctgccagggactgtcatagcacactgaactgggaccgttgaggcacttatgcgttatgttgtaactgtttatttatttgcctatatattctattaggtgcaagctgcttgagagcagccttgtattcccagcatccatcacagtgcctaatacatggtagatcctcagtagatatttgttgagtccatgagtcttcaaaagaacttaattaggtaggtgttattaccctttaattcacagatgaggaaaccaccttgaggaggttaaataatatggccagcttcatgtggatgataagccgaagagctgagatttgaacctgggcatttctgacccaaaccccttatcacaagctgtcacagcattttttcaaactactgtcttggccttggagacagctggagagccagcagcattagtctattcaaattgcatgtataattttgagatttctggattccctggggactctcaattttcccatccaagtactaagcaggcccgaccctgcttagcttccaagatcagacgagatcgggcgtgtttagggtggtatggccgtagatgactctcaattctcaaccagctaaggggtccttgtcagtggttgctgtaggtctctgtgggtcctgacccataattttggtaggtttttgaagcttcagtatgaggactggcattcttttgtatctattatttttttccctggagtatattcgtgcccttcctttcatcctcagtgagaagacttctaaattaaaatgcatggtttctacctagtacgtgtataggtggtgtacattaggacacctttaacagtcacaattgttatgtatgtctttcattggaaaccaagatcatgaggcagatagtgtgaaactgctattttagcattttgtgggatttagttgacatcattaatgtgcaaaccagtgtggatatttaatatttttcttgagtctaatatttgttatgtaatattgtgtacatatgtctatgtataaagaaatgtctgaaaggaggttcatccaaatatggcagtaaggggatgattttcaaagttctttttgcaaattttttttaggtacatggcccctgaagttctcgatgattccataaatatgaaacattttgaatccttcaaacgtgctgacatctatgcaatgggcttagtattctgggaaattgctcgacgatgttccattggtggtaaattgctctcctctcccccagtagtttgtcatgagcagaagttgttcaagaattgtcttctttttttaattgaatgaaattatgtacagtccattatctgaaacaggatgtcaccgagtgccagagaaaacaaaggcgatgaaacctttgggaggggacagtgccatggtgtgcacatgcacagctctagcctagtgtattctcttcctgtttccatttgaatctggagactcatcagaacccaaccccttgttatattggaatatagttctttagaatggacagctgcttgagaggctcacctaggaagctgtttctagcatgtacctgggtgtcaaacttattttttttctttgagattgtggttattttctccaacttgatagttacagttacatacacagaatacaattatgttaccattgtgttgtattctagagttagtttgttttaacttctagctttttagatggagtacttttaatgtttactcaggaaacagtctcttaggcttggggacctagacttggctgagacctagtgccttaggtttttgaagcagtgagggacagagtatttctctgtattgtagtaaataggatatattattgacagatgcaagtagagaaagggacttggcaccttaaacttgcctcataagattcaagtctcactgatagggtatatatatccctgtgcaagtgagagcctgtgcacttacagaatagaatctcatttgctgcacaatagggttctaggggaaaatgtcaatctggtcatcacagctcatagtttactgtcatttcaaataggctttattgatctcatggcaatacttagtttcaaggtgtgggtggaatatcaactcagggaagtggcttgtggatacagatgtggatgagatagagaaagctgtaatctctgttccacatacctactttagtaatgaaacactgtaataggtctctcaggtgatcttttaatgccttggcattagctgaataaattcatcaaaatttaattttttttaaactgatacaggaattcatgaagattaccaactgccttattatgatcttgtaccttctgacccatcagttgaagaaatgagaaaagttgtttgtgaacagaagttaaggccaaatatcccaaacagatggcagagctgtgaagtgagtatttctttttgatattaggcaattttctaaactgcttctgcttagtaagcaaaagtttgctacttttctttaaggaaaacttttctttaagaattttctttttcatagcagtcaaaccaatgtttaaaaacagaataatttggttttcatattcaattgtaagcacattgaaagggccatggaacatttgcagtggcctttagtgtatcagaacatagtttagatctgccgggcgaactaaggcacatatttttaaatgaatgcctcccttcagccggggcaacccagaacactagacagttaccggacatgaatgaggagccctgtattctagaccagcctggctaccatttcaagggtctgactctgaacaaatccctttagttctctggactttaatatccctttgcaaggtgaggaactcagataaggtgattacaaaggtgtttcaaatgattttccgttttattcatctgattgcccagataaccgttaaccaggaatttagggaaaatgcttttttccagcagtatctgagctgctcaacttcagctctaacaaaaagttttagaaacgtttttgtaattgtaaatttaaagattcgtaagatgaattttatttaacctctccttaattgctagctgttactattacaatattggtgaagcagagcatattcctccaggtttgaagatttgtagcttaaaaaggctataaaaagctgttcagttcagtagttgattttacgtcttaaactattgtaggactcagcagaacctctgataagcaagagagcttgctacctccaacaaaatcacatctccaggcccaaataaataaaatgtatttcagcatgcttaaggaatttgcatgtgacatagtttaataaatgagagtgctgctagattttgtcttttagaaatttgatctacttgggaggctgaagtgggaggattgctggagcctgggaggtcaaggctgcagtgagctgagggcatgccattgcattccactttgggcggcagagtgagaccctgtctcaaaaaaaaaaaaaagaaagaaaaatttgatgtgaatacttcaaagtacaaacttaaaatttcagtgtgaggtcagatttcttctttgctttgcccagctctggtttaggattcggccttttcaggtttgctaaatgagtcactctttgtccacctgctttccagcactggcaccagtaccctattgatggaaatttatgtaatttctactcatttgctattacaaataatgcttaaacaataacaagtgtatatgtcatttaaaaagaaaatttacacgtaaaaattcttatccagaccaatggaaaatggtgcatgcattaatttttttttttatattttcttgtaggccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcaattgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaaacatcttctggtaaattgtgcgtccatattcattttgtcagtagccaggagaaatggggatgggggaaatacgacttagtgaggcatagacatccctggtccatcctttctgtctccagctgtttcttggaacctgctctcctgcttgctggtccctgacgcagagaccgttgcctcccccacagccgtttgactgaaggctgctctggagacctagagtaaaacggctgatggaagttgtgggacccacttccatttccttcagtcattagaggtggaagggaggggtctccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttcccaagtgccagtggcatattttaaaataaagtgtatacgttggaatgagtcatgccatatgtagttgctgtagatggcaactagaacctttgagttacaagagtctttagaagttttctaaccctgcctagtgcaagttacaatattatagcgtgttcggggagtgccctcctgtctgcaggtgtgtctctgtgcctgggggcttttctccacatgcttaggggtgtgggtcttccattggggcatgatggacctgtctacaggtgatctctgttgcctttgggtcagcacatttgttagtctcctgggggtgaaaacttggcttacaagagaactggaaaaatgatgagatgtggtccccaaacccttgattgactctggggaggggctttgtgaataggattgctctcacattaaagatagttacttcaatttgaaggctggatttagggatttttttttttccttataacaaagacatcaccaggatatgaagcttttgttgaaagttggaaaaaaagtgaaattaaagacattcccagacaaa

SEQ ID NO: 97 - DNA, 97505 bp, Homo sapiens
ccctctcctcccctcccctcccctctcttcccctaccctcccgcgcgcccgggccgccggccgggcccgggcctgggggcggggcgggaagacggcggccgggagtgttttcagttccgcctccaatcgcccattcccctcttcccctcccagccccctccatcccatcggaagaggaaggaacaaaaggtcccggaccccccggatctgacggggcgggacctggcgccaccttgcaggtaaagcctgggcgcccgcgggcctccagctagggaagtgtttgcgtgcgtccgcggccggggcgatgggccgtgtcacatggccgctgcgggtgggggctggggtgtggtgagttcgggggctgtgggtgcgccggcccgggcgtgcgggttcggggccggagagccgggaagggacggggctcggttgcactgcgctgccgcccaggctgacgggggcgggggctgcctgcgtcccttcccctcgctgctctcacactccatagtttgtggttctgatttttaaagccgaagggccagagctcttgtttcaggagttgtggggaagccttgttagggacgcgtaatactttgcctccactttttttttttggtctcgtaacctttgttaacagtggtagtctcgggttttccatggcttgtgtgtactcacaaacacgcacacagctgataactctgtgatcatccttcactcacttgtgaaagttgttctgcgggtggagcctattagtttttatcacacgcctttggaaagccctcgaagtgatttctcgtatttcaaacttggtttttaaaattgcaacttactttgttctcttggagggggatattgtctttgggtcaggtacttttgtcttttacttatccttaaaatgtccttttgatcctaaacagaaaaagaatgcctgggttggttttgttattcctttctcttgaccctttaaaagcaaaataccaccagtgtgttgtcaaccatacctttaaaaaagaaatttccaggtaaaacgaatttgcaagcagcattttccatcaaagtcatgtcttgtttgttgcaatttggactatcttaaatttgggtttgtgaaacttttaaaacgacatgtgtaaaataattgttaataaataaataacttggaataattacatctttttagaaatggtctttgaaatgtgatttaatttccaaaattctttttctctcttctgacttcatatgaattgaacctgatagtttcgtatgaatgaatcgctgataggatgttttccttgagcctagtaataaatttgctcttattatgctgaaaatttgctattctactttaacaccctttaaaaagtttccatcttacagagaagttagtcaaatagttaaatggagtttcaacagttttaatacatgaattagtgaagcagatgaagcagagatgggagaagtaatttaaaatgggcttcataaatgtaccatagtttgagggtatttaaaaaatttgccttcggaaaacccatacaagatatttaaagaatttcctctgccagaaggtcatttagcaaacgtttatattaaattcaaaagtaatacttttatttttaaagttccttagccgttgccgtaaacttagctgtcgtagtaaatataaatagttcacatctttcggcatttctaaagagtgtgcccacttttactataaatattaaactctgctggatttaattgagttcaaggctgttcactggccaggtttaattaatgtaatgtgattggaaacgttcattttggggttttagtaagaaattgctcttagagcttggtttttatacttagccacaccttctaaagtgcggccacaagcattgtaggtgttcaacaaaagtttgggttttcaaggttgtaacctacgtttacttagtcataagtggtcatgtctctacacagtctgtaagtttcatgaaataatagtcttttaagaaactgtgcagggtaatttcctgttgtttgtgtcttatcaggcttggtatgtgttttaactcttgtgtaggaatattggggatggttttggtatttcaacagaactttagtaggaacaaaggttgtttctattctacttcaagatggccagaggttgttgtccccttttcattttcacattgtaaatattagaatcatgttgctataatctttacttcacatttgggggaatatatgtcaatggaaaaactcggtttagctgtgtaaaccgctggccaaagacctattgaatttttacattttgcaaatactgtcagttttaaaagtctttccttgttcttgtttggttttgattctgttggttttgtgctttagggctccaaaaacctcgttttgtagcagcttttttatacaggtgtttttgtaatgcatataaaagctgtatttagtgcagtctggcagatggagatttattcatattcttaggacaaagagtcatttttagagggtagaggggggcatgtcttttagattcttagtcttttgatgggtgtagaagagccatttttaggcccttagtttctgtgagaggtaagatgttttcccctaagtattccaaaggtatgtcagaaaatgtgaaacgtaaggaattcacaaccagttaagagaggttatgagagattatgcatttatatattttattttattttattttgagacggagttcactcttgttgcccaggctggagtgcaatggcacgatctcggctcaccgcaacctccgcctcctgggttcaagcgcttctcctgcctcagcctcctgagtagctgggattacaggcatgcgccaccatgcctggctgattttgtatttttagtagagacggggtttcaccatgttggtcaggctggtctcgaactcccgacctcaggtgatccgcccacctcggcctcccaaagtgctgggattacaggcgtgagtcaccgcgcctggccgatgcatttattttcaacaaatacatttattcatttattcaacaaacagctttttctgtgtgtcaggctctggactaggcaataaagtctcttaacagcaaacaagtacacccctgttccttaatggagttagaaaagtggaaactcatgtcccttgccctattctccagtgtttagagtaagacagttgttagtgtacaaatcaagggcacatgcattactgagccattcctaaagtgagcttgccttgcttcctgtaacatgtagcagatagcactagggaagatgtgaagtgttactcagtgtcactgggaacaatctgtgtattttggggggaccttggcaccagttttgcacagtctatacaaactgaagatacggccagtctttcagaaacatgtttattgctgaacagatgtacacttgtagagctaagcttcatctgaccttaatttgatcacttattgccctttaattacagaagctggttaaggaaagaaagcagagttgaataactcagtgaaaggatcgggaatagtgtaaaaagttagttaaaccgagacccaggattggacagcagtctcatgtagtggaaaggccttgggttttggaatcagagagccctagcctaatattttgtttctcagttacaatactgggcaatttactaccaaccccaggcccttggttttctgacacaaaatggaagtactaaccccttcctcttattcagtgatcacaattcaagtacctagaacattgcctgagatataagggtcctcccaaatgatttcttcctctcttgtagttgtgggtttgttacttgggctctttctaatccaaatgatttgcctacactgttattatggacctattgtaaaatgtatttgagaagcagacaatgaacaacaaaggcctgggatagccaaattgtcccagtccatagcttaaagcttaggagagccttggagacccttaataagaatgtgttggcatttatttaaagtgtttctaacaagcaaagttatctggcttctaaacctgcactagattagaaacaagtagattatgggtactgtgggaggcttagagggggtgtggtgggggctggggagtaggatgttagcctagtgtctcttgtcagaaaaaacagataacagctcggtgaggataatagagataatctacaagacacaaaaatagtcaaagcctgactagcatgtctggggccattgagtgcaggaccagacctgaaagcatagtaatgaatgttcatcaattagcctaaatcatgtttgggaaaatctttttaagagtgcaataatctacgtaatatactttagattgtcactcaggatgattaagaaatgttcttaaaggggttgaagattgtgctatagcttatggcttatttcatgaaagatcacagtagctgttatgaccaagatgtttttcatttgttttgccattcagacagccattcagattccaagctgaaagggtagccagcagtaaagaaaggctgtttcagtgtggtagcaccctatgtcacccctttctttggtgtaagtaatttttttgtcagtctgcaggagtatcatataaattttcacttgtgctttgacagtagtgtatgcttttcactgtgttttgagatagagtatgctcgagatttctaggataaagcaagagtggatagttggccagtctctctgttgagggtttcttgactcttgtcatgtgacttctgcccagtattagcactgataatttttttgatcccctttcttgtaaccttacctcagggttacttcttaaaccatctacaccatcagataattattggtgaccttgtaatatgtagccttggctgtttttaagaatcaggtttttttttagcagtagtacaaaagtactagcctttttggtttaaaaatgcatagttagaggcttattgcttgtcattgatcaattttgatcattttttcaggttggtgtaattgtgatgtattcagttaggacataattcaatgttgattctagatttacatctcaaagatagctcgcagcttcagttcagcaatttcatgtagggagaatataatttttccaagccaggtggatttagacactgcctttagtttggtcagatagccagaaatattagggcaattctgtgtcttctgtgcttgcctcacattgtacagtgtgagtggttctccttggctcagtgggttcctcttatttgtaactgaggcacattgataggacaggtgcttgatgtatctttaggtttgtagtcttaagaaaatagaaattctgacgtgattaattcttatcaaagtttgtgaatttactgtgaaattgtcactaattatcctaggtagccctgtcatttttcaaaatctggttttacattggcctcaaggctgtagagtagtggaaagcgaggatagactttagttgcttctgtttagtacacgtgtctaccttaatgtaaaaatttgcatttccttgaataatctacagtgtcataccttccctcattttgtggggaagggggatgtagtttcacatttaatgtattcagtaggaataatcttgggtgaaccactggtattccatctgttcattagtttgagtctcttaagtcaaaaaagactcttgatctgaggaagtagcatagtgaatctgtgatcttatagtttgcctatgtttaaaagtaaactacattttcatatgctgcttcagctacttccagaaattctgtagagacataatggttaaggtcttgtaaatatcaaggaaacgttccatcctcatcacgtctttcatttcagaatgtgaggtggtgaggccggaggcagtggctcacgcctgtaatcccagcactttgggaggctgaggcgggcggatcactttgaggtcaggagtttgagaccagcctggccaacatggtgaaaccttgtctctactaaaaatgcaaaaattagctgggtgtggtggcgggtacctgtagtcccagctgctcaagaggctgaggtaggagacttgcttgaaccggggaggccgaggttgcagttagccgagatcccgcgactgctctccagcctgggagacagagcaagactccgtctcaaaaaaaaaaaagaaaaaaaagaaaatgtggggtggcaaatcttttttgcagagcctcctatataaaatcctcataaatgatgcagtggaagctgggcccgtgagccttctgccttgacttgagtgaactattgaaactcttttgttgactagagatactttatctgtggtagtaaatgtaaattttccttattgagatccacttttaaaattctttttttttttttttttgagacggagttttgctcctgttgcccaggctggagtgcagtggtgcgatcttggctcactgcaacctccgcctcctaggttcaagcagttctcctgcctcagcctcctgagtagctaggattacaggcatgcgccaccatgtccggctaattttgtatttttaatagaaacggggtttcaccatgttggtcaggctggtctcgaactcctgacctcaggtgattcgcccaccttggcctcccaaagtgttgggattacatgcgtgagccactgcgcccggcctaaaattcttaatagacaggtagttaggttgtagttcatgttagctgatcaattaaacttttttttaaaaaatgttttagttatcaggagggtccagctttggcctgaggttgtgcattggccatttctgctcgaaaccagtagtagtcagacttaaaacatgtgcacacctgcacacacagcagcaactagaaagcctttagagagaaatatgcagaatttcgaaatgtaaaacagataaaaggagtaaagctgttttgtggaaggaagaataggcagttgttgaagtcctgcctgatcagttttcctctcatcctcaccaccaggaagcctttgaagcacagctgaagaacagtaggtcttggagaaatttttgctgtagacctgctctatcttaacaggtagctgccagccacatgtggctatttagcacttgaaatgtggctgctgtgactgagaaactgaatgttaaattttacttaatctaaatttagatagccatatgcagctgatggctactgtattagacagcacagatacccaaggacatttacatcattgtataaagttgtgttgggtggcactactctagactttgctttaattgagcttttatggcctgaggaccccactcacgtgaattgacgtggtattagttgctgcttcagaagagggtcaggatagactttgggaatttgaagagcaattagagtacttgtactttatatttgtgctgatttgagtctgggcctgtgtagtgttgtcataggtgctttttttttttttttaataatctgggaatgataaaccaatatgtaagttacgtgtttacaagttgattatagagttgtggattccacaaaactcattataggtgataggaatataactcttagttaaaaaaaaaaaaataagtagtctctttacacagcagtccctatttaatgtggacttttgctaaaataataattttcttgaattaaattcaagcttgcattaggtttgacagtccataaagttgaacacatgaatgttttctgtttgcttttgtttaaaagacatgacccatcattctccatgggggccgacctaggtttccagttggcagtgtctttccttactagcttacgctttggagagaacatagttgtagtgagaattgaaaaatctgtttttaaaaaattgggttttatgtattttaatttttttgaggttttctattatcctggttactaatgaattatttatttgactaaaacagttatacaattccaggtcattgatgctgctgtttttttctctgccttgtagtatgtttgaacatagattgctaaaaatctcggtctccacagaggattggttccgggactctcctgcaagcaccagaatatgagaacgctgaagtcccttgtataaaatggtgtagaatttgttttatgcacattttattgttattctttaaatcctctctagattacttaatatctaatacaatgtaaatagttgttattctatattgttttagaaatgatgagaaaaaagtctgtacatgttcagtacagtcacagttttttcctgaatattttttatccatggttggtttaatccatgtatttggaacccacagataaggaggattgactgcacagtgattttatattatttctagtgggaccttagatgttctagatgaggcagcaccatcatatttaaagtatttttgttgaaataattaactttggttttctttctaaataaaaattcacataggtatttggggaatattttgtattttcctgcagtttgaagatttgaaatttctcttccctccataccttttaaaagtgcaatctacttttgctttctacatttaatcactatctgttcttgacttcaactttgcaaacatattttttaaccattctttttcacatttcccttcctactggccttccggatgaactgtcaagtttagcagtcttttctcagtgatcatactttcttcagtgtttgctgttattgtttatactgtctttatctaaatttcttaaaatgacacagacacaagttaggcccattcttcttactgtaaacagatgaaaatgttggataaaatataaaagttttctcttatgtatacagttgatcttgagagagaaagtgcccaggtactagaaacttagaaaaatcagtcaactttaagggaagtgtggccttgggggatttactagagataagattcagtagttggggctgaggttataatgccattcaatgaaaggagacagaactgtgggaactgtgtgcttaaaaaaattaaaaaatgaaaagtgttctggtatcattgaaacatctggggcttcttggagaaagaagcctcagacctctctatggaggaactggaaaaacagtaggctttagatggactttaatatcacagcaaggcaaggcagggtacatgaaaacatctacagctgcatgtggaatagtgaatttttgtatacataatccatgactgcaatccaaaattcagggatacccagtgaagagtctctttactggtctgttctttgccatacagttgccttttcaaaggcaagtagctttactaggtttttgtgtggtgttccagagattttatgcatctatgaacaattttgtgtgtatattaccttttagtacaagtggtcacatatgtcacttaatagtacatcttattttgtgtcagtatgtaatgaatgcctttcttcttttttggagtagtgggttgtataatattcttttgtatgggtgtctgtaaatttttttttgagacagtgtctcactctgtcacccaggctggagtgcagtggtgtgatcacagctcactgcaaccttgactgccaggggtcaagttaatctcccacctcagctacctgagtagttgggactgcaggcgcatgcctaccatatccagctaatttttaaaattttttgtagaggtggggtttcgccatgttgcctagatttgtcttgaactcctgggctcaagcgatttgcctgccacggcccctcaaagttttgggattacaggcgtaagccactgtgcctggccgggtgtctgaatatatcatcagtcctctgttgaatgtttccagtcttgtggtattaaaaacaatgctacaacaaataacttcgtttatatagcattttgctcctttgcaggtatgtctgtaagatagatttctaggagtagttcaaagaatatctacatttgtaatttattttagagaatgtactttattcattttttcgaataacacatgcacatggtataaaagtcaaggagaacaaaatagcaaatactgaaaaaagtaagcctcctttacatctcctacctcctgctgcccagttgtgctttccagaaatgtaaccactgttactagcttttcgtttatccttctagagttgctctgtccagtatgatagccactagccaccatgtggctattgagctcttgaaattgagatggaccacaagcataaaatacacaccaattttctaacagtacaaaaacagaatgttaaatatttcaatggtttttaatacggattgcgaattgaaatagtattttggatatattgggttagattaataaaattattaaattatgatttcatcttgtaattcccgctgtgatggcatcaggaaatgggatctttgggagatattgaggtcaggagggtagagccctcatgaatgggattagtgcctttataaaagagaccgttgttagcattctgtcctccatgtgtagatacctgaaaaaagcggcagtctgcaacccagaagagggccttacttggaacctaaccatgctggtaccctgatctcggacttgcagcctccggaactgtgagaaataaatttctgttgtttataagccacctagtctgtagtactttgttataccgtcctgaactgactaaagcacaccaatttttacttttttaatgtggctgatagaaaatttaacaatatgtggtttgcatcctgtttctgttggatagcactggtctaaagaaatccatacatatataaacatgtactaacataagaattccacttaggcaaaatttttttcttttgcgttgtaatctttggaatcagaaatctgctgagatattggtaaagagtggtacaaagctgttctttatggccccatcagtcacccccatccatttatcatttggctctaatcagtgaaggttatgcttccattgacttctacagtgttcactttggagagaaggctgccgttgttttggcttcgtcttttttagcttgctccgatttgcactggttgcctctacacctagtacgccgcagtcattctgagatttccccctcactagcatattagggattgccttcattttttcttctttgttagatctcctattctttgtgtgtgtgtgtgtgtgtgtgtgtgtgtgtgtgtgtgtgtgtgtgtgtgtatttttttttttgagacaaggtcacactctgttgtctagttggagtgtagtagggtgatcatggctcactgcagccttgcactcctgggttcgagtgtagatcgtattcctttttgttttactagtatctccttttgatgagacatattcttcaggaccttcctggagagtgtgttgggggtggggcggtaaatacttggagatgttgcatgtctgaaaatgcctttgttctggctaacataagtctaggttggaaatttttttttgaaaaattatgaagcccagaattacgaagccattgctctcttgactttgtttacagtatactgttgacaaaaccaaagccattttgattgttttctatataacctattttttttcctccttggaaactttaagccctttctttgtctttggcattctggttttgctaccatgggccttcatgtaggtttgttttcatctgttttactggggtcttgatgggccctttccatctagaaactcccatctttcagttcaggggctttttcttaatttatctatttgactcccctactctgcatctctgtttggaactgttgttgggacattggacctctggaaccagtcttccaatttttttcattttctctactgtttcccatctttcttttctactttctggaagatttcttctactttatcttctagcacttctattgatttttttcccccgtttctgctgtcaagctatgcaagagctgttaagttctctgaatgctgcctttgagagcatgctgctctttcttcagggttgctcagtcttatttctctggccatgttgatgttttaaaaatgttttctttctctgtatagtcttttcctgaagctgaatttttctggttttgtttgacgtttttcctcagataaagtaattcttaagaagtggggatctaaaaagctgatcaaaaactcaacatgtgggtgaaacttgtctcctttcagtttcactggagagggatctgagcaggcaggctgtttgttggtaaactcccaatattagcatctatatgcctttcctcctgggtcggtcaggtaccctagtgaagtcttttgatctgaataactgggcggaggtctggctgctagtatttgggagccaaaacccagtggaggaaggggtttgggagtcgacatttaacacagcgtgctcatgttcattcacaccctcttttcttcctacttatacccaggccatctcctagtccagggattttgttttcccctttgcagaaagtaaacgttgaggcagaggattagttatccagagacagtaggggcggaaatctaagaactgaattcctttctacaaagctcttaacaagtgctacctattattccttcccctgcctggccctcagttcctgccgtgacttgctgttggttccttaactttttgaggtttctgtgttaatcaatggttttcagcttttcctacagctagcctagagttagtagtttctgatctgttcaattactgctcacccattttccagccattaaaattttgcttctgttttctccttacctcttctccctatcctcatgaggtttctggtttttaaaaattcccttggttaggcgtggtggctcatgcctgtaatcctagcactttgggaggctgaggcaggaggattggttgagtccaggagttcaagcctagacaacatagggagaacccatatcttaaaaaaaaaattctttatggttttcaataggctgttttcatctacaatgcaatgatgagttaaagttttccattaaaaatttttttaccaataactctccaaaagaattgaaatagaataacgtataactccaagtcagtggggatgaggggtggaaataaagagaaattgatcactccagtataaggcagggaagaagaaaaaagaaaagaaaaatgcataggtattagaaaacacaaaataagatggtagaaaataagctgaaatatctccataaacccaatatgtaatctcagattaaacttgctggctaaaggagaacaaaaatttaaaaaatccaaccaactgtattttacaagtggagatactcctaaaagtatgatgacatagtttaaaagcaaaggaatggaaaagatatactaggtgtaatttataaggtaaaattggaagaattacaggtataaatcaaatctataatcgtagtagaaaattttaatatacctctcagtaatttatgaaagggtagatttaaaaaactacaaggttatgaaggattggaagagtacaattagcaagcacccaacaattacagaagatacattctgtaaggggaatcgcttgaacccaggaggcagaggttgcagtgagccgagatcataccactgcactccaggctgggcgacagagcgagactccgtctcaacaacgacaacaaaaatagtgtcagcgagactctgtctcaacaacgacaacaacaaaaatagtgtctttgatttagtgcatgtaactaagttgaaaagagtgccaagactgatagaggagaaaaagaatgtacaaatgtattggaaatgaagggatggtataactgcagacaaactgagattttaaaactgcaagaatactgtgaacagttttatttctttaaatttggaaacaggtaaagtggacaatttctagcaaaacaaattaccaagttggcttaataagaattagaaacttcactagattatgatttaaaaacttagtcatgtttagaaatatacctataccaggcggggcatggtggctaccactttgggaggccaaggtgggcgatcacttgaagtcagcagtttgagaccagcctggccaacatggtgaagccctatctctatcaaaaatacaaaaattagccaagcatggttgcagtcgcctgtaatcccagctaatcaggtggctgaggcagagcccaggagacagaggttgcagtgagacaagatcgtgccactgcactccagcctgggcgacagagtgagactctgtctcaaaacaaaacaaaacaaaacaaaataaataaataaatatacctgtaccaatgtaaaattttaagtcctcaagcaaaacaccagactacaaatgaagaccccgtatgggcaagtgcaaccaaacgtgagggattaactctaatcttatacaaaatgttacagaaaaattattttgcaaggctactataatcttgataccccaaccagatagtgtgagaaggggatataggctgcattctcaccaaagaacatggcaataaaaattgtagtttgtaaaatgttagtatttactcaaaacaaaaataccatgactaattagggtttgtctcaggaatgtagggatgattaagcattagaaaactcgtaaatgaaattcatcatgttaacacattaaaggagaaaggccatatgataattttgatggacaacgggaaagcatatgataacatttagtacttgttcatgacaaaaattcttaggaaatgaatacaagagaactttcaaaagggtgttaaaaaacacagaagagtacatacggtataattccatctatatgaatttctggaacaggtaaaattaatagtaatagaagtcagtagttgcctgacgggggaaggtggattgactgaaaaggaacgtaagggagacatctgaggtgctggaaatgttgtttttttggggattgtggttacattagtgtaaacatttgttagaattattgatttcatgcccactcacggttcgcgaccctcagtttagagaaattgtagagtgcagcatatggtgaaatgtcttttttagcaaagtgtgtgtgtatatactaggttgcatgtaaaatgtacttttcactgtgggactttttttggttaaaaagtttgaaagtttgaaattttctgccctagaagagcttttacatggtataaaatgatatataccagcctattcatagcaggttgtgagagaggaaaattggaaacctaactagtcatccagagtgaatggacagtgaactgtgctagtcataaaatggaatgccatgtgacagctaaaatgaatgaactaggatttaggattatgtatgtatcagcatggactgaacagtatcacactttcatataaatttataaaatgtacagaactgtattgtatggatacaatatgtagcaaaactgttaaatgaccatgggggaacatcaggatagtgataatctctgagaagcaagagggagggaaatgttatcaaagaggaatacatagggggctttagctgtattcgtatcttatttcttatgtctgatcaagtactgcaaaatgctaagatatgacagctagatggaaagtacatgagtgttgagtgtaatatttttgtgtaattaaagtccccatttacaataaaaaccaagatacctggagaaataagtaaatttgacaagatgtaagattttttatggagaaaatatgcaacttatcaatagataataaataaatggaaatactcatttgcatagtcggagtacttgatatcataaatatgttctccataaactaatataaattcattgcacttccaatcaaaatcctataggatttttgtagaacatgctaaacttaaagtaaccagcaatactacacatctgaaaaataaggaaggggggtcaccctgacaaatatcaagactaactagaaagcagtagtaattaatattttcttacattgatgttaagtgtgaacaaataacagaatgcgtgtgatcagacctttagtaggaatttgttatgcgacagaagtggcattatgacttagcaaaaggtaagctttaatacacaggctgtccttatgagagatggttagatcactgtctcacctcttaaaaccaaatttctgatctttcttttagaaacttaatatgaaaagtaaactaaagcatccataagaatatctagaggggattctctgtattacgtcagggtatttatttgtgcctcacattcttcatttgtaaataatagtacctaaccccagttggttcttaggattcggaattcttgcttactggactcttaggcttaagcactcaataaatgtttcctactatatttagaggcacagcaagatttctttgaaaagcaaggttgtggcataaaagatttttaattaaaatacagctttgtgtgttccaaaagacaacataaaatgaaaagtcattctaaggatttggagatttttttgtaatacatactcagtgatagggtttatgtcagaataaaaacagtaagaaaaggaccacatagttgaggactctggaaagagtatgcactgttgtttaattaaatgtgcagagaatgctatttgtcaaactataatatagagttaataacttgaaggctttactacaagttcaggataattagacctcttaccttattgaaactttccggtgagtaatcgtagaatcctaattttactaaggtatcatttggtaagctgacttattcagctgtaaagatagtctttgtgttcttttgaaatctgcattatgtaagtatcacttattgctggaattagaaatagtgtctgaacttagatttcaattcttgcagatgttgaaaatttatttcagtagagaacttgctgccacaccattgaaggaaatctgtatattctgtaaatgactcattcacgttttgatagcaacttgattataaatctagttttcttttttgtatttcatttgtttttaacctggaacacattgttatctgttccttgtcagcctacattcagtctatttacacttcaaaaatattggctaaaaatgcttcagtttttaaaataaaagcttaactaattgaagatgtattatcagcattacttacaacaaatgttattttattacataatttaaaaattctccggagatattagacagatgtcagccaaccatggttactgagacatgcaaaggtaaggctggcaactttaagtgttcacttagttccaaaatggttttaactcctcttgtaagacatgggacactgaaatcatgtggcaataccaggtcatgtggccattcagatgacccagaataggcctaaacttaagttagtttcatttcagtgaagaaacaatattgtaaaggttttatagaaaacttttagatccccaggaatacagcttaactcataagaaacatttctcctaacgaaagtgtaacaggctgggcgctgtggctcatgcctgtaatccctgtgctttgggaggccgaggcggatggatcatctgaggtcaggagtttgagaccagcctggccaatatggtgaaaccccatctctactaaaaacacaaaaaattagccgagcgtgttgacgcgtgcctgtaatcccagctactccggaggctgaggcaggagaactgcttgaacctgggaggtggaggttgcagtgagctgaggtcacgccattgcactccaacctgggcaacaagagtgaaactcctcaaaaaaaaaaagtgttacagaaactgtttactctcattcctcctaatgctggaaatcccttttttttttttttttttttttgctgtttatacagaagtttcattttttattctttttttaggctaaattcttatgaatggaataattgaaccaaagatacagatacttgtagggagattcttttattttgctttttctatcagtttttcacaaggaacagagagattactcatgctaactcaaaaagaggttttgttctgaggatataattgtggagctggaacaggcctggacagtcctcagaaaccaagcctagagattggctgctctgcttttcttcaagacaccagttgtctctgcctagctctggcacacactcttacttgtacactgactgctagctcccctgagtctactatattttatgctgcctcctggccatgtgatgaacatagttacttacataaaggcatgtataaaactgaccctttagccttcagggttgcttctctttcctcattcctaatagtgatgaatgtaccattacatgccactcagttacattaggtagtcggtcacattagttgtgtttcaatccttttccctaaactgcacgtccagtaggtcattcaaaatgcaaattgtcactggaataaatgaagtaatactcctatcattagcagtaatttctgtcttcagctctttaatctgcactggccttattttcccctcatcttctgccacagtgcttcctgtgcaccgtattttagtgataacctaaatttttcgtctctcctaaaacgtttcctgtctttagaaaacatgctgaactttctgcctgctgtactatctctctcaatacttgtgctctggtgtcaactttagtgtcacctttcccttccaaaggttgaatcctgttctctgtgctaggataagactgtgtcacatgatactacggtgtctgtagttggctcctctagagcatactttgtggcacagagtaggaatccaacaggggccaaaggtagccaagtacactttttgctgcctgatagtcccaggttattagttggtagatgattacatgcgtttgatggagttttgtgtatttgctttattttatcaagttacatactacagtgcttatttatgtgtcgtattataggtctaccactatagacagtttaaccgggctgttaagttcactgttgctcttttatttgcattacagttccctaattctatgcaaacctcactttcccaccatttctactatattgctaaagaaagttacataatcctattattgactcctttcaaatttttagtgtttgaaccctagttggactcccaaggttgccaatgcagtattgttatgtggcattccatacatccctaaaaagggttgacatggccaaatttatgaaatttatgaaatttggcatgctgtgttgcctcttcctggagggaggccttggggccagtctcctgaattgagcttgaggatgcattgattttttttctgtttcgaggggcgtgagtatgattatattaggttatggccattattttctttttttttttttttccagatggagtctcgctctgttgcccagactagagtgcagtggcgtggttttggctcactgcaacctctgcctcccaggttcaagcgattctcctgcctcagcctcacgagtagttgggactacaggcactcgccaccacgcccagctaatttttgtatttttagtagacatggggtttcaccatgttggtcaggctagttctcgaatgcctgacctcgtgatccaaccgcctctgcctctcaaagtgctgggattacaggcgtgagccaccacgcctggcagttatggccattattttctagcaaattataccaagggctgaatatcctcagtttgaggaccttttttgagaacattcttttgataatttaaagtccttttttgagcttttatttaatgtttcttttttagtaaatatacagttgacccttgaacaatggggtggttggggtgctgtcctgcacagtgaagaatctgtgtataacttttgactctcctaaaacttacgacctactgttgactggaagccttaccaatacataaacagttgattaacccatattttgcatgtcacatgcatgataaactgtattctttaagctagagaaaagaaacctactaagaaaatcataaggaagagaaaatacatatactattcactaagtggaagtggatcatcatgaaggtcttcatcctcattgtcttcactctgagtaggctgaggagtggttggtcatgctgtctcacaggtagaagaggcagactgggagtcaggcacattcagtgtaactttatgaaaataagcaatttttgcctgactttttgcattttcatttctccaaaaatgtttctgtgtggtaccagtcctccttacaccttttgctttagtttcagtgcccatgtaatggaaggatctgtgttataaaagaagtcaaaagcagccttcaataattagaaccctatattatatatagctagattgtcctatgtcaatttgttttctggcactgcttcttctgcatcttcttcctcatcatctggagctagtttagaagcactgatctctgttacgtcgtcttctgttaattcctctgatgtgtggagtctgttagcccttgaatttctctaaaaagatccatctcttgaagcccttcactccccacttttttttttttttttccatatccacaatctcttatgatttcctcgataggctctggtgtaaatgctgtgaagtcgggcacatctggatactgttttctctagtaggaatgtatcattttggacttgatggctttcatggttttttctataacagcaatggcatcttccatggcgtaatccttccatactttgatgacactctatcagagttcttttttgtaacattgacggtcttttccatggagtactgtgtgtaatgagccttaaaggtccttatgactccctgatttagagatgttattaatgtgttcagggacaagtagatcactttgacatatttggtgttggaatcatgggattgtgggttaccagcgacattgtccaatgtcaaaagaactttaaaaggcagtcttttactggcagggtacttgacttcagggacaaagcattgatggaacgaatccagagaaaagcgttctggttgccctggcctttttgttgtggcagccggtgtttatcttttcccttcaaggattggaggtcagcagctttatagagaagggcagtgctgatcataaacctggacatatttgcacaaaacagtagagttagcctgtcctttcctacctcagatctggtgcttgtttctctttttgctaataaatgtcctttgtggcagttttttcccctagaatacagcacttgcgcctgcattaaaaacccgttcaggcagataccctttctcctcagtgattttcttaatggtgcctaggaactaactcatctactttggttgacagaagctcctttcctgttatcttgacattttttaagccagcctgtttctaaattctcaaccatcttttgatttcattaaattttccagctttagatccttcaccttaattttgctttaagttgtcatataatgactccgctttttctcaaaccatgtaatagtctataggtacgcctttctttatagcaatcctgtacctacataaaacctgcattttcaatatgagatcaaaagttgtttcacaaaaggtgcaagatcttcacacctgttggcctagctgcagtggcagcttcacaaattttcttttttttttttttttagctgtagttcttacactggattcatttatcttgaaatggtgggcaactgcagctgcagacctcagtctgtggtacataccaagcaattggagtttttcttgtaatgtcatgatttttctctgcttcttgggagcactgtcagcatcactagtggcacatcgtatggatctcatggtattagtcaaggcttatggtattgcactacacatggtgaaaattacatgagaaatgtgagagatcactttttactgtgataatttactggagagaagaactgctcatgcagagatgattagcctcacacagtggatactcgcaacacttccgctcaccgtgatagcaacaggaggtggcgatgaaattattacagtagtacagtatgtactaccgttaattttatgtagttaatgatttaatacttcatctgaatgtttacatttctcaactgtaaatggctccatgtatggtctgtgtttgtgtaagttttgataaattttaactttttatagtagatttttgtatttcatgatggtaaatgatagagtagtatctacatatcttttatgctttataacatacctttttcttagtttttttcagtgtttctaggctacctggtttatgagtttttttcagattgtctcaaatctccaagacattttgcaatgtttcttgaataaaatctgtgtataaatggacctatacagtttaaacccatgttgtccacgggtcaattatatagctctgttacaacaaccattttgtcagtgcctcatgtatgtttgtgatggctgtcatttgggctctcaatttttgtcctcaaaacaataccccttccaccctccatccacgaacatttgcctacatgtacttgcagaggctatctgcatgttgtggacggaaacttccaagcttacatctttggtcacttgcaacctcctcccttctgaaatttgtaatgtgcattggcatgttgaagcttttgagaagttcttcagtaaagaagtctatttaacttaatttaggaacttcttaatgtgtttgtccaggcaccttttaaatttttttgaattgtaatttacattgctaaaatgcacagacttcaaatgttcagttctgtgagtgtttttgagatagagtctcactctctcgcccagggtgctggagtgcagtggcacgatctcggctcactgcagcctctgcctcctgggctctagtgatcctttcaagtagctaggagtatagacatgcacatggctaacttttttctgtattttttgtagagacagggtttcgccatgttgctcatactggtcttgaactccagaaatcaagcaatctgtctgcctcagcctcccaaagtgctgggattataggtgtgagccactgggctcggccagttctgtgagttttggtaacttgtactcatgtgtgattacctctcaagatagaaaacattcaggaattcaacagtggatttacaggagcgagggaataaaacaaagatagagaacacttttgtcaccgtagaaaggtactttgtgcttctgtccaaacatttccacttctcttccttagtgcctctgagatggtcatcttgacttgtcattagattagttttgcctgttgtgggaagccatgaatgaaatcagtctatatttctttgtcttttgcccagcatgtttttgagactgatccgtgttgtggagtgtataagctcattcatatttgttcctgagcagtattcctttttatgagcacactataattatttgttttcttttgatattttggctgtttttagtttttggcgattattaacatggctactatgaacattcttatacaggtttctttttgtggacatacgtatttatttttcctgaatgtgtgatacagggtagatctatgtttaactttttggaacttgccggttttccaattgtgctatataccattttatactttcatttcagcagtttatgaatgttctagttgcttgatgtggtagactgaatcatggtctccaaagatattcaggttctaatcccaagaacctgtgaatgttgttttatatggcaagagagactttacagatgtgattaaattaaggatcttgagatggagagatgatcctggattatctgggtgggctttaaatgtaatgccaagagctcttactagaaggccatagagggagatttgaatacagaagagaaggcagtgtgacgatggaagcagagattggaatgatgtgctctgaaggtgggggagagagcacaagctaagggaagggagcacaagctaaagactacaggtaaccactagaagctgaaaaaggcaaggacgaacttcccctcagacactccaggaggaatcagtcctgccaacactgtgactgtagttcattgaaactgattttgctaaatttgtgctgtgattgcgattatttgttacagcagcagtagtatactaatacactccacatcttcatcaacatttagtagtgtcagaaaaattttaaaccattctagatggtgtgaaatggtattgcattatggttttagtttgcgttttcctgatgattggtgatactaaatacctcttcatgtgctcctgtgtcttttatgacatgtctattattcttttcctgtttaacaaaaaagctgagcttacctttttgtgtgatttttaaattttgttggtttatgttacatacacagatttgagtatcccttatccaaaatgcttgggacccgaagtggttcagattttttccaatttttagaatatttgcattatagctgtatagtacaatgaccgtttttttgggggtgtcatgttggtactcaagaagtttcagattttggagcattttagatttcagttttcggatttgtgatgctcagcctgtattttttttttctttttctatttctttttttttctttttgagacatggtcttgttctgccactcagcctggagtgcaatggagtgatcttggctcactgcagcctccgcacccctgtgctcaaatgatcctcccacctcagcctcctaactgggagcacaggaggcaccacgcccagctattttttttgtattttttgttttttagtagagatggggtcttgccatgctgtccaggctggtcttgaacactagagctcaagcagtcctcctattttggcctcccaaagtgctgggattacaggtgtgagccaccatgcgtggctcaactgtatttctcttgtggttaatgctttttatgttttaaggtcatgaatgtattctgtgttttcctctaagagcttaagattctgctttcccattgaagatggtatgcacttgtggttgaggcttgttattttccatgttgttgaaaagttgttgaaaactagattgaccttgggccttactggaaaatgagttgactgtatatgtgtgggtctatttctagacttgttctgttccactgatctttttttcttatgcctactctatactcttgattactaagtctttttagtaagccttgaaataaggtggtgtaaggcctccagttttctttttcaagaatggtttggttattctagtttttttttttgtttccatatgaattttatatcatatgaattgcttaactctgctggaagtttggtagggattacattgaatccatatatcaaattggaaagaatggacatttaagcaatatgaatcttcaagtctatgaacatgatctctctttgttcagtgtttttcatttttcttagcaatattttgtaattcttagtgttgagatcttgagtatctttctttagatatgtagaaaatatctgttgtttcaagcgtatttcttgaaatttcattttccaaatcttgaccctttatcttgaaaccttgctaaatttacttactagttccagtaagtagattacttgtagattccatgcacttttccatggagacagtcatatcactgtagaatataaagtcagttttatttatttctttccagtctatcttttctttgttgcatagttgtcctgtctacaatatccaatgcattactgaatagaaagggtaaccgtggacatctttgtcttattcccagttgtaagggagagatttaatgtttctttatgacatatgctagctctaggtttttcatagatgtccttttcagattgaagaacattcttttctagtgttgctgggagttttaaattatagatgagtgttgaattaacattttcagataccttttttctcgctcatttgagagaatcataggtgcgttttctcctttgtactataaatgaggtgcttgatttttgaatgttaaaccaattttgctccttgggataaatcctacttagtgatgatgaccttttctattatgttgctggatgtgatttgctaatattttgtttaggatttttgcatctagtagtaacagacctttgctgtgtattagtacgggatcttgggcccaagccggcttgttgtccctttttcagtatcagacagctgttgcttctcattcctcagcatctgtgtgcctttgtctgggactggtggtagcaatgtttcctcccttcccgtggcagtagaatatggtggttattgttacagagtgaaaggcatgtttgtgtgtgggagatgggcaagtaagttttgctccacaaatcccccaactcagcagcacatgtcttttgctctacccttccctttgaggcaggggatctttgcttgcccttgggtttggtagactttcctgcctctcccgtcatagttgaaggcatttgcttcatacgagatgccaccaaatgggaggaaggagctctcttccgttttctgccttttttcaagagcactcagttgaggcccttggaaaagagcttgtgaatgagtgcagattctctttctatcgaggactcccagggattttaactgttatcctagctcggcctttcatccttacttttatctttaatattcagcaggttgaccatgaatgtgttttctttccatatgtggattaatatctgtcatctcttgaaaagtttatggccattatctcttcatacatttttttgttccccattgtctttcatctttctctggcaccccaattaaacccaactgacatttggttttggatattctgagtcccccccccccccacactgttttttccctctttgtgtttcaatttgcatactttaatttggcctgtcttcaagttcactgctcatttctgttaagcccatctaatggtatccttaatttctaatactatagttttcatttctaacgttttcctgtgatcctcttttgtaactttgatatctgtgatgaagttttttcattattcatgttgctatctcttccatcagtttctttagcatttttattatagttatctgattttattcatgttttgactgtttgctactccctgtatcttgtaatttttgattgaatgctgaacatttgtataaaaacaatggagattgaagtaaataatatttacttttagaaaatggtccatcatttcttgttttgtccaagtgtgattttggatctctttttggtttatagctgagccgtcagctttctgaaccatgagaaatttctctatagctcagctgtcaattccttggtcattcttattttctttccccccaccccctctttctctagtcctgcctccaagcttttgtgcccagtgagacatctttctgctattaataccttccagaggtttcttttagcaatcctaccctgtcttcaagttcgctactcatttcagcctcggtagatcaatgtcctgagtatctgggtgaaagttttctcatctttcctgtcctaccgcagcccttggcagctcaatgtctagactctcttgggatcatctttttctcacctttcttgcctgtccctccccccatcccccattgatgagggtagattttttgcatttatgggagatcttaagctccttaggggatctccctcagctttccagtcctgttccccaagctttgacatactttttgcaagtacttagtggaaacctatggggatgagtggttggggtggatgcacacttgctctgtgggatccttgcaatttaatatgtcatgtcggtgtgcatgtaggctggtttcttctttctttcatttatggcaggattattcctcactagccgctccaccaggaaagagaccatccatgcagcctctcttctctcaaggctcaacacttggaatttagttcttcttaggctgctttgtatcctcaactctggttcagagagaccatgattttgtagcttatctggctagttttgattattagaatgaaagtgatgctctgttgtaactttctacgtcctaatcagaagtggaattccttctatggaatactttttaagtatatagtctgataatacataactgacacgttttctgttgtttcataatggttgattttctcagggctacgtttctctattttttcctgttctcaaatcttaactctccatctctgtcctcaagtggtaagtgatcttgtgtcttattttgaaattaaagtcatcaacaaattatttcaactcatagatttatagttgtggaagacttactattcaaatggaattagaacgttttgggggataggatgcagtagttcttggtagtccaagactcttaataaaacaactagaaaagccaggtaatttacaaaatttatatatttagcgatagagaacaatgggtgtaaaaatgattaaagaaagcaaaattttgcaccctgggggaatacctttcacaagtgagctgagaggtctgcagctgatcattgtttttcctgggtacagagtagaggaggcctttgggctgcagcctgagtggcagattggaaatatgaggggcctttaaacacagagaacgccctcagtatattcctaaattctgtagttcagctgggcggaagagataaaccaaaatctcagaaaaggagattgggatattttctagtcctatggtgttgagataaagattctctaggggaagcgacttgagaacaataggtgagagttgaaagcgtttgaggaagtggtgaatacacactgatgattttcaacacacccagtttcttcccccgtagacatttgccaaattctgaagctgcttaggctagagagctaaaccagaagtctcttaaaaacaaagcaattcttatagtatctaggtacctagaagataacgatctgctagcttttgaaatgaaggctctgcagagtctcatcctaggaacagggacaaaccagaggtagtctccttcatagcaaaactgctactcagcagtgttctatgattctggcattatagaggaagtagtaaaagtatatgtatgaaaattgtgttaagtgaaggatgaataagaaaatatctagggtaaccactaaaagaaaagaatgtaacaaatgaatacagaaaaaaattggatatagaatatgtgataaattcagaagaagacaagaaagaaaatataaaacaagcaggcaactaaattagtaattatgttacatggaaatgggctaaatatttcaagtaaatggcaaaaatcatcagactggacaaataataattacctaaatataagtacctagaaagattgagagaaaatgatgcgaaaaggtataccatccaaatgctaactgaaggaaataagtgtggctataccaatcaggcaaaggagactttaatacaataaacagtagtagaaaaagagaactacattttatagtgtaaggggattgatccaccagagttaccacaatcctttatgtgtacccagtaaaatagcccaaacatctataaaccaaaaattttattttgaactaaaagaaacagacaaatatgccatcacaatggatgcacatatataggacatacatacatcacaattagcaggcttgatctaattgtcatatgtagaacattgaaactattaatggtggtattaaccatcttttcccttgcacatggaaattgtactagaattgaccataagctagggccatgaacaaagcctcagcaaatatcattgattttaataattgaatatgttgtttgtattatagtaaataaaaataactagaaaattcctagctgcctagaaataaaacactatgcttttgaataacatatgacttaaaataagaatttatgatggctattagaaaatattttaaactgattgaaaatgaaggtgaactacaatgatctagattgctgctgctgaaatgctaagatgaaatttatagccttaagtctatgcattggaaaagaaagcttttttaaggaggtagaaaaggaataggaaatcaaacctaaagacagtagaagtaaagaaataatgaagacaagagcagaaattagtgaatagaaagtaatcttacatagagaaaattgacaaagctaagaaaaagttggttctttgaaaagattaatgtaattgaccacttagcaaaactgataaaaggaggatggggagggggagagagaacataaatttaaataataggaattgaaaaatgtcacatcactacggatcctacagccgttaaatagaggcatttatgaacagtttatggagaatatgggataggcagagtaggcagaaattttgagtagttagggctggatcattcaatatgggtaggcagcacctttgtgtagctattgagtacttgaaatgtggctagtcctagttgagttgtcctgtaagtgtaaagtactcaacagattttgtagacttagtatgaaaattttttttatattgattgcaggttgaaatgatggcattttggatatattgggttaaatacatcattaaaatgttgcctattttctttccctttttaaaatgtcattagagaacttaaagtacatatgtagctcatattacatttttatagaggttgttatattggctttaagataggtactgttatccttattttacagctgagaaaactggggtgtatagaggttgccatgcagctagtaagtggcatccttgggatttgaacctggccaattggcttcagaatctgttctctgaagcattacactgtttatgggttcttaaaggatattaagtcattttactgttactttttgcaaatattgaaggatttttagtagtagggtgacatgcagtatgcattttagaaagctgtttgcatcaaagaaggtagaaggtggtgactgaaagactagttaaatgatttgtagattgagaaaggagttggagctaaatgtgtcattctaatcctatctaatggactaatttgtcaggcacagatagctctgttgattgtataaagagctcagcctttaatggctctttttaggtctccagattagcttcagattgttatgtgcaacacaatgcattgacacaattaagtacttgttctctggcatcatgctgcttgatataaatcctagtgttggcacttaaaagttgtgttaccatgttgtgttgctataaattgtcctttgtattcatgacacctttctccctaatcatccactttttttccacatttgataactcctttatatgtatttcttagaatttttttttcactgaacttggcgctttctgagctctcccatataccagcattgcgtttcattaccacatgacagtttgatctctctgctaagctccaaacctttgtttctagctgcttatcgggcacctccttctggaatttcatagtcacagcaaatttagtttgactaacacaacacttatgttccccaaatacttcgtattttggcgaattgtattttcattcaactggtttttcaagcaagaacctgtaatttgtaactttttcttaatcaactctgttccttctatgtccctaatagctattcttccttttgtgtattgcaattctctgctggttgatctctctgcccttaaaaacttaccccttctccattccccactgccaataccttgctacaaaggatttcttttgtcctacccgtcccagctcaacagtgtagtttgcagatgaataacacagactggatttgagaataaacaggtaaatacaggcacaatagacaggcaaaaaaaaaaaattgttgaatgcaaaaaggaatgaataaatggcaagctgccaaggaagtgcaaatatttcctcaggaaaatctttcctgacgcctaaagcaaaatcagatggtgtttctttgtgtacctgtaatcccccttgcaatttctcttaattgtcatgtgtattttaatcatggcagtcttcttcactagtcattgaccatcctgagaagagggaatatttaaaaaaaaaaattattcttccatgtggtgcaaaccaaaataatggaattatggagaggttagagcaggaatgcagtttgtgtacattggaaatgaatcttagcatataatctatgaaaattagccatgttctttgatgggaaataaatttgcatcttgtgttaggatcttctttaacgttaagaatatgtgcaaagtgtgcttaaaaactgtttttttcctttaaaaatgttttatccagttttttgtacacacatacacaaaaacatacacaatggccatatcattcagcctttttcatcttttcacccccttttctgcatattggtatatctgcaacccatattaatatcctagatttttgtttatacacgtataatccagttactagttgtaacacgtggcacattgccagattacttagaataaagctgtcacatttgaccttttcaccagcaatgtggaatgataacaatttcttcacatcttctccagcagtaggtattttaattaattcaatttttgccagctagattgggcatgaaatgatgccttattattattttaacttgtacttcctcctctacgtttaaaaactattgtctgatcattatgataattaaggaacaaactaatgaaaatgtaagcatcattgttttcttaaagatacactttgaaaactacaatttcagtatttggggtgtgtgatgtaaagactacagacctctttactttctaaaaaggatgccttttgggaactttattaaatatggcaaattgaacacattcattttcctttttcctatatctcactaaaattgaaggcaaaggaaagaaaagcgtaagagctaagatattaagagcttctggagcgaaacaatttttaaaccccaattaaaggatcaggaataaaagttatgtgggacttaccagtatcagtagtggagtctagaaaattgaggggacagtgctttctaaattctgtgtgaactgataaggaatgacctacagggaattaagcaaaaaaataaaaataaaaaaataatttcaagatatacaaaataaggaatattatgctacttttgtacagcaataaggtgggaatgtggttagttgtatgtatacatgtttatatttgtaaaatgacgctgaatagacaaaacagcttaataaaaatgattcctatggaagagaaaagacaaggtacaattccttaaattgggaagagaaactatctgactttactcactatgcaaattgttatttagatgaaaatgaaaaaaacatgtgttaaaaaatttctctcaagagcaggtgaaaccggactacagcttttctccacggactctgtttgccatgtttatttctttattcttgattacttcacactttacgcattttcccttcttgtaactgtagattttgcctcctattagttatgaaagtttaaaacccgggggagagtgggcttacaaattttcaatgtatttttgtatagtcttttgagattagagtgaagttctaaaaagtaagagaaccttttgtgaaaatattttaattgacactactaagagtttaaaatagtattggtggtgaaaaatcgttaaaagtatctgattttacttgcaaaattactgtattttcccacaagaggagtccttacaacattcttgtttttagaagggtttgtttccatcattcatttaaattcataaagataacgttttcatgggtggagaagtctattgggaaagtcataattcgaatttctatcttgctttgcagtttgctttctatgataagttgaaattattacttgatgttcaaggtagtctctacatcatcctttcaatatttctgctaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaaggtaagttttgttagatcccaggtttgatcaaattatgtcaaggaatctgaaggaaagttactgaatttgtgttcctttcaagttgcctgtaaaaagtgatgattgaaatatgactgtttttaaccttgtataaattgtttttgctagctgacttgttttataaattattttcttgaatagtgaggtttaatcaagctaaataagatacttagatttattatcttcattgcctacatttgtatgttatcctcatttccgtgattgaatgatacttgaataaagaattgaagctttttctatcactaacatagtagcaacctacagttttctcctcctttagtcaaaactttcatcaggggtgaaaagaggctgctcactttttaatgaattttatatggtttttctttgcgttgcagcattgcttccaagaaagaatagtgtgttaggtggcttcttaattgttgtaggcattagtcagaacctgtcttaaagacctgcctcttaggttaggaggacctgttactttaaaagtctgaagttttctgaggataaatttaatcatttacagataagtaccactgtcataagtattgttttttaattaagtgacaggtgttttaaagtgtgttttactacttgtgtacattacagattttggggagattgttaaatgtaagaattctctaaaatgatagtttgcagtgtcataccgtgggctagcatatagcatgtgaaaccattctacttgactttgaactttgagaagtacacttttgatgcttatagataacagatcccaataacaccagtgcagcctgtctagttgcaaatactaacagtagaatgtttcttgccttgtttggtagaccatccatttctttcccttacttgttttatgtatatcttaaaggttgcttttttggtttgttgatttgttttacaaatgcttattgagtgtttgctatgtagaaggcactgtttctagacatatgaggataacagtgattaacaaaacacaaaactcctgccttcctaagggatagaaatacacgataaacaagtaaacaaattaattataatttgatatggtaatgagtgcaaagaagacaaccaaatgcagtgatatgatagaatgaagaattaaaaagctgctttgggtcggattgtgatgcttgcgtggagcttggagaagcagcagccaactgagggaagagtcttctaggcagagggaagagccagagtgaagacactgaggtgagcttcttgtattagaatatttaaaaggagcccagtgtagatggaggacaagacttgcccaaagcttatacagggcatcctagagtgtggtgagagtttgaatgttagtctgaatataacaggatgcaagtaagtttattctgatggattttaaagaggatcttacatatttttacaaagatttttctggctgcgggagagtggtatgtgtgtagtagggtagatggaagcaggaaaattaggaggctgtgaggaatctaaatgcaagacgatagaggctggactggcgtggtggctgtgctagcacacgaagtaaacagatttggcatgggttttagaagtggaactgaggacttcctggtgaatgggctgagaagtcaagctatatttcattcttcattgtgtagtgcttgggatttcaattaggtaaccatttatcatatgcccactatgtgcctggtgtgctcttcctcactggagttaagatacagtgtttgcttttaaactacttacttcctagtaagggagataaacttagaaaaagatggtttcatgaggcttggtagatgttataaaagaagtatgcttggggctatatccagaggaggcttgtggaaagtttccttctggaggaatactggtgattttgagttgagcggggtaaaggaggaattaggagaagcctgtttcatcacatgtagtgcggtggtgtggagattgggaggtgggggaggattggtgaagcgttccaaacaagttgggtatccttagagtataaagtaaggggtggcaaatggccatagtgtgtataggtagtaaggagtcacttcatgctgtgccagtgttcacacttaacctgagggtgacgggtgaggttggggccgtttaagtgccgtagggtctgaaggctcagaagtcagattaatttcaagtgcaacgtgggttgcagcgagaaaactccttgaggctgtcaagaatggaggccgggagactggtatcacttgattgaagggagctgtgtgatacagcagagatagagccatgtttttgcacaacttcaacaaggctcaagttgccattgcagtgaggttatccagagcagagcctgagagagtctaatcttttagggaggtacagcagtactaaaattggccattgctggtatttaacctgtggaggaggtcaccttagtcatagctcttttccttatttcccattctttttacagcctcttttggagatagagatctctgagagctcatattctggagctgcttcatcattaaaaacatttttttctgccctctcacctgattaatgaagttgaagtgataattgtccattatcttgtttttcactattgaagtttccttgaagcgtagaaatttgcctaatttggtggtttttttagatgttgcaaaaatggagatttgttattattgatcatggtctatcaaaaaaattttaactttttacacactgtagcttagtgccatatattttataaagcttgtttttagtagtagaacaattaaattgtgtcaggttattagtcatttcttaacaactaaatattcttaaatgtaagaaatttagttggaattcagggaactcatttatatgtagagtgtaaaagatgggaagtgggatggaaaagatttgttatggctaaatccaaaccttagcttaaacagaattattcaaaatgtgatacacaatggatttgtaagcacgtttactcagaatttcaagtaaaatgttagtaaagtgcctttatggttttataagccaaaaaatacaactaagttcagctgatgaagaacgggaaacaaattgcttaattttaagaaatggcaaatgttttctgttgaaatgtttactgaacagttcctcctctctactttcagccccttaatattagagtggggttaaagttagggcagaaacatagtcctggctttgtgtccctcccactcccctcatctcattactcttgttgcctctggcagtttaaaagctgtagttatagatacgtcactgtcgctcccttcccaccattttctgtggtgacacagagtaatttataggtagagcttaacctcaataaaagctgcagtgagctaaataataaaaaatttcaggaagctttttcatctcaaacatttttgagtccgagggatgggagacaacttggtcgtgaaatcagaatggcaattgatatttagataaagaatcagacataaggaaaaagctttcaatatattattatccacagtaaagcaaaattgaaattgcagtggggatggaggtctgtaaagttaaaagtaaggactatggggtctaaaatggctattttataatattgattatacataaatgtataggaatgcaaaatttattttcataagcataaattaaaaggactttcctaaggtggtactctgaccatgtaatcacatttttgatctttcatcccaaggaaataatcagaatattgtcaaagattcctgatgtttgtttcagtatcattttttccaccagtccattggaatctgtattgtttttaatatgaattagaaaaaacccagtcctaacctttagtttctttaataaagaacacttaagcttattttataccacaattaaacaagaatagcgaaagaaaagtttatgccactctttataaacatagatgcaaaagtcataaataaaatatcagaaactagaattcagtggtttattaaaaacaaaaccacaaaaacataactaggcatggtggctcacgcctgtaatcctagcactttgggaggccgaggcaggcagatcacctgaggtcaggagtttcagactagcctggccaacatagtgaaacccggtctctactgaaaatacaaaaactagctgggtgtggtggcatgtgcctgtaatcccagctactcgggaggctgaggcaggagaattgcttgaacccaggaggcacaggttgcggtgagcccagattgagccactgcactgcagcttgggcgatgagcaaaattccgtctcaaaaaaaaaaaaaaaaaaaatgtctaggtaatgtttattgtcattcaaggatgactcaactacaggaaatctattagtataagataccacataatcatatttaagaagcactttatgatcatcatggatccagaaagggctttctataaaatttgctattcatattaacaaattagaaataagagttttcttagcttgataaagcatacttctaaaaatgttaacacttaattatgaacttttagagattaattgaccaaatttttagtaatgagtatgggtgacccagaaaagtcctgtatttttttttctagtatttatatataaaagtatatcacttttatagtcagcacaattaaatgtttaaataggacttttgggcaatttaattcgtgtctatttatgacaagactattcttgtcttttttctttgaagtcagttttttctgttaaaaggcaattctattttttttagcattctgatatttgtatgtttatgactgtttttgccttcaaaaagtgtatttctagccagacgtggcagcattcacctgtagtcccagctgcttgggaggttgaggcaggagggtcacttgagcccagaaattccaggctagtgtgcagtgatcacatctgtgaacagccactgcactccataccgggcaacatagtgagagtctgtccctttaaaaaaaaaaaaagttacttaaaaacataaagtagcatgtacataactgaaaaatcaaccatgattatacggtggaaaaatcagtctccctcccacccctgttttttcatcacccagttttcctctgtagtgaacgttgtattactagttcctcatgtgtccttccaggatgtttctttttaatgctgccattaacatttggattttgttttgcctcttagaaacgagacagagttttgctcttactgcccaggctgcggtgcagtggcgggatctcggctcactgcaacttccgcctcccaggttcaagcgattcacctgcctcagcctcccaagtagctgggattataggcatgcgccaccatgcctgtctaattttgtattttttagtagagacagggtttctccatgttggtcaggctggtttcgaactcctgacctcaggtgacccgcccgcctcggcctcccaaagtgctgggattacaggcatgagccaccatgcccggccacctcttacagacttttaaacatcagagtaattagtaactttatgcagactgtcttggaatagagcagttgtcattaaaaaaactgtcatcttttatttctaacctcatgttcatacccttttgcttctctaggtaaccaggaatagctaaagagaagtctttttgaacccaaactgtagtattcttccattcttaagcaactgctttttcataataggataattctttcttctcattcatacataggcatgtgcgtgtgtctgtctgtatcgtaatatgtatgaaacactatggtggagggaactctgaatttcaagtttgataacctgtttttgtgtcagcttctttagtattgatgaatgtagatcctagggaatatgactgtactttttttactgttcacagctgtgaaaggcagtagtgctatctgagtactttcacagtatgacttttgggtccattgaaataatgtaaatgagcttcataagctataaaacattatagctaggaatatgatttattggaaatattcagatattctaggtcttcgttctctatttttgtttttcaggagaactcacattaaattgtagacattaaaatgtattgtctctgcttagaaaaagtttttgccaggcaacattgcatgatgtataatttagtttattaaatgtataaaatttgttgataaagtcagagcaataaaactttataaatatgaattagaactttgaggttatggggaatagggaccttttatcagccttatcatccagtttgtcatatacagtttataaatgtgaaagcacttgtgatgaggtcaagtatcacgtgaaacacactttggaaggcactttgctaagccctggaccttatctggtgcctacatttacagttaggtattttgagggggctcctgctccaggacctggtattcaaagtcccttgtgtatatggtatattcttgcatggggcatttttatcacttaccttatcagggaaaatacctacctgccctaggacctttgtccctttataaaaattactgaaattatacctaaattaatcaatttctgtaattttatcatgtaacacctgatgcaatgaacaatataccctcttttcttgtcctgtttaacatattagcttcaggaaagagtcaacctagctaaaataggcatttaaaaaattacagtaatcttttgttttcccaacatccttggtctgtttccagtccttttttttttttttgagatggagtctcgctctgtcacccaggctggagtgcagtggcgtgatgtcggctcactgcaagctctgcctcccggattcacgccattctcctgcctcagcctcctgagtagctgggactacaggcgcctgccaccatgcctggctaattttttgtatttttagtagagacggagtttcaccgtgttagccaggatggtctcgatctcctgacctcgtgatccgcccacctcggcctcccaaagtgctgggattacaggtgtgagccaccgcgcccgactgtttccagtcttacctggaaccattctaggctacccaggcctttttttttttaaagtatttaccatccagcccaaaatgtcatacccaggacattcttatgtgactacattctgggaaaaaccatactgtttactccttccccttcctgtcttgtagtagagtccttccaggcctgtgtggtcctcactggcaatataagtaaatgtatcactatccaaagtgcctgagatagacaatacccacacatggactatggagagaggtgagataatagtaaaacagcagtttaggatatcttgctttaaatcttctgttgtacttgggctaaaatcagaacgtctcttacagttctgttgttttcatttccttttttttctttttctctttttcaatttagatattttctgttgatctacttttgagtttactgatcctgtttttgtgctgtattcagtctgttaagcctacgtaagttcttaatttcaaatatatccttcagttatagtatgttcctttgatattatagaccccaaatctgttgaaattctccattttgtctatttccttaatatatttataatagttactttaaagtcttctgtgtggcagttctaatgtctggatcatctgttggtctgcttctgttattgtccattcttttctttctcaaattttcctgcattttcatgtcatacagcttttattgtatgccatatgttttgtacattatgtaaaattcactcataaagatcttgcaaataatgctctccccagagtatttgacctttcctacctttaccaggtagatagagagaagctccccttaatctaattagcgattgagctgggtggggctagactgccattttaatttggtttagtctgccactggattatacctttcctgcaaacagcgctccagggattttgattgaaagcttgttagactgtcacctaacccctgaaacactgggagattcacttctactttttcgaagtatgaggtgactttgaaagtatgagctctttagcctcagctttaagatctgataagcgtcttgagggggaatactcatgtgactgtcaaaagttctactgttttattcctcagagcttcttttctcagaccaagcctttagcctgcacctagaatctacacgtgactccaggggaggaagtgataggcatttgtcagttcacctagaaagctgctttgctgcagttttagttcatctggatctcattagtttgatagctctccattgtcttttgagcaagttttttttttttcccttttttcccctctagtaagaacattggactgctgtgacctgcttatattttacctggagttggaactatagcagaatgttataataggaaatgttctggtatttaccaaatctggtatttaccccaaatctgagaacagtagattgccagtaacctgcattcaaaattgaggtgctatagtgttcatgcagaacatgcagaaaagacaccctgagtcaagcattgctacagttaaaacctgttactcacctgtaggctgtataaagatcgtgagttcaagagaaggaccccatagtgaaaagatttttggcgagagtagtatatgttaaggtatttctcccttttgttaatccaatttgaaggacttgacgagaacttctcagtttgacatgtgtctgctgaggtttgagagataaatagactggtacttgacttctatctgaaaaagcctaaaaagtgagataaaggctggagctgcccctgtatcggtagaatgaagaaagggcacaatgggagtgggccagcactttgtcagagtttgatgggtcaaaggtggaagaattacccccatggacaaagtagacgttagtaagacataatagttgaagttggcttaccttgaaaggatcaagaggccatacttggttgaagggtcacagtgatccaagcagacaagcctgagaagttcctgcatcaggaactaactataggtgagagtctgcatttggacttccaacctccacaggactccatcacacattactgtcacatcagattacagtccagccagccacttaagatcgtgccccttttctctcagactccctcttcctgctatttcagaaccgggaggggccttaaaaataatagctggagagtactggaagaggtagcgtgaaaagaattaatgagatagtaagattttggctttgctgtggctggattttaatttctgaagacatttattgttaatacaaatatctggatatgactaggaagtgttgaaatctttttgggattttgtgcagacaggataaaagcagcttgggaagagcttgttggagagcaatgactagagtggtggtggaagggagctcactaagtctagtttgtttcatgagctgtctgtatcctctttttgaaaattgagaattccaaatttagtggttgctggggacaggaagaatatgtggggagaaaagagggatgttacgtgtgtctacgtgaaatacatgccattttaacaaaagccttttctttttttttttttttgcatataatcatgatactggttaaattagccagtgatgctttattttcaaagaaatgttacaactacagttttcttctattatcatcatcgttttccttgaagcggtaggttagtctttactctcaaaatccaacttttaactctgactttgggttatgatgggaagcgctatgaaatggtcttggtgctcttatgaaactgtgatcactaataatacttaaattagaactgaaatatataaggagacttctcactaactccttcaccccagccttttgtcttttagaactttgcttatctttatggttagatagatagatagatagatagatagatagatagatagatagatggatagatatagatatagtttctctgaaatttgctaggacaacggggtttgggggcaatgaaagaaggttttatatttatgtttaggatgatagggacattgagagatactgaacacaaatttataatgaagttaagtaatttaaaagggttttcctgtaatttttatatgatgccttatataatttgcatccacaggtataaaacattaatctatgtgcttaaacatttgcctaaacattttaacatgttatctaaacataacctctatgcataaaagcagtttatcacattcagagtgctatacagatttgagttgatttttattttgtgggatgctaattgtcaaaaattgtcagattataaaaacttttacaatcaaagtcaagcattataaaactgtataacttaaaaagttgaatttcatggaatcacattctgtattgtaatcattgttttatggttgatgtaaagtcatcccttggtatccttgggataccccatatctccaaaatttggagacgctcaagtctcttatataaaatggcatagtattcgcatataacctatgtacatcccccaccatatactttgttttggaggcagtggggagacagcgtctggctctgtcgtccaggctggagtgcagtagtgcagtgttggcttactgcaacctctgcttcctgggctccggtgatcctcccacctcagcctcttgaatacctgggattacaattgtgtgccaccatgctaggctaatttttgtatttttggtagagacagggtttcatcatgttgcctagtctgatctcgaactcctgggctcaagcgatctgcctgcctcagcctcccaaagtgctgggattacaagcgtgagtcaccatgcccagcctgtattcttcattgttgtattgttattttatctagtttttcctctagtattttctgtccatggatgtggagcccacatatacagagaccaaccatgtattccagattttatgcacttattttaagattagaataacatgtacttatattttatatttattttgtcatttatgttactatttttctttttaattgttaaaaacagtatatattggccagacacggtggctcatgcctttaatcccagcactttgggaggctgaggcaggtgggtcacttgaggtcatgagttcgagaccagcctggccaacatagtgaaatcctgtgtctattaaacatataaaaattagctgggccaagtgtcataattccagctatctgagaggctgaggcatgagaattgcttgaacccaggaggcggaggttgcagtgagccaagattgtgccactgcactccagcctgggtgacagagactgtcttggggggggagggtatatgtgtgtgtgtgtgtgtgtgtgtgtgtgtgtgtgtgtgtgtgtgtgtgtgtatatgactaaatctagaaaatcgataagctatgttattaaagtaaatgtacctgaaccctttcagtgttagcttttgttttctttaagtaaaaagtttgtatttggaagggcttgaaatacttcaaccatttttagaattgatatttaaatcttttcagtagtagagactattttgtgtgtgggagatactttgttttttcaggggcagcagaaatatcaaacggtatctcagagtagagtttttaataacagcatttggaggtggaggtggaaaatattgagaaagtttttttcaatcatcacctggtccttcttctaagaaaggctatactatatcaaagatgagtagaagtgtcaattttattcttataggactgtgtgacttacaggagtgtgattatggaagttctgttgtctccgcctattttttatttagttattaatatttggaaacctaagctgcttattttaatttggaaggggctttctcaatttacttgtccaaagaaattttctttcctgagaaaatgtctcttacagtgaaatcttcagtttttataattaaacatgttgtgtaaatgttttacatacctgggatattataccagttttattgttttagctttgatttgctatgtttatattacttgtttctttttagtaactatatatggggcggaataatgttaataattaaaaatgtggcctctgtctcttccacttgctggctgtaggaccttagacgtgttactttgtgtttccattacctcatttgtcaaatggggacaacagtgcctgattcatggcactgttgaaggattaagcggtttaatatgtgtaagagcttggtacatagttggtgcttaataagtgtgaactatatgtgggatgggattttatatataaaatttgattttgaagtgaaactgatgatgtcacctatattacatgcaccaagagggcatgaaaaggtttattactcacataatgatgctgtctgagtagagcatggcaggcttccaagttggtccaaaaatgacttgagagagcagtgataggagactggcttggggttttatggtgattagggaatggggctgtgggctggtttttacactgtacatatgctgagacttgcctggtttgaaatttctctaatatcaacaggtggagcacctgggctttcttaccagcttgcccagattcgaggcagaaggggaagaggaaatggtggggcttgaaacctatcagcagtcaagtatcagaaatggagttggatttcttattcaacacaaacaggataaataaaaagaaaaccacacttagatatatcatggtcaaactcatgaaagagggaatcttaaagcagctggtgaaaaatggcacgcagcatacaaatgacaggtgatcagcaacagagaagattgtaaagtgatatatctaaatcaccaacatcagggagtcataacaataaattgtatctgcttaataaaggaacttaaaaatacatgcagcaaaactgggtagaattaatgggacagaatcacaaatccacaattggagagttcaattagaacaaaaaaatcagtaaagacatagaagttttaagttacattattaagttacattattaactacctacgtgatatttatagaatactaaacccaacatgagtagaaatacaagcgtttcaagtgttcatggtaacttcaccaggaaagactgtttacagggcacaagtctcaatcaattttaaaagattgaaatccaaagtatgttctctgccaccaatagaataagaaattaataccaataagacatctgttaagaattggaaattaaaccttaaaattctgacttatgggttattcaggggaaaaatgaggtaaaatatatttcaaaccaaattataatgaaaatacagcatatcacatatgtgggatgtagctgaaagagtgcctaatggaaaattttatagttttaaataatctgctaggaaagaaagttacctaaaaagataaaatagaaagtaagtagaaagaagaaataataaaattaagagtagaaatcagaaagccaaaagcgagttctttggagagataaacgcttgttagactgatcaagaaaaagacagagagcccacaatcacaaatgacctatattggtactgaaagagggattgtcatggtaggtcctacagacagtaaaaagattataagcaaatattataaacaattttatgccattaaatttgatgactaactgtaatgatgaaatttaggttacccccagctgatgcatgaagaaatacaagatctgggtagccctataacaatgaaagaatttgacttcataatcaaaagctttcctgcaaaggaaacttcaggcccacatggttttactggtaaatttaagcatttgtgcaacaaatatcaccaatcttatagacaataaactcagaaaaatgttgttttatgaggctcacataaccctgaaaccaaaacctgacaaagatgcaactaaaagaaaagttaaagattaatatatcactaacatacatgagaaaagaatacatcataattgagttctattccaacaaggttagtttataactttcaaaaagtaatcagtgtaagccagccgcagcggctcatacctgtaatcccagcactttgggaggccaaggcaggaggattgcttaagcctaggagttcaagaccagcctggtcaacaaagcaagaccccatttctatagacagataaaattacccacccaggcatggtggcatgcccctgtggtttcagctactcagaggctgaggcaggaggatcactcgagcccaggggttcaaggctgaagtgagctatgattgcaccagtgcactccagcctgcatgagacattgggaccttgtcccccacccccgaaaaaagaaaaattaatcaggtcagatgcgatggcttatgcctctaatcccagcactttgggaggccaacgcagtaggattgcttgagagttaaggagtttgaaaccagcctaggcaacataagactctgtctccacaaaaaaaaaaaaaaaaaaaaaaaaaagccaagcgtggtagtacattcctgtggtttcagttatttggaaggctgaggtgggagggttacttggacccaggaagttgaacctgcagtgagcagtgatcacgccaccacactccagtttgggtgacagagcaagaccctgtcgggcaaaacaaacaaacaaacaaaaaaactatgtaatttactgcattaaccaaggagggaaactataagatcacctcacttggtcaaaagcatttgacaaaattcatcatccattcatgataagcattcccagcaaatgagaaacaaagagactttctcagtctgataaaaggtatttaagaaacactaacagctaaggatttacttaatcatgaaatactgtgttttccctcaagaacaagacagggatgtctactcttgtgtccttattattttaatagaagacctagcaagcgcaatgagtcaggaaaacaaaatataaaaggtttaaagatctgaaggaatgtttcaaaattctgtttgtagatgacatgcttatttatgtaggaaatcctaaagaatctataaatatagccactaaaacaaatgagtaaatttagcaaggctgcactttatagattcagtgtctaaaaatcaattgtatttttgtaaatactagcagcagacaaataggggtgttaagaaaattcatgaatagtagcatcagtactaaatacttaggaatacattaaacacacacacacaatgacctctgcttaaaatgctgaaaccttgctgagagaagttaaacaaatgaagagggagttgtgattctcatatggccaggtatgctcttaccagactgacactccctcaataacaaactgcacaaaattctaaaaataacatgaagtactggagaataaacaaaaataggcatgttttagaggggattgacactcggaagaaggaaatggcgtaggcgaattttctgttttacagcttttgtccatgcaaagtgtgcagggtaggtaaaattccaacacaaaaccaagtctttctggccttgaagcaccataggtaagacttgggagaatcacaactattggagagtgaggagtgaatatcagcaaggagagtttcagaaagagagccctggattctgcctacaaactttgccaaaatcacctgctgatcccacatgtgtacggtagacagtacagccagataatcagcctgatttgaattgctccaggacagagtttgtggtttgaatgcaaccaggttagttgtctggtgaaacaaaaatgaagacttttggaagattgtaacagaacctctaactaccatcagataaaattcacaatgtctagcatacaatcctaaattacctaacatacaaagaacaaagaaaatgtgaccctttataatgaggagaccaaccctagaagacctacatgttggaattaccatgcagtaaactgatggatacacttgtgaattggaaaactcagtaataagttagagtacttaaattaccctgacttcaagactcaccttgaagccatagtaatctgtatagtgtgatactgacataaaaacagataagatagccccacatagataaacactgtgtgcctatatgattttcaacaaagttgccaaagcaacccagtagggaaaggaaagtctttcaacaaatggtgctggaacagctgaatatccatgtggaagaatgaacatgactccaccttacaccagtgaaaacaaaatatttctggataaattgtagtctaattaaagctaaaactataaagcttttataagaaaatataggagaatatttatgacttgggggtaaacagagaattgttcaaagtatatagaaagcagtgaccatgaaagctgctaagttagactccattggtatacaaaacatattattaaaatacattgttaaaaaataagtcagagtgggagaaaatatttgcaaaacatttctgaaaggattgaatctagaatttataaagatttctataactcagtaatgtaaagatagcctaattttaaaatggacagtagttggctacttcactgaagataaaggtccagtaaagaaatggaaaaatgtgtaatatcggtaggcttcaggaaaatgacaattgaaaccacaatgaaataccactgcacaatcatcagactacctataatttaaagactgaccacaccaaatgttgatgaggctttggaataaccaggagctctctctcatacattgaaagagggaggactgtaaaatcgtactctggaaaatgatctggcaatttattgaaaagctaaacatgcatctatccactgactcaagattttcacttctaggtgtttacccgagaaaaaaagaaatcatatttctatataatgatatgtactttcttgaatgttcatgacaactttattcacaataattaaaacctggcaacaggtcaggtgtctatcagtataagaatgactaaataaatcatgcttgttcaagtaatggaaaacgactccacacacacacacacacacacacacacacacacgtcatatacattaacatggatgaatctcaaaatcatgctgagtcaaaaaagacccaaaagaatatgtaccatattccattcatacatagactttccagaagacacgacacctatggtgaaaagatcagattagtggttgcctctggggatgagcgcatggatgccagacattgagaaatggacatgggtgatgatcttgacagggttgagaagtgtacaatgtatgcatctgagaaaactcaaatggtaccattaagatgtgtgtttcatgctgtgtaaatttaacctaaagaaaaaaagaacagcgaactctagttatgtgcattcttaagtgtctagatttgtgttatctgcagcttttatttttctctctgagacagggtctagctctgtcattcaagatggagtgagtgcagtggtgcagtctcactgcagcctccacctactgggctcaagtctcggcctcctgaatactaggagcataggtgtgcaccagcacacccagctaatattttgtatttttgatagagacggggtttcaccatgttgcccaggctgcccacatacacccttatttttaatgttccaaaaagtaagggatggatagagaggttaagtagatacatgagagagcaaaagaaaacaaatccaaattacagaatttagctgatcaatgtgtagggtgcttactcgtaactttaatggatgtttgaaattttttatcatacagaactcaggagaagatggaaagcttgttcatggaagtatctgagaagttggaataaatacttagaaactgttgagtttttcttttctgagatattcctctccaaaagtttgcttgattctttcgttttgttttgttttttaagatgggatctcacggttacccaggctggagtgcagtagtgcgtcatagctcactgtggcctgaaactcctgaactcaaactatcctcctgcctcagcctcccaaatagctgggactgcaggcacatgccaccatgcctggctaattttttaattattttgtagagatggggtctcactttgttgcacaggctgtttgcttgattcttaagaacgtatagggatccagctgtacagagctttctgcagtcttttgtaatagaattagttgttaaaattgtacttattacatgagcatcaaagaccttggaataaagctattcctcacatatctggacattatttggacttactatgttaccgattaggaagacttggtattagtttattttttaaaattctgtttcatgtgtgttcttataaaattatacaaataacagtaccacaccattgtgtggtgagctctacttagagctctgtacagcttgggtatctggaatgtagacatgctctgttctgatttgaaacttagaatgaaaccctgacataccggaatgcacatttggtgactgtttgtttttgaatggttactatttcattgctacaagataaaatcgaaaaacattttctacacagagtgaaggtttaagccagttaaggaccctgttaaactgtctccagatttaattactgcccaattatgccttaattatgaaggaatgtgagcacttattagctattgttgatgattcaacctttttgaaataaatttcttaatatatttcttttatattttcaatttttattcaggaatatctcaaattttcaagagatacagttttttgcatctgtaatgcagcaacttaaaaaatcatttgcacctacttatttctcaatcaggattgtctacattttgcaaataaaatatggggaagagactggattctgaggcaaataaaaggctatcattcttaatcattgattaaaaatttaagtttaatcaaagtagtcacattgttttcagtgatgtgataaatgacatttaaacatttgtaattgaatactacaatctattttgtgtctttcaattatatttgtagtcaagataaaatatacagccacacatagtacttgtaattatggagacttaaaaaaattattacagtgattaactcttcattcctgagctgtttaaatctaaacttttagtcttaagtcacatataaaaatgaaaggattattttaagtagaaataattatggatgcatagttacagattactcccctagaagtctgtattaaatgagtagatcagtaatcaagagctggagccttaggaaagttccttttgttgataatattctgctaattgactaattttactgagtgttcagcatgcttttaatcttaccaaggtggcaacttaggttgttatcccttttgatttgttaaaaaaaaaaaaaaatacactgtttaggcaagaagatcatgaaaaataataaattagtaaaacaatggggtttattacttttgttattggttgtctaactgcagcagtaaatcttgcagatatggtaggaacagtaaaactggtttaaagggttaccagattctgtgatgcgagccaccttttgcccaaagttggtagtgttttcttcaacttaattttcactgcttctcttttctttctccataacaaagatgtgaataaatatctatatccttaacgcaaaaaaagtagtaaattgaccaaacataatatctggataattggaacaaagtgcaaaatgttaatttagatgtgtatatatgtaggcgagtgtatactttgtaaattgtacactagatattaaattttaatttcagttttcaaaagtcagcttattcttagatgaagaaaatctttgatgtgttttactgaaatacttattgtaaaagttattactagggaaatttgataaggatttctattaggtttattaccaagtcatcctgttagtttagtgattaatatactgtatgccaacaaaggtagttgctatattagtatgtttatgactttaatagctgttttgcctctcctccccacctctttttaatttaagctagatatataagcaagaacattacacagttgatgggggataatctgtctttaagaaactgttccatgcaaagaactttgggactttgcgtgagataacatacgtatgcttgttcatctgtatattgatgcagggacatcattgtagttagttaatggtctgctacatcttatttcaacatattgtaatatttcacattaatttgttagtaaacagtatcaaatttgttcaggcagaatttatgagaccaatttttgctgatatttttcaatacatgagagttttaagaatatcctgaagttagatggtcaaataaatttaggaaatgttgagccaatgtgtttgggatattgctatcattgttataataacttaataatctctttaggatatgttgattttacatagcaagtagtcttagtttaacattttcagacctattttctatccttagtactttgtaaacagcttgatgttgtacaggtttctgtttttcacatttgagtaatgtacagacatttcttgtggacttcctttaatattatttaaatgtatagaaacatacttaagtgcaaacttaacgctaaccaaaagacaaatttatactcagttatataacccacaaaattccaattaacatcaatttaataggtgatggatactatttttacataacttgcaggttactttgaggtccctaatccatttagtcttacacagtgcttgatataaagtagctagcttatgaagacaattgtcattaaatatttgtttgtaagatgcacatttttttcactttgagatgccccttataaataaaattgaaagaggattttcaagtgttacacaaataatgttgcattttaaagtagataatcttagattagtgaaatttattgaatgtgtaaaaagctttttatatagttgttataatcagtgctacttctctaaaatttttcctgcatttgtttcttttaatattttttagaaactggccatacctagaagttataacttacactttttattaacaaaatgaaaacctgggagatacagtttttccccagtgttatttaggatgttatgatttaatgtgataaggaatattataatccacttttgtactatgaaaataccagttgggtcaccaaatatgttgtttgctgggtggtacacaaagggctttgggagctcagggtgttgttgggaaatacattgtggttagacagaatctttaaggaagagtgggtgattaaaactgcctcattaaaacctaccaaaggcatcttaaaaattgacctcgtttgttagacttattaaagaattagtagtaaagttaaaaggtggctaggaaggggcagttaacataaattgcacatggaagaaaattggtaccaaaggttcatgtgagacagaaaggacattgtgtgagaaaagaatgatcagggctcaggctggcatgttattatttgtctcttatagtaatgcccaaactgcgctttaaatgatgcagtataggaagtaatgtgcctctaatgttttagaaccatatctttttatagaagtgtcaagatgacattgacttgcattttattctctggcaatattttcttctgttttatttttacaattttggtgaaaggcaatatacattcacatggctcaaaaatacgtatgtttatgtatgtatacacatacaagcatgcatatacacatacattggaacctctcccttcccactctgcacctcaagtaactactgtccatgatgtatgtgtgtctttatgcatatattagtgagtaattacagatctttttacctgtccttttttaatacagggagtagcatattttagacctttccatatcagttcatagggtgccttcatcatatgctaaattgttctatgaattttttgttgggactttttctgttttggtttttacttttctttgcattcttttgtgtttttccttttttcaggtaaattttttataggtgaagtgcacaaatcatatattcagtttagttagattcaacaaatgcatataccagtgttttaagataaagaaatttcaatcatccagaaagttctttcatactctttcctagcggttcttctggaaacaattactgttgtttttcactttgaatttgttctgccacttctagagcttcgtataagtggagtcattcagtgtagatactttagtgttcagcttctcttgatcagaatattcccaagattcatccatgggtcagtaattctttttcaagattgttttgctattcaagatccttagtatttccatatacattttatatcagcttgtcagttgctacaaaaatatttttgctgaaatggtcactgtaatagatataaaacaaataggcaacaatcattagggaattaggtcagatggacatcttaatattgactcatctgtgaatatgctgtatctctatatacttagcttttaaaaaatatctttgagcaaagttgagtttgggcagagttcacagtcacattgttgatgtttttcccttgtgcctctttctttacagggtatcttccttcttttttcaaactctctggcagccccaaatgtgtcctctgattctaggtcagtaaaactgcagttttctaaaaacaacccccctgcagtgttctgtttgaattctagttgccctgcctagctgtggctggggagtgcccttgggtacacagccacagaaatgcagctctcatccagtacagtttgcagctttgacagttggacctcccttcagcttttgtctgtttttgatctgtgtctgctattttcaaatagttgattattttgttcagagtttatcattgttatatgaaggaaagttagcctaattgaggctgctctgccattactggaattagaacctccattctgttttgtgtattcttttactaattgcatactgttttaattattgagaatttattatgtgcttcagaatctggtaggacaggtctttactatttgttagaattttctggtcatacttatttgttttggcttattacagtatttggactaatacctggatttttaaaacatttatttttattgagattgcatcaaatatataaatttggtagagttaatacctctatgatggtatcttcctgtgtagggacgtatgtttttcttttttgctcagtgcacttttgtgttctttagttatgtttaaaatgtttctttgtatagtttgacacagttttaattacatttatctagatgctgcttatacaactctcactatctaagggggattggttctaggatttcccactcataccagaattagtggatgctcaagttctgataaaaaatggcattgtaagcctgggcacgttgacttacttctgtaatcccagcattttgggaggctgaggtgagaggatcacttgagtccaggactcaagagactttgtctctacaaaaagtgttaaaattagccaatcgtggtgacacacgcctatagtcccagctactcaggaggctgaggctggagaactacttgaggctgggaggtcaaggccgcagtaagccttattttaaaaataaaatggcattgtatttgcatataacctatgcacattttctcatactttaaatcggctgttcccaaccgttttggcaccaggagacagagtcatgaaaggcaagttttccactgaccgtggtggtgcggcaatggttttgggataaagacgttccacctcagtcatcaggcattagttagattctcttaaggagtgcccagcctaaagccctcgcatgtgcagttcacaatagggttcttgctcctatgagaatctaatgccactgctgatcttccaggaggcagagctcaggtggtaatggtctctcccctgctgctcaccttctgctgtgtgtcctggttcctaacaggccgtggaccggtatcagtctgtggcctctgagactcctgctttaagtcatctctatattatgcataatatgtaatacattgtaaatgctgtgtaaatagttgttataccatattgtttttaaattttgtatttttcaattgttgtattttttagttttaaaaatttacttattttttctactttttgatccacggttggttgaatccaaggatgtggaacccttggatacagagggctctatgttttattataaattggcttattttaaaaaatattttttattatgtaaacaggcaatgattttactagctagaagcaaatttaatgttttaaaataaaccttccaattttgttaggcatgataatgatggaactgaggcttaaatataccctatggcagcagttggaaagtggccgaattagggttggggtctagatctgtctgcctctagattgattgcaagttcttaacaattactgtttattcttctctgattcctttcaaggattaaataaagtacaatgtaaacttcatgctctattttagattctggttctcatgtgagtcccagaataacttgagtgaaatgttctgatacagagcagaatagcctcttgtgctacacttttgttaattattttcaaagaatagtctcctgtataccatttctttaatagactcagaagtctgtagaattgaggtgattctgttgtgatttaaactacatcatgctatatgtttccaatagatatttgaaaatatcttttaaataaaccattaatgtcatggtttttaaatcagtatatctttggaaaaaagggaaaggtctaagccttaatttacctggctttttctggcttttatagtctggtaaattttgcagcctgaaaaagcaagagaatctataaaatacttgaatgagatgctggaaaatttcagaacaggttttgttttgaactgtcgggtcactgtagcccccaaagcagggcatgatgtgttcctgcagcctgatagctatgtgacagcacctgtagtactaaagccaaggatgccaggtggttctgttgcctggccacaggaagccagcgcttctcaccattgccctttgaactgttgatccagttaagctcactaacaatgtgtaaatatgaaatttaatcaattgcttgattcattttcaaaagatgttttgaaatactcctttatccgcattgaagttttgatgattttgtaatatgtaagaaatggacttttcagaaaagtacaacttagtacttgagacattggctgtcaaagttccattccaaaacttccttttaagctctctttcccttctctcactgaccagaagttactatgaaatgaaataaaggtagggaaaaagggagaattatctctgagctgcccatattctggagagaaatgtgggagaaaatttttaaggtggtatactaaattagaatgacttcaaagtctatttctttatttattctagagatgagaacaaaataattttcagtaaaacttaaaaatatcatgaccagataacctgaaaatcttaactgtggatgcatgtctatttttattgggatttttttctatattaaaaatcagttgacatctgtttttagataattttttaaaaaactggattataaaatgaagcacttagtaaagctgatggcagaggttttagatcttttgaatacaggaaagtggtaagggcattataggtatgattcattgagctagagggcgttggtgttcacattttaaaaacataatcatgacttatctggagtcacatgttccattttattggcttccttcatatagaaaatatagtaaccagcactacatgcctgtgaaaaagtgaagcaattgtatattttctgggtgaaggaagtattctgtacattctccatgttttacatcatggtattttgaataaccatgcttccatgttcacatcaattttttgtttttcaatttatgcacagcacttgctctgaaatttggggactgagtacaccaaatacgatagatcagtgggatacaacaggcctttacagcttctctgaacaaaccaggtgaatattctgccctctgtcgaatcttagagatcttgtgggaggggggtatattttgaaagacctatatggggttgcttagtataattttgcctaggatgtttccttaatgtaaaataaggcatagcatttaaaatatctgcttgccagtataaaaaatatattaaatgtttcagctgatgttttaatcaatgcaattctagtttgaatcttctttaaattactgtatcccctaaagaataataattttgataactatatatttattttagcttgagatcagattataatctgttgttggcctaatttttaagtagatacatgatgagttttgctaaatttcttgttatcagaatctcatctttatactaataaatacatacttaatgaaccccttatatcacaattaacagtaggttaactcatttttatgttactttttttaatcacttcattttcttttttgcgtatatggtatttgttcatttcatctcatcatattcatcaccatccacatttatttgtgaactacataaatatacctcagttctcaaaacagtcacaactgggtaaagagttgcagtagtctgaggaagttactatcacatcattgttggtatttatcattcttcacactagttccttttctgactcttcagtcacctccagaattaatatccttagaagcatctctaaaatgagtttgatttactaaacatagaagttgacaaagtttttcaagtataactgcataaactctcttttttaaaaaatcagtttttcccaagttgttagcctttcattggcatttgagtcatttatgtgacatatttataagaaacatctgctagtgctgctgcatacttttatcagatccattaaatagtacatttttgttcttgattctcactaaaactaactaaatggctgtcattcttttctttatgcttttattgtactaatttagcccatttgactgcacttttttttttttttttttaaagttccctcctttcttttccccttgcttcccaacaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccaggtaggaatattgcaagtttttttcttggttttgaattaaatgcctgaacttcagtatatttaagtactcttgtgacccaggaaaattttagtgtaaattctaataaattaccttaaattgtgcatattatttggtggtaattaaaatttttttatttttaaaaatttttaatgagaaaacatatctgtttcttggaatagcatatgatttggcatgaaagtgcatatccaggaaatcctgtagattggcagtctgctcagcgctatgctgatgtgcttctacatgtccctgctgcagtaacattttcaagcattttgcacttggagtgcttttagaagtactttaatgacatcatttgtatgtacaccgtttagtaaagcttgtaacaagacttttcatttagttagctgtctacctgaaactattaaaaaatatagcagtagctgcgtttttggaaaatttcctatatctgattttacagataaagacaatgttaagttttccaatggggatttatgaacttttatggtaatataatattaccaggatcacattgttcccaaaagtttgagataaattagaacttggaaatttggataatagactacctaagttagagccataatcagatttgtcattttctcagtaactagtatatatcgagtaggtggaccctagctttaaaaattaagctacaacttctcttcttgttgaaaactttaaaaaaggttcccccactcccctttgctctttgccattaacttggatttcttgaactttttcagttttgcctccagtattagtgccccgacacaccgagatcctaacagaacttccgcctctggatgactatactcactccattccagaaaacactaacttcccagcaggaattgagccacagagtaattatattccaggtatttttgccttctgaatctcctaaaacttggatagatacaaattttgttcataagcattcaagttttagtaaattgtggtttcacttttttaaaaatgcttttgagtttttaatagaaaaattggattcgttgggtgattattttgtgaaatgtataagcctagtacattaaacagttttgtttggagaagagttttactttatatttcattttcttttgcagtgactttaatcaaagtactgtgagaagcagaaaagaaaagatcttagtaagtttgtcttagttgttgaagctaagcgagatgcagaatgtaagcaaaacaaatggtgtaggagaaaagtaccccccaaacacatgtaactgaatatccacccaatgatcactttttcttagataacttggtaatatttaacagaaatataacatttctataagaaatataatacttagttctatagacatagcaacacttacatattataacacgaacgtcagaaaacctcctttaattatgtttcgtctgcatctcagtaatttctgatgaaaattgaattcagctacatggttctcaaattttgttctgatgtattatgtgatccagtaatactccacgatatgatatctggccttttcgttttttatggtttcttttttttttttttggagaacaactaatactttgttacttttcttgtatgttttcctttttgtttggttgatttttctccctagcagaaacagcatgatgttaggatgaggattaagctgtagtgtctcgatttctttcttccttttgtaatattcttttattccactcttattttatacactaaaaatatgtaaggaacttaagagcatttacaaaattcttaaaatacagttttagtacatttaaacaattatttctttcatgtatccatcatggaaataatgcttattcattgaagataattttttaaatgtaaggaagaaaaaaaagaaaagataactaagaaagataagttttttttttaaatagctggttttacaaatgggaagtggtttttgattgttttaatgtatatttctttgattactgttttattccagaagaggatttaaagctgctttatgggttgctaggaaatacaaacttactgaagttaagagagggagagggtgggatgtagtatgataacactaggaggagggaaaacccgggactatgaaacagggcaattgctaggtagaaaagggagtggagttgtgtgaacgttggtgtggggaaggggaggcattttaagtcgttagtgtgggaattactgttattcagccagcaatactaaccttaggtataaacatgcagtcttagggacaacacgcatatccagtaattatttggaaggctattcaccagaatgtttagtggctttcacttgtgaagatgtttgggctcatttttcctttcttttttattcctttaattattgagatttgagtattttataaagtagaaaatcagaagtggattatacccatttgcttttctggacagtggggctttatccggtttcaagcaacagcaaaaccaaagggttcacattttattccacttaaaagaaattttaacattttctcaaaaatgctaatagctttattatttattacaataatggaaaaaataaacacagtaagataacgtattttaaggttcagcatttctttctgattagatctttgaaatacaggttaaactcaaaaagcttagcgccgtttaactttattagctttaacttttaaaatatgcataatatgtacccttatttttatgttctttgagtatatgaagataatttattcttagaatttttgttttaaaaatttgggggtactgacacttaaatgaaaagtttgatacttaaagtttgtggttagtttattgaatagatattgtaaaaggttattgaaggagacccttaacctgtatcttctcttcctctttttttttttttttttttttttttgagacggtgttttgctcttgttgcccaggctggagtacaatggtgtgatctcggctcaccgcagcctccacctcctgggttcaaatgattctcctgcctcagcctccctagtaactggaattatagggatgcaccaccatgcccggctaattttgtgtttttagtagagatggggtttctccatgtttgtcaggctggtctcgaactccccacctcaggtgatctgcctgcctcggcctcccaaagtgctgggattacaggcataagccaccgcgcctggcctcgttcttttgataattttaaaattgtttggatatgtgtctttgttatcttgaatcgctcaaaactgttcagtgtaaatgtaaaactgatgaaagtcttctgaacttatttttcctccctggaattacagttgattaaattgtatacatgtttttattttacatgcagtttattcagctattcagatacctttctgaacataagtgttttattcagacaacatgttggaaataatatattagaatcctaatggttattttcagggagcattttacctctttatacagtagtctatatttgaattgaattttctgcttcaaacacttagactttaccagttaggaatccttggagaaacacactttttagatagaattcagcctggaccaatccggaaccatactctaccatattttaccctatagaacttagtgtaagttgtaagcctgtattatttaatacttttataatccaaaatcttgtgtgttttttaattttctaagtactcataaaataacgatgttcattagattaaacaacaacaacaaaaaattgtagttactgatggttttgcagcctactgattcagatctgaggcatttttaaagttacgtttttggctcttgccccagaatatgtacatataggaatgagcaagatacgtacataatgtgtatgtccagagagtaggattttattaaaagtggatgttaaggattcactgcaaaatttggacaagatcctgaattatacaccctcagtatgcaatattactttttataatattatataacattattatttgttatttggagtgattcattggttatctctggtagctgagagaaaaggtagtgagattatgttgcagctgtgcttgatttgttttaaacttttgtagaaacgccacctcctggatatatcagtgaagatggagaaacaagtgaccaacagttgaatcaaagtatggacacaggtaaaaaaaatgtctttgaaaattcctcagttattagatatacatttcttgtattgtttgaaattcacaaaagatgttactcttaaatttagagaagttgagacgcataccaaaaaagatgatcttctatcttgatttaacatatctgaactaccaaagaggtccatgttgtcactgaaaaattataacgtatgctactctgcagaataattgttattttttattagagtaaatgaaaatttgaaaacatgcacatacttttatttctttttaagtatttgcttctgttgaaaattttagtaaccctatgactaagtatctctctgtgataaaaaaccataattactcaaataacagattttcagaggaatttgggggtgaaggatggggatcagcttttcactgcttttttaacctaatagtgagttttgaattatagtagattaatttcttatgcttagctatcaactccaaaaagtgatgaagaaaaaaattaaagctttaaatcacgtcttacgtaataaaatgtataactcagcagaactaataaactaccagtgaaatcactttgatgtcattgtaattgtccagtttgattcattttacctgtctgtatcttaactgttggacaccttaatatcacaacctgacaaattataccatcagtctttctccacatcttaacactaatgcattcttggttatgataatctaaattatttttaagtggattaacattggtgggggagggaggggttacaataattctcttgtttaaatccgtttttttggactcccaggtaaagaagtttctgctgtagctaatcatacatttgggtgtttaggagtaccagataactaagaaaggtagataatctaatgaacgttggaaataacgtgttatacatcttaatgcaaataatatttgactttccacatatgttttactaaaattagatgacactcttcttgaagcaataatattcttttttgcctgtgatggacagctgttactgtgacatttaaaagtgaatgatgggaaaagatactgaacgtcataaaccacagtgagatactacctcacacctactagatgctataatcaaaaaaggacaataacaaatgttggtgaggatgtggagaaattggagtcctcatatatcgctagtaggaatgttaaatggttcaacactttggaaaagtttcctgttcctcaaaaagttaaatacagagttaacatattgtggccagctatgtatccaagtgaactgaaaacatgtctactcaaaaacttgtacatgaccatttatgcaggcattattcttaatattcaaagttagaaacaactcagatgtccatcaaatgatgaatggatgaataaaatgaggtatgtttctgcaatggaattattcaaccatgtaaaggaatgacagtatagcatgacgtgtggcaacatggatggaccttgaaagcagtatgttaagtgaaataagccagaaaaaaaaggctgcagggattctaatttagtgcacagacacctattcagcaatataactgaaacacaggaggagcaataatacaagtattcgttatgtatgataaatgaatcaaagtacaaaagtggagaataagctgaatcagccagctaaaataattgcagtgttggggctaactttgaacccaacctaatatttctgtttcagtggagcagtgttactggctttctgaatgacaggtttaaaaattactgtatggcaatgggaatatgtgattcatgagatgccaacagttagtttggctgccagcctcttacccaatatcagtttctctcttggggccatggcaagaaacaattctgactgatgcagggctccaatttagaacaaagttggccacctctctaactctggttcataccttccagaaggaaggacataattaaattcatctttcataacctgctgttaaaaataatgaattgaaattttttaaaagggcaaccagaggataaattaggcataataagtaagtgtacgaacaagcacttgttacttttttctttttttttttgatttagattttgctggtcaagactttattcttcctttatagtggatattagagatcaggctggacatcgtaagaaatttataagttcgattaacctttgtagtattgtataatcagtcccttttcaagtcatgatttttatgaacatatttgttcaaacaggtatatagagaaatagaatataatagatcataagatgtggatttcataactcacaattcagttttgtatcttctacatacactgtgcttggtccaagatacacaaagagacttaaagggttttttaatctgcctgtgtcccagaagataaaatgaggtgctaacctccaatacctcagaatgtggccttgtttgggagtagcatctttgtaaatgtagttgtttaagatgaagtcatactgaagtacgatgggccctaattctatatgactggtgtctttataagatagggaggaatgtgctatatgaagatggaggcaggtaactggagttagcacctgcaagctgagcaattcctaggattgttgggaaacccaaaagcttaagagaaaggcatggaacagattctccccttgagcctttgagagagcatggctttgctgacaccttgtcttgggacttaggtccttcaaagctctgaaaaaataaatttctgttgttttaagccacccagtttgtggtattttgttagagcaagccctaggaagctaatacagtgagtattaagattttgagagtatcctactaatatgtacacttaattatttgtaagttatatacaggtacttcaagtacatttaaaaatatatacaaaaattagaaattgaaggatgagattaaataaatagaaaatacattttaattttttcttcttgtaaactactagttttttgtactcctagacagttttcccatacactccacttacaagacttactcctcttaactaaatgcatataatcaaaatagcatagtgagactctgagctagactatctgagtttgaaatgttcctcttacatatgctagctaggtaacctagtttttaaatctgtaaaatagggacaataatagcatttaactcatagagtattaataggactgatatttataaggcatctatgtgttctaacctgtaataagcactgtatgaaggtagttaaaatgttaagaggagttaaccattaagaaaaaggaagatagtggattgcacaaagatgtgaaggaaagtgaagaattgagatccagacacagaagcacttgatttttgtggtttaggatcagctctataaaataggaaagtaagatttttgtcaaaaatgaggggtcaggtttgacaacttcaggataatagtcttataacaatgccttttctctgccatgtgttaaacagtttttgatgtagatgtatagcatgtctttcattagataaattttttagtattttatacttttagtgctgttatacgtttttgtttttacattttattttccagttgttcctaggatatgggaaatacttgatttttgtatattcttttctcctgcattcttgttaaattgactttttggttctagaattctgtagattcttgaggttttctgcatacacagccatgtcatctgttgataaggacagtttttttttgtttgattgttttttgagaaggagtttcactcttgttgcccaggctagagtgcaatggcatgatctcagctcactgtaacctgaacctcctgagtagctgggtttacaggcatgcactaccacgcccagcttatttttcgtattttagtagagacggagtttctccacgttggtcaggctggtctcgaactcccaacctcaggtgatccacccgcctcggcctcccaaagtgctgggattacagccgtgagccactgtgcccggctgacagtttttctttttttccccagtcttcatgcttttttctttttctgtcctaactaagacctacaataaactgttgaagctataagaatggacatttttgcattgttctgattataggaagaacacatttcacaattccccctttaagtatgatgttaattgtggatattttggagattgtatctgattgaggaagttctttttcctttttgttcttaatgttctaattgtgttttataaatggctgttgaattttgtcaaattttttttctgcgtttataaagaggatcatatagtttcatggatttgaattgttttatttttgagaatttttccatctatgtttatgagagattggtctgtagggttttttcccttgtaatgtgtttattagttttaatatcataaaatgtgttggaaagggctttctcctgttttctcgaagagtttctttaaggttggcattatttctttcttaaatttttgatagggctgggcatggtagttcttgcctgtaatcctagcattttaggaggccaatgctggagaattgcttgagcacaggaggtcaagaccaacctaggcaacaaagcaagaccccgtctctacaaaaaaaaatttttttttttttaaattagccaggggtagtggcattcacctgtggtcccagctacttaagaggctaaggtgggagggtcacttgagcccaggaggtggaggttgcattgagccatgtttgcgccgctgcactccagcctgggcaacagcgagaccttgtattcaaaacaaagtttgatttttccagagaaaccatctcttgtaggaaaaggttttttaaattgagaattatttacatttttaattttgtgtatgtgtttgataaacttggattttgttagaaatgtgttcatttcatttaagtcataggattgattaattgagacaggatctcacttcgttgcccaggctggagtgcagtggcctggttggctcacggcagcctcaacctcccaggctcaggcaatcttccccactttagcctctcgagaagctgggaccacaggtacatgctactgcacctggctaatttttgtgttttatttagagataggatttcaccaggttgccaaggctggagaatgtattgatataaagttatttctgatatttgttattcctttcatatatgtgagatccattttaaaatttataatgttagtaatttgactttttaattttttattagaatgtcttgtaatggattaatcagtagtctttgttgtctttgtctcttttctgttttgtttgtattcatctttttgtctgcttacttttcatttaatctggtcttttctagcctcctgtggtgtacatttagatcattgatttgtttataatgtacacatttaaagctataaatttccctctaagctttatgttagctctatattacaaattttatgttgtttttaaattatcacttattttctaattcttcttgattcatgagttatttagaagtttgggtttttcttaggagtgtgaggattttctagatacttcatcaatttctaatttaattctgttaacagtccagcatatagtgtgtgtgactttagtccttggaaatttatgaaaattattttatgctataacttgtaacttatcttgataagagttccatatatagttggaaagaatgtatatactatagtgttccaaatgtcatttaggtcagggtggttgatagtgtttacatcttcttaattctttatgattttttaaaatctccttattttgtcagttatgataagtgttaaaattttcagctctgattttagagtcatctgtttgtgcctttagtcctgtcagtttttgcttcgtgtgtctttaacctctgttattagatgatacacatttggaattatacatcttccaaattaatttgccctaattataaaatgcatttcatattaacatcaccatatcttctttcttacctctggttacatgatatatttttaattgtttcagtctatccgaatctttatatttatggtgtgtttcttgtggacagcatatttttggttttatttaatctaacaatttttgtcttttagttggaaaatttagtccgcttatatttagagggattattgatactggctttaggctaccattttgcaattgtttgtctatttgttctctctggtttttatctgtttgttttcctgccttttagactaatcaaataatttttgtttcattctgtttactctcttggccttttaccagtaacacttagtattattttctcagttggcattctcgtgattacattgtacttatgttatacctagaagtttatttaagttgtaatattttacaacgtcatgtaaaatttaagaactttacaccactctagtttcattcatctacttctgttgtttgtactattattgacatgtattttacttaataaaaatatataaaccccaaagttcagtgttattttttgcttttgatatcaagttgatttttaaaggaaattagaagggataaaaagaagtattttatattcacctacatatttaccagtttggctcctttttgctgctttttattcctttactacagacatttctttcagttgttttagcaccattttgcagagacattcctttctccattgatttacattggctcctttgttgaaaatcaagtgataatatgtatgtgaccctgactttgagtctgctcttaatccaattaaatgaatttttcatttcagatcctttattttttagctatataatttccattttaaagtcttcgataatttgtgtccagttaatatgtaacatggcctgcttttgttgactgttttatctcttgattatggggtcatttttttccccctccatctttgaatatctcttgttttttaattggatagtgggtgttgtatatataataatattagagattaaaatagataacactttctttggaaagaccaactcttttctctatttgccaagttgaggagctgatcctttccctgcccttaggatttgagttggaaaggtgataatttggtgctttaatgtcacatcactcaggtttcagggagggtcagttccctaccttatcagaactttcagatacaaatatggcaagactgcatattcttatttctttccagccttgcccaggacttcctatgctaacatgtactcagctaaagacatgtattaaaactgactggtgaagaggagctctgtgcttgcagcttcttcgattcctgtcgtctgtgcatggccattgaaattttagttggcttctcctttggcaagctcagtcctttgtctgtgtcctgacttggcagatgctgtcagtagtgaaagtgattaccactctctgttaactggggaggagctcatccctctctgtaaattagttcctatggacttatttggatctatatctgtgtgataactttaaagaaaaatagaatttttctttgtttatccactgttttcttactgctatttcagaagcaaaggttttccccaatcttctacatactaactataaggggaactctgtaggagtttctaataaaaacaaaagcagccttttttctcattatgaacagaattatgctctcatagaaaaattggaaatatgtaaaacctaagatgctatcgcactggggattaagttttttaaaacaagaaatgaaaaaatgatcattcatgcattatatatttcataagctgaatttgatgattataatgttgtatcactttggcagggaagcttaatctcttatttctaccattattctgtgtcagataaaagttaaacagtgttctacacataagattatgatacagcatttcaaattatacaacaaatggatgttcattataaaaaattagcatagtcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaaaaaattagcatagttaggcaaaataggaaaacttaagcattatatgtaattgcatctagcaaaaaattaaaattttaaaaggttcaacttttaccagaaattaaaaaacaatgctgtaatgaacctcattaaaaaatagctagaaaatgacagagaaattcagtaggatgtcagattctagagttcctgttcttgtttattacactatatgtctggctggttttaggtgacatgggggagaagtgggtgcttttgatacatattgctgaggcttagaatatgactagtgatcatatttgggttaaggttgaagaagcaacccaggatgattcccagttttctggaaggtttgtgaacactttagtctgtattcagtaaattagactttttaaagcatacatttttattgtatatgtttaaggtatataacatgatatttggtgtatgtagtgaaatggttgctgtagtcaactaaatccatcatctcacatagtcacctttttatgtgtgtgataagagcacctaaaattgacttactaaatttccagtatacaacacaatattgtaactgtagtcctcaggttgtacattagatctctgggcatatcttacatatctgcaactttataccctttgacctataatctccctattttccccccaacctgtaatcaccattttattatgtttctatgtatttggcttaaaaaaaaaaaaccccacatatgagattatgccatgtgtctttctatgtccacctaatttccttggcataatgtcttccagattcatccatgccaaaagtggtaggatctccctttttaaggcaggataacattcaattgtgtgtataaccctccatttctttatttattcatctgttgatgggacacttgggttgtcttctgtatctttgctattgtgaataaaagcagcaagagtaaaagcaacgtgccacataacaagggagtcttcattagacaatcagctttttcagcagaaagtttgcaggccaggagagatgggtggtgtatttaaagtgctgaaagaattaaaaaacaaaactgaaattagccgggtgtgttggtacacacctgtggtcccagctactcaggaggccaaggtgagaaaattgcttgagcctaggaggtggaggttgtagtgagccaagattgtgacactgccctccaacctgggtgacagagtgagaccccatctgaaaaaaagaaaaaagtacccctgccaaccaagaatactataaccagtaaagctgtccttcagaaatgaaggagaaataaaaaatttttcagacaaaagctgagggagttcatcagtgctggtgtggtgaggatggggagcaacaggcacactcatttattactggtcagaatgaaaaatggtatagccactttggaagacagtttggtgatttctcacaaaactaactatattcttaccatatggtttagcagtcttgcttctccttggtatttacccaaatgaattgaaaacttaggtctacacaaaaacctgcagattgatgttcatagcagctttatttataatttccaaaacttggaagcaaccaagatgttttaataggtgactagataaataaactgatatatccaattaatgtacaacaggtcctcaagtaataatgtcatttcgttacagtgttgatgattggggaatgttggttttgttgtacaattattttgcttaagtcagtttccaaaaacctatggaagatgttaaatgaagacttactatatatgacattctggagaaggcagaactatggaagcagtagaaagataagtggttactgaggctttgtgggaggtaaagaggactaggtggagcacagggcatttttagggcagtgaaactactctgtttgaaactgtaaatggatacacgtcattatacatttgtcaaaacccagagaatgtataacatagccctaatgtaaattatggactttcagtgataatgatgtatcagtgtaggttcattattataacaaatggaccattgtggtttgcggatgttatagggaatttggggaagcagggcaggggtcatatgggagctttttgtactttctgttcagttttgctgtgatcttgaaactactctaaaaaaaaagtcttttttaaattaaaacaatttaatgtcaccttaaaagatataacagattttttttaaaaaaaaacctgggtgaatatttgcaaatagatgacaagtctaagaactgatttttaagtttaaaaacttacaaatcaagaagaaaaagatagttaatagaattggctaaaagaacagaaatacactgtttacaacaaaaacaagaaattaaaaaattgctccttttaaacctatcatattggcagatgtcaacatgtagtgacacggtgtgaagaaacactagcttataaattcttagtgagatgaaacatttttgagagggtattttggcacttataaaagtttaacacattttatttgacatttgttaatttgtcaaaggtttgacgaatgtatcctacaaatatatgtgaatttgtatgcgaagatacatgcacagggatttctgtagatggtttagctgtaagtagacactgctaattcacactggatctcaaataggatatttataatattctaagtggaagacctgtggtaggtgagactccaatagcagcatttatgtatgaataattcataggctaatcatcagttcgttgcctctggtttttttttttttaaaggcttctattaattgttagcttattttaagtttttaaaatttgtcttttttgtaatctgtaattctaacctgtcacatctgactgaacgcctgttaatttaaatgatcctactggtcatttctaagtatttaatagaggagtaaacagttaaaagatatgaatagttgggcagtttcctccatttctaatagtggctttgtttattttatgttggtttcaggaaacagcagtgaattttagctcattgttccaaatatgttttgacctatcttagttgtacctgttgtgacttgccagcagatttgtgacttgccagcagatttgtgacttgccagcagatttttcaaactgagaaaaaaggaacataacttaattatgttgtggaagaccgtactgtcttctaaaaactaagcatcccttctctgattcatttatttatctaggggctaccatttcacctttattgcctggtattttatgtcatggttataatagtgtgtggtagggaggaggtgtgtaagatggtctgacctatcttactcttttttttttttccctctcgagacagagtcttgctctgtcgcccaggctggagtgcagtgggatgccctcagctcactgcaacctccgcctcctggattcaagcgaggcgacctgcgactccttgactttgacaatcgagtagtactcccggttgaagcccccattcgtataataattacatcacaagacgtcttacactcatgagctgtccccacattaggcttaaaaacagatgcaattcccggacgtctaaaccaaaccactttcactgctacacgaccaggggtatactacggccattcttctgccttagccttccgagtagctgggattacaggtgtatgccaccatgcccgactaagttttgtgttttcagtagagatggggtttcactatgttggccaggctggtctctaactcctgacctcgtgatccacccacctcagtctcccaaagtgctgggattacaggcatgagccaccatgcccagcctgacctatcttattctacaattatgctcttggtatacatttgaagcttgggtcatgctcttttaggtaactgtgcctaaacgtgtagagaatgatgatcataaaagaaaatatattttatatttttaataagattatttaacaatgtttatagcaaatgtgttttaaaattgagttgcatggaactgagcagactagttgcgccatgatttttcatatgttgtctgtggtggttcttattttgtatgtttgtgcccccttattttcttgattagatttagcctgtttacccaaaagaagaaacagatcattttctaagaaagtgtaatttaccagaactgactccagaaaatagagctatctgaacaagtcacccttcatagaataatgtctcgtagtaaaccctagaaagttactaactataatttcacagaagaattctaccaaacttttaaagaatatgctgttataatactatttaaacctttgcagaggataaagctgctagattgtcataacattgaccacagagccttacaaacatagcactcatgtaaatcttcaggcttgtattgcttgagactattgatgcaaaaatcctaaataaatattttattactgttagcctgaaagccaatgccatgcttaatgggaaaatggtagaaacattaccctaaaagtcaagagtaagatatccaccgtcatcactgttttatcccaaagtgtgacgctaacccaaagatgattgataaatcttgtagaagggcttttattttagtgctacatgatcaaaattaggattaagagtcaaaagaccaatgattaaatatttgtagctcataccataagaagacttacatccctaatacacataaagagctttcaaacaatcagtaagaaaatgatcaacatcgcaaaagaaaagaacagactatcacaggaaggaaatataatataaacatgtgtaaagctactcaaaattaaaactgtacttgtgaccatgttttcatctagaagcaataacacctcaagcatccctttactatgttgtgactgggaatgtaaactggtacaaccttgatgaatgataattttacccaaatctatcaaaattgcaaatacacaaacctttcgacctggcagtttcttgaagaatgtatctttcagatgtgattggaagcgtgcaaaacggtcaagattagttattgcaatctcaaagcattggttcttatagcaaaagattgaaaatagcttgaatatccatcaatgtgggatcgcgatgttatgtgactaattgatatgtagatagacaaataaggaaacacattgtgaacaatctgatagaataatatagaagatgaaaaacggttaccacttgtatatgaaaagaaaggacacagaacaaaaatgtatttgcttatgtggttcatagagtattttggaaagatacccaaggaaccgtcaatattagatatctttgggaagatgaactgttgggctagaagccaaaactgttgcaccttttatactggaacccccccttctcttcccccgaccccccacaaattaaactaaatttaagcacttacatattctgaattcttggtatttaaattatctttgtattattgttgataattataaccagataaagctagttttatgattacttgatcagaagttctggaaatacttcatttatttttaaatccttttgttttaggctctccagcagaactatctcctactactctttcccctgttaatcatagcttgggtaagttgcacatatgttcccctcatcatttttatactgtatcacctacttaataataaaaatcatctctaggagttattttttatatatccgagaaagggatcctaatgaatagccaaataattatgtatgtggttaaagtagtgctttttaaaaagaatattgacaccatccctcaaaattattaagtcttttctgctggcacatataagaaataggtataatctatttattattgaaatcatattcctcatagaaaattatataacctgttatggctagatttttatggttatgtttattttatgatgtaattaataaaaggtatgtgtattacatatatacacattgacataaatatgtatacatgtatacgtagtatggggatttatatatattatacataatatatataatatatataatatataatatacataatatatataatatataatatattatacataatatatataatatataatatatattatacataatgtatataatatatatataatatataatatatattatacataatatatataatatatatatagtatataatatatattatacattatatatataatatatatatagtatataatatatattatacataatatatataatatatatataatatataatatatattatacataatatatataatatatatataatatataatatatattatacataatatatattatatatataacatatattatacataatatatattatatatataacatatattatacataatatataatatataatatatattatgtataatatataatatatattatacataatatatataatatattatatatattatacataatatataatatatattatataatatatataatatatattatacatattatgtataatatatataacatatattatacataatatgtatataacatacataatatatattatacataatatatataatatataatatatattatacataatatatataatatataatatataatatatattatacatatatataataatatatatatactatatataatatatatatgagagtgtgcacatatatgtacaaatgtgtatgtgtatggtcccttcataaccatgagttcagcatctgcagattcaaccaactgcagattgaaaataatcgggaaaaaatgaaaataacaatacgacagtaaaaactaatacaaattgtatttatttttatttattttttgagacagagtcttgctctgtcgcccaggctagagtgcagtggcgcaatctcggctcactgcaacctctgcctcctgggttcaagcaattctctgcctcagcctcctgagtagctgggactacaggtgcatgccaccacacccagctaatttttgtatttttagtagagatggggtttcactatgttgcccaggctggtctcaaactcctggcctcaaacgaatcacccaccttgacctcctaaagtgctgggattacaggcgtgagccatcgtgctgggcccaaattttaaaatacagtataacaaatatttgtatagcatttatattattaggtattataagtaatctagagattatttaaagtatacaggatgacgtgaatttaagttacatggaaatactacacccttttatgtcagggacttgaacatctaagggtttttagttagggggagccggtcctagaaccaatcccctgtaaatgccaagggatgactatatatatatatatatatatacatacatttctgtattactattattatttttgccctcattttaccctatttcacaatttctcttcggttgttacatgtttggaatttattctacaaaattgtgaggtttttttcttttgcagtattccttatgatatgttttagtcaaactgcagaagctaaatatatagttttccagtgaaataagtagtcttttgactctatggtctgtttctacttgcatgatctttgtgtgttactgctttctggttcttatgtatgagtgggttttctctttttgtagctagggtatctcaccaagagtttgatgttaaaatagacaaatgtcaaaaatatgtcatattttgtatccttttattattactgtttttctttgtgtggcttttgactcattaatctttgctctggctttatcttaccccactttagcttttttatgtgctttagaaatgcaccaagtatggcaagttgactgactttgcctatgattgttttgtatttgaacaggagctagactaaaactactggtaaaacaaagaatccaacataaagtgatttaatgacatgggagaaatttgaaaaaatctggtatgatctatgaaactggagttttgtgtgaaaaatactgaaaatctggtatcatctgtggaaaccgatacagatactatgtctacttcctgagcttttgccagtgcaggctggcatagagcatgtaaagatgattatattaaatctatttttggcttgaattgttcacgcatttcttccttttattatttttttatttttttctttttcagatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggtatgttttattttccttgttgtgaaaaataaatgctgtatactcataatgtaggcattgcatggtgtgccacatcaagagcttgtgtgcagtaaaaccagctttctctctggtggtttaagtgccgacacatttaagtgcacaggcttcactgcttctaatagatcctggtgatgcttcagctgcaaactcttcaacttttatttggcacccttggtactggaaagttcttcaataaatatgtgttaagataagtttaatttgctgagtctctaccagtcataaaattgccatgttcagatttgggggttaatacttttttataaatcatgtttttttgttttgttttgtttttgttttttttcagtttctttatatagctcccaggttttttccccctttggtgagtttatatattaaatgaaatctgcttgctgttcatctgaaatgagatatctaaaacaagaactgcatttaatatagttcaaaatataattcagggacatctcaaaatgtggtctggggacttctggtagtcccagaaaccctttcagctagtttgtgaggtcaaagctattttcatagtagtactgagatgctgtttgccatttctactctcatactctcatgactgtacagtggagtattccagagcctacatgcatatgattttgcaagagatgaaatgtagatttgataatgagactccaattctgttacactagacatgaatgttgaaatgttgccactctatttttttttttttttttttttgctttggaaatatagttgtttttcatagacaaaaatggtgaaatgttgccactctattttttttttttttgctttggaaatacagttgttttttataaacattgttaatatgtaatggatttgatttttaaatgaattttttaaatctcagtttttatatctaatatggtcattttccataatattcacataaacaaaagctctttggggtcctcagtatttccttaacgatgaagtgaaaaagtgtgagaaccattcataattgaacatcattctcatcaccttaaagtaacttcttttaacagtagtttgcttctgttttttttctaattaaccattacctcctgtgagaagtaatgctggttatcaaagtgtgattttgatactgcaaaatgatagtgactagaagatctattacttggttccaagtggaagttctcaaatcttgcttgatgtataaatttggataatcttattaagatacccagtgtcgctgtaggtgctttaactaaaatagttttttgtttttgtgacttaattggggttctgcaaaaaaatttaatgggttttctctgccttattctcttctccctccaaagttttagattgctgtcgttattggatttttttaaattttttatttctagttttataggtgatattgatcagggaatatagcctgaaaaatctctactttttggacttagtgttttcccaatgaccacgtgcatgactgttttacagatattccatagtcttaacagaaccaccgtaccaggttctgtattaaatctggagtgttagttgtttgattagttttcttttgctgtgtaacaaattaccacaaactcagtggcctaaaacatcagttttttacctcacggtttctgtgggtcaggagtccagacatgggttaggcggtcttttcagggtttaacaaggccaaaattgaggtatcagctggcttgtgttcttatctggagcttgaggtcctcttctaaacccacatggttgtggcagaattcagctcctagatgcctcctgaattccttgtcacatggtgccatccatcttcaaagtcagcaatggagaatgtctcttgtgttgaatacctttcatgctttgaatcacttagcctatgacagtctagtcccttttaaaggattgcctgattaaggttaactgatttgctgccttaattacatctgaaaaaatccttaacagcagcacctagtgtttgattaacagagaatgtatgtgcacctcagggctgagactcttaggtgtcatgttagaactctgcttctcacaattttttttttaattcttatatctcatattattttgcatctgtgatctctcagattctgaaagaagtatattaaaaatctcccagtagaattttttctcacctaatcatgcttatacatctagaggttgggtttccaccataatatatagtttttaaaatggcaaatgactttttgatgtttttacatcttttttcttaacattaagtgggatctctaagaaactacagttgtaatgaagatatatttctccaaacattagtgaattccttcaaaattaactcaatcttttacttatcttaatatatatcatttgtatgaaactattttactatgtgtactttttctacattgtttaaatactttcagtcagtacacatgtattttaaaatcaataaaattattgttagaaaatacttgggagaaatatacagtagtatatttaaagttagacttcagaaagacattatctgtgaaaaagatcctggaaataccttatatcattttagaatttttccaagaaaatgcttccaaagtcacactgaaatagtaaatgttacaaaactaatctcatttgtattttgtttcaggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggtatggattcaataatgtacataaacctatcatgtcaacttgcttagtttttcttgttgctaattttaggaatcagtagatgattgcatgctcatattctaaaacttgtaacccttttaaaattactttttaataatgatactcttttgacaatttcttttaccttttttaatcataggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccggtatgaaatacatatttggttcttaaatttccacagtgtaattatgtttcattgcattcttgcatattctggagttcatttgtatctattttcaatgaggttatagagtcagctgatctttatgtaaaataaagttggaggcctccaaattcaaaactgttgcaaattactgagctgccattatggaagatattaaaacatgcacaggcgtgcattttaacgtaattcagagtgttaaatatcataaaaggggtgtatatgaagggttatgtcagtttatggaaggagagatgtttgcacacggtgctcaaggaaaacttgatggcacatgatctagttgtaaaaggtgcattggatttcaatagtcataaatggggtgggcagagttgggaagtgataatcttgacaatagcatagcaattcagtttggagaatagaaaaataaggctggacaattaaattgagacaaactagatgtaggttaagaggaggaacttcattcagaagtagaaggaatacttgctaatgtgccaggcactgtgctgttttaagtgtagtatctaaaaattattatttctgttgtcaattcattctttgtaaggttgaaatatatgaaattgccatcgttgcaggtaacacatggttcaaactaatacatatttggaaatagacatagaaagctgataatttgcccaaggttacattataagtggttgagatgggactggaagatagttctcctggactctttacctcttttataaggatagtagtaacaattatgtttaagttttacaaaaactaatttgtcatcagtggataagatagtctagattattgatgaattaaacaatagattggatttcacatcaaagagagagaagacttcttgaccatatttaagagtaggaattaagtaaaatacttagtctttcttcaattcgtattgcttactccatatgcctgcttaagaaatattcatgtaatatagtgattgtattcctgcttcttccagcaatttagtcccttccaaatttatttgttttggacttgcttgtctatcttaagttttgtcagaaatctgatttgagattgtgcaatgtgaggtctacttgttgaatacatttaaaaatatatggtatatatttgtatcagagaatgaagacttgtcactatttttttctgagttatattggtagaataattcattttgtgattttgctgtagttctgttttgattattacccttttgagatgttgttacctgttaagaatgctgaatgccgttttttaaaattagacttgacctgagttgatagcaaaattagatttaaattatattgtctaataagatttcaggtcagacttttttttgttcttcagaaggttagaataatgcaaaatatggtaggaatttagtggaagtaagagtgaattacagagagaattccatgtgtatctatagatctgctaagaacagttttacttggtaaagatactgcccttcttcattcactgtggactctgctgttctttaactcacagataaagtaaaatctgtaattacagaagcagtaatatgcagtatgtttttatgagtattgggagtcaggtacatctgactttggaaaatcaagtagtttcctgtaacatttacaaatcaaaatggcaaatatccatctatctgtggatatgtgggtagctaccaggaacttactgtctgtaatcattctggagctgaggaaatagacctaatgtttaggtttctaaaactattttttttaaatttccttaatgtcatcttggttgttagcacaaaaatgaggaaatgtagtaaacaggaaatttagatgtatgaagaatttgtatttaatcgagtggcagccttcttaaacctactccccttgggtgacctggattatggattattctagaaagggaagtgggacaggggagaacagggcagccaggaccattgttaagccatctaccagagtgggtgggtcactagaactgacacccttggggaaactctaggaaacagtaaacagtctacagaattatcctacccaggggaacagaagtgctgggcatgtaaatgtcaatttctgtttccttggttgagggctgctcctggggatgcttctttcctggcacctctagcctttttgggtatatcagagaagttcctgggcacagaaatgcagatacctgcagttggaagttgtctagagcacactgaaaaatccaaagggtacagtggggcactgataccatctgcctcagaaagtgacatccttggaagtacagttttaaattacattgaacatgtgttgcttggagatgaagagttgataatgggcttttctcatatttgaagggctgttagtttgtagaagcaagtggatttattgactttattctgtatagcaaataagatggaactaaaatcagcgcatggaagtgacaggatgtcattgaataatttgtaattctcttagagttgccccttttgttgaagcactattaaaagcccgaatggtgttgctaagagggatgttcattggctttggcagggaaagttgaattccagcttttaacactctctgtggtgtgggtttagcttgggccaaaattttgtttttgctttggtatacttttacttagattctgtttgatatttgagtatctactattctgtggttgatttggtaagtacagttactttatgtcttggtttgcttggacaatcctgattcacgtgtctccttttggcctgatttttttctgccccccaccccgagacagagtctcactctgtcgccaggctagagtgcagtggcatgatctcggctcactgcagcctctgcctcttgggttcaagtgactctcctgtctcagcctcccgagtagctgggactacaggcacacgccaccacgcccagctaatttttatatttttagtagagacggggtttcaccatgttggccaggatggtctcaatctcttgaccttgtgatccgcctgcctcggcctcccaaagtgctgggcttacaggtgtgagccaccacgcctggccctggcctgatattaatagtatctacattctctctcaggtgttccattttggatgatggtgaataataagatcaccttattaattttagtgcgatgagaaaaagatgttcttgtaaatcacttctaaaacaaggtcatcagaagtactttgactttgaggatcaaccattttgcggaataatcgtgtccaaaattatatacacaaccttttaatttctgtaaatttttaatgcagtgtacctaaacatagccattttccctgcctgtggacttgaatttcataatcattttcctgtattcttttaaacagaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccatactgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccagttggtttctctacctcttaaaagcttcccatatatacctttaagatccttctcttttttctttaactactaaataggttcagcatttattcagtgttagataccctcttcgtctgagggtggcgtaggtttatgttgggatataaagtaacacaagacaatcttcactgtacataaaatatgtcttcatgtacagtctttactttaaaagctgaacattccaatttgcgccttccctcccaagcccctgcccaccaagtatctctttagatatctagtctgtggacatgaacaatgaatacttttttcttactctgatcgaaggcattgatacttagacatatcaaacatttcttcctttcatatgctttactttgctaaatctattatattcattgcctgaattttattcttcctttctacctgacaacacacatccaggtggtacttgctggttatcctctttcttgttagccttgttttttgttttttttttttttttttgagagggagtctcgctctgttgcccaacctggagtgcagtggtgcgatcttggttcactgcaagctccgcctcccgggttcacgccatgcttctgcctcagcctcccaagtagctgggactacaggcgcccaccaccacactcggctaattttttgtatttttagtagagacggggtttcaccgtgttggccaggatggtctcgatctcctgacctcgtgatctgtccacctcggcttcccaaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatcaatcattttaattttacaaatggctcaaaaattctgttcagtaaatgtctttgtgactggcaaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggcaaattatctcttggagtggaattcctgtgttttgagccttacaaccaggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaggtatttctggacttcctagccttttagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgtta

SEQ ID NO: 98 - DNA, 129336 bp, Homo sapiens
gcggccgccgcctccgccccgcgttcggggccttcccgaccctgcactgctgccgtccgcccgcccggccgctcttctcttcgccgtgggagccgctccgggcgcagggccgcgcgccgagccccgcaggctgcagcgccgcggcccggcccggcgccccggcaacttcgccgagagttgaggcgaagtttgggcgaccgcggcaggccccggccgagctcccctctgcgcccccggcgtcccgtcgagcccagccccgccgggggcgctcctcgccgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtgggggcccgcccgggggggacccggggtcacgccggcccagccccctggcactgcggggccgacccagtggggctggagatgggaagagggagagagagggagggagtgagactgtgtgggtgcgtgtgtgtgagagtgggagagcgcgggcaggaagggggtggggggaccccaaacaaaaccatctctgatttgcaaagatcagagcccgaggcttccacgcggcactctggcttccacacctcacattccctttccacctccgggaggggagagcgggttgctgcgggactcggccgcccccactccggggagctggggctggaagttgaggcccgctttgttcggctccgcgggccggagcccctcctccgccgccgcctcccgcccccgcggcccgcgctcgtggaggtggtggtgtctttgcgtttcttttcttcagtcgggtctccccactttcctctacaggaatgcggtccgtacagctggggctgtgggtgaggagcgggagcctagtgattgacagattccttcttcgttctttctttgccttcgggattagcatttttatcgagtatttttagactcggttgtgccagtctcccgccccctgagcatgcacgcactttggttgcagtgcaatgctctgacttccaaatgggagagacaagtggcggaaaatagggtcttctcccacctcccacccccccatcccgactcttttgcccttcttttggtccaagagattttgaaaccgtgcagaacgagggagaggggcaggctgcagccgggcagataacaaaacacaccccaaagtgggcctcgcatcggccctcgcattcctgtagagccttccttcccaaagcgcgctgccatctgtctggatctcctttatccttcccgttgcgcgctagctaggtcgggcgggagcccacagatggctgatagaaggggtcagtgacttcactcccccagggccttccttagcttagatgtgcctggctgggaactgggggtgcgggtaccttggcttcctgtctctacctctcagcctcctttgatgctgaaccaagggagagagcgtgtgtgttgggggctggctcttttgggggtcccaggctgccgaggaatgagtagaaagcaccagggactgtcagccgcaaagggattgtcatccctgctcctgggccagggtggactccatccttggccacctgcttggggcagttgtacaggggctgccaggcgagtcaggcaggcacaaagcaacatctgtccacgggaaccgagggcaggcctcccctggaaataaatgccacatatggtgggagtgcggacttaaattttttttaactgggtggatccagtcaataaagggggagggaaggcggtgtgctgtctggggaagtctctgggcgtgtgatcgggagccagaattgacttcagaggaggtggtgtgatgtgatggtcagagagacctgggatttggttccagctctggttgttaattcttctgtattccttccgtgggggtggctagggtagagtgggtgagtatgctacttctctttctggggaggggtctgccaaacctaccttctccttatctgcctgggtgcattgaagacaagtgctttatgtattgaaacagaagaaaaaaagtggtatcaattgtaaaacaggcagctgtgaaaagtgtttcacagtttacaaagcactttcacatggttttctgaggtcctcaaaaaaagacagaaagcaagcaagcaaccagccatggaaagtagataaggttgttaggcttaagattatcacatttttaaagcagaggaaaccttaaaagagagaggtgaaaaggcttgagtcatagacatggggttctgcctgaatgtgctctttctgctgccccatgctgctttatactttgaagatcctgaatacattctttgctgaatgctaaagctgtgttagcttggggagggccctgtggatctttgtatgtgcggttgcttctttaatctttgggctggtgatagcttggcagagaggccttgctttcccttgccttggtaggagtttgtcctctgtggggccatacctttggcctgccttttcctcttccaaagtcctgctgagactttggaagcctaagacgtgtgaacgctttggatgattctgagagttcaagccaacctgccctgtggccttctcgtgactttgttaggactgaggcatcttctgcctgcctggataggactgaatacaaaagtagattttttttttcatcttttttttcagttagggaaacccagttgcttgggtggatccagacaaaatggattttcatccttggattttgtgcccacgcctctgggtcaccttgtgtcccttggcaacagctgctgctgttttggtcgtgggcagaaaactaaaggccacgtcttggggaggtggctggtttggccctgtgctggtgatatcaatgtgtctgctaagccccatagattgcagtgttgcttgtcaaattgtctgctttcaccacaactgccttttagtttggaaagtagagaaaggaaaatgtttaacttagtcattccccctgtgtgtggggggttggtcactgggtgcttaaaaacactctgcaagatctggactccggggtttaaggagccctcagtctaaggagattaagccaagtgtgttttggctaatatataatcatgagcagcaacagcaacatttggcaattagagctgtatactagggacttccagaccacaggcttgcttctctgtgacaccagctctgacttgtttcaattatcaggggagctggcgtgatacacacttatcgacataaagaaggtgaaagagattggtgccaaggaagtggtaagagcttcatttagatacaccaacaaaggggctgtcaggatactctgaggtctggcaggattggcagaatttacacaagttttataacagcctctcatgcctcacctgcttgagtacctgagtaaagctgcaggtatcttccttgccagtttataagaatggaatcaaagcatttgccgctgaatgagagttggtgtgtgagcgttatatgaggaataaggagctcggcacacttaaaacttagttttctggtagacactggtagcttgtacttccaccagggaatccatgccttggcctcgttgttgggagctagaccaagcttaaagcattgcttgtttggaagggaatttgggctttcttgtgtcagagcacccagtccagtggaaaattggagaattgaagcaaacactaggtctgacacacagcatctactccctccctgtgaatctgatgttttttttttggagacagagtcttgccttgttgcccaggctggagcgcagtggcatgatcttagctcactgcaacctctgcctcccggttcaagcgattcttgtgcctcagcctcccgagtagctgggattacaggcgcccgccaccacgcccagctaatttttgtatttttagtagagacggggtttcaccatgttggtcaggctggtgttgaactcctgaccttgtgatctgcccgccttggcctgccaaagtgctgggattacaggcgtgagccaccgcgcctcaccgaatctgatcttttactgtagcctcctcttattatctccttgacttttgccagggtactctcactttgagaaaggaaaaagatcctagtctttaacatgccttttccagatttctggggatagacctattactaaggctgtagaggcctcccttttctcttggctgcacttcagagcaccatgcccgtgtggcccattggaagcaagcccccttccagctgctagggaggtggtccattatctctttgctcttgttaagtttgattaggggagttccacgtagggcctgagaagaggaggtgcctgcaggacaataggtagctgatgagggatctgactcagctgcagctgaacctaggcgccacttgacgttccctgggaacatttagaaccttggaacatgctgcttgcacctgggagtggaatgtttgcagacagcccctctgttgttacagggctggattttgttgatttattgatatttattggaccctcccatgtctgagtcaattttttaggtaccagaggaggatgcagagacacgtttgagaagctcccagcctgtgagaagcttacacatcagtaagggaaacatgaatagggcattatttgagtatctaactgctatctctttctcattcccagctaccagtagaaatatgagatctagtatggatgatttttgatgggggcgggcgttgatgtgccttttaaatattgtagaattcactatgttaggaaataaaataatgacaggcatctgtttttttctgaaaaaaacacaaaattcaggtcctgtacctgccattttaccacctgcaaggatttgggaatccatttaagtttcacagcttttatatctgcacctgtcaagtcaggatgagataagttctgtggaagtgttttgtgaaccagagaatttgacaggtatgttacgtttatacttcattctgcatcattcattcattattgaattattcagtccttcgttgagaacatactacaatgaccacagcagggtccctgtactcaaagagctccctgtctagagcgggagacagacttgcccaaaggtatgaggcatgagctgcagctgaggaatgtgctaagtgcccagcaatgtggaaacacagttaattctgtgggaggaggtgtagagaggaggagaacccatgagaggtggaaaactaagaaggggacaagggttatccaaaggaagctttttggactgcagtatgatgttgggaactttttggtacatggggatagttccctataagaatgaggacgtctttatcctcttttactaaactgagtgctgctataaatatgttaccttgtaactggcactgaacagctagtgacttgggtgctatattttactccactgtaaagcattttctctttgaagtaaaaagtaagttagtactgcaaactgaaattcaggtttccttggtgggaacagggactttagatgtatcagctcagaatatgacagggagtgttaataaaaagtggacaacttggctgggcacggtggctcacacctgtaatcccaagcactttgggaggccgaggcaggcggatcacgaggtcaggagatcacaaccattctggctaacacggtgaaaccctgtctctactaaaaatacaaaaaaattagccgagcttggtggcaggcgcctgtagtcccagctactcgggaggctgaggcaagagaatggcgtgaacccaggaggcggagcttgcagtgagccgagatcgcgccactgcactccagcctgggcgacagagcgagactctgtctcaaaataaataaataaataaatgaaaagtggacaacttgcagatggttgttttgaaattcaaagcttcggtgtgacctagcttctcatttctctagttaacacttgctgagaataaatcctagacgcctgagtttctgaatgaacataggtgcttttagtggtatattttttaaaaagtctttgcaagggtgaagttttaaatgacaattttaataacagaaaaatatgaatacagtcgcatttaattctgatgagaaatgcaagaagttgatgaaattgaaagaatttgtttcaagcttatcacatcaggaatccaactaaatgagttaaaaaataaatattggtttaataatgtaaacatgtgattgctgtattattataatggaataaaattaacacgatttaatgaactgagcgaccattaatttttacttgttaatttattaggagattttaatgccatttgatgcacagtacagccattattctgcgtgagctccttaatgaaataaataagaccaagcagggcttgcttcaaattggaatcagctttcattcctgttaaccttattctcccacctttattcacctctccttcagcttcctgtaattgcaattaagttctctaagattggaatgcagttttcttaatcagcaagtctcatcaatagtcctaattgacttttgcccttttctcctttgccatattgactgattaaaacaaaagcaaaacttaaagactccattccctcccccaaatccccatctcatagtgttggttggctggcaagagaactgcccaagaaggctgctcatgatggcagcctgctgaatgtgcagggggtggaagttcaccagccatgtgcagacgtgaatggctggtgcagtgttggatgggactaactcctccctaaggaggggtatgaccttctgttggcctctgacaagtccctgagccatggagccttcagtcttcccatcttcaagcacaatggttcctggaaacagtgggaagttgccatcctaagcccaccctacagaagtttggtttctaattttactgtgttctaagctttagaaccgagacaattccaagagaacttgtccagttcatttttatgccttcctttaatgccgtaccaggtgctaatttctgtgccagataatgcggacaaaatagtgaataaggcagatactgtccctggtgccttctgtagcttctagtccactggctgtgaaacacaggttctttggagttgtaagaatgctgtatgtgttcactctttagctaatttgtaaatactgtttttttggtgccaaaccacatcccccaagctctgcagtttattgacttgacaaggatctctctctctctttctctttctctctgtataacataatcctttgtttcgacttaacagtttgagaaataaacaaatctatagcatactatccactgttggttatctaagacccttcctataaacagcagcctgccacagtggcaactgctgtagaatgttttggcagagactcagtttaaaatgaaaacacagtagaagcctattaattaagaagtttggctaattctggactaggcaaaagtttgtttagcaggcctttttgccccataaatgctgtcaaagaaaaattaataaacaagagtttggggattattttggaggtaggagtcagcagaccttggtaggttctagacgtggctctgtttctgattagctgtgtgacctgggacaagtcaccttctttgggcctcgaatgttctcaactggaaaataggctagataaactctattggagggcctttctaacttggaattggtattcatacaagcattttattttattttattttattttttgagatggagtttcgctcttgttgcccaggctaaagtgcaatggcgcggtcttgcctcactgcaacctccgcttcccaggttcaagtgattgtcctgcctcagccttctgagtagctgggattacaggcatgtgccaccacacccggctaattttgtatttttatcagagaccagtttcgccatgttggccaggctggtctccaactcctggcctcaagtgatctgcccgcctcggcctcccaaagtgctgggattccaggcctgagccaccgcgcccggccacatacaaacattttaaaagctcccagttgcacgcatctagttgatcagtgaatgacagatctttcttaattattgatgttccaagactctatcagcctggtgtcaattaatttacataagtaaaaataataaaattgtaattcagcctttaattttggtgatttccctccctcttccttgcctcttccttactctgtgagtctaaatcagtgaaatttaactacaaaggaatatgaaaataatgctaggatgaagatgtggaggctgtgcctcttgagatgcagtgaacagtttttcttcttttgttgctatttttgactattctaagaacaggaagtttacttaaactaatgaccacagatgcctaaaaatggttaaatgtaagaggtaggcattatagaggatacctgtggaaaatgtttgctcatatgtcaaagtttacccaggaagcttcctttatttatttccaagcatctatataaagaaaggctgcacttgattgcgtaagcatgagccttttgttaggcagcgtggatgttgcaagtttaaaccccaactaggaaatgaaaagtgagtttcctcctaaatagttctttttcagtatcacatggctctcccagcttacatctggcaagtttttctcttgagtgctttgccggtagtttaggactccagtattgtattgtattgtttgtttgtttctttatctctgtctctctctttttttgttttttgagacggagtcttgctgtgtcgcccaggctggagtgcagtggcgtgatctcagctcactgcaacctccgcctcccaggttcaagcagttctcctgcctcagcctcccatgtagctgggactacaggcgcccgccaccatgcccagctaatttttgtatttttagtagagatggggtaggactccagtattaagaaacactgtgtatggctttgcctttgaaacctacagagttatgaatctggtcccttttgctgctaagtgttgcatcacaaactgccaagccaagttgtaactctgaggtgtcaccattttttttttcttttcaactggacatttgaaaatagtaatgctttttgggtgtgtgttttttaaaggtctgtttttacgctgtcactgctcaaaaatgccaaaaggcattttttccttaaaaaatcacctctgggctaagcccaaatgtggagtaatgaatccagaaaggactttttgagtagttacaagtggctgaaagcaggcactggtgatggaaattgggtttttccttttgcttcaaatcttcctggttgtaaactttttcttacccttattgaagtcagactcaaggtgggtctaatttctcccagcccatgggaaggcagagtgaattactgcttgttgtgccaaccctttacattttgtgtgtggctgtttgtctctacccagacaggttcttcacatattacctggggagcaggagagggggaggacaggaagagcacagttgggcagaaagagcaaagcctctcaagtctgatgggtttgggtttgagtctgacagttattagctatgtggtgaccttgggtactttgcttcaacttattgagccccagtttctgcatctgtaaaatgaggatgaaactacctacttcatagaaatcaacccaagtggccgggcacggtggctcatgcctataatcccagcactttgggaggccaaggtggatggatcacctgaggtcaagagtttgagaccagcctgaccaatatggtgaaacctcggctctactaaaaatataaaaattagccgggcatggtagcgggcgcctgtaatttcagctactcaggaggctgagacaggagaattgcttgaacctgggagccagagcttgccgtgagccaagatcgcaccattgtactccagcctgggcaacagagtgagactctgtctcaaaaaaaaaaaaaatcaacgcaagtgagataagatgtatcaagtactttgccagtatcgatcataatacatagtagatgcttagtaaacgctcatttttcctttccaaggggaaatttggcagatgatgtccgtcgactccaataggtgatccccttcccatcccgacacacttgctcacagagcattctcctttggagagtctcagttgatataggaaaaggatctacttcaacacacacagagaacatacagacatgccacttgttgatgtaaggcttggcaggctattgaaagagaaacaattcatattcttaggcggttctgccctcccccatcaccttctctatcattattcttaaaaatttgtttggtcgactaaaaataatagtactaaaaacaaacttcgatgaatcaggtctcctggggcgggggatgggtaagatcctgaagcagaaacgcagtgactcacgcgcctgtcactgatagctgcccgtaagtgcatggaagtgcatgatgtttattgttgctggtgtttttttgaggcccaagttggaatgcacttccggctccccctcaagtactagcttactggttaggtgggctgttgagtgagaatggtcaggtccagaaactcatggctctgaaatgacccagacgtggtggctatacccttgactgccctcagatacgtgcaagagggagctcacgcttcaagagtcatgctttggccctccacctggctgtgctcctcttactggggcaaggagactgtagggccaagggacaggcccatctagagcaagcacttcctttttccagatcatgctcagaggcctgacccttccagttccctgcatcagtgtcttgagcctgtttccaagtcctgcgtgggcctcttccccaggtctgttttacttgagggcagactgtgttggccatggacagcatgtgtacctgtgggaccaatggctgggcaaggggtgcaggggcatgaaggaattggctagagcttggacttgtggcctggggactctacttgggtgtgcacaaggcctctgaaagttatgggtggtgctaggggtgggctgagatcttgggctgggtctctctgagcttccacattccattgtgaaaccaagaggtcagggaatcctaaactcaaacctggacttattaaagtattggtcaaggcaggatgatagaacgcattctgtgtaaccgtttgttaccttgatttgtctttaaatactacatatggtgtgtaggccttcctctgtatttttgctcttagggcaggcatttctgtatgtatgtatgtatgtacgtatgtatgtatgtatgtatttatttttgtagcatccgctcagttgcgtggccacaactgaatcccagtccaggtggcaccattatatgggtagcattttggagatgttcacaggaattgatttccctcaccctcaacccaggccagagtgaatttaatgcagatgagggagaaggtgctacatattatagctgctcattcaaaaagtggagcagagagctggaccactgaatgtgcctttgtttgctggaaatctttattaagtaccagagatatagagatgaagttgtgtctctgaactgctcagaggcaaaaaagggacaccagtaaccacagttatggtgggcctgtggaagagacactatagtgaaggtcaaacaaaatatttgggagcctagaggaagaacaggtctatttctggaggtatcagaaggcttcacagaggaggcaatactcaattggggccttgaaggatggataggagtgtaggagtggagtgggaggcagcacagagcacagaccagactgcggaagggcctgacatctagggaaggcaagacagtttagggtggccagagtgtggatgagggagtggccagagaggagttggagaaggatgttgtcaagggctttggcttgccaaacttcgtactttgtgtttggaccttgctctgtaagtgtccaggagattttaaagcaggggagtggcacggtgaaagccaccactctatcgtttcttgtttcatttcctcctcttacccagtggctgttaacagcaggttttctgcccgagttatccaggtcagagtcataatcccttacagtaccatgtggacagctttaggctatgtctggagcaggttgaagatagtgttttgttcactgtcaggagagaagacatgttgttcagccaggagggctcagggaccccaggcgttcaggtaattagccagtgagtcatgtcaggcttttgatatggataccttgggaaactaagtggggtgttgctggcctccatgcagatgcctggtctacccaagcacaggcccccaaattagatctcggcctctgctgggtcttccctgtgcctgacacagtgccttcatatggaccgtctctggtcagtgttttcaatttctttgttgatgatcatcaatcaaggccaggctttccaattccagaccacactgcaatcagtggaaactacctaaattcagtactgcagacccatagcaggatgtatgtttattgaaaacagattatattccttaatgagagactaaaacagcatgtttaaatcagtattcttcattccttttatcattgagagattggttattatttacctcgcctttagagggtcagcttggtggtggtggtggtggtttaagttgctgggtttttaaaagattgagtttcatgtccaaggactgattctacttcatgggctgtttttgaaaacattgctagaaacctcttaactgaaggcaagaccaggggcagcctattgctgcggagtgccctgggttcaaatccctgctccccaacttactgcggtggtgactgtggacatgttgtttaacttatttgagcttccttttcctcatcagtaaaatgggaaaaacaatgacctccctcaaggagggatgttattgaagttatttacttaaatcagattagatttattttagattaaaagcttcttgcaagctgtgaaatgttttgcaatgtcacatattattattttttttttttgagacggagtttcgctcttgttgcccaggctggagtgcaaaggcgtgatcttggctcacggcaacctctgcttcccggattcaggctattctcctgcctcagcctcccgagtagctgggattacaggcatgcaccaccatgcctggctaattttgtatttttagtaaagacggggtttttctatgttggtcaggctggtctcgaactcccgacctcaggtgatctgcccgcgtcagcctcccaaattgctgggattgcaggtgtaagccaccgcacctcgccccccgcatattatttctttatggtgtagaactcactaatactgctaaaaaccctttctgacagagatgggagttaaggcttctaagttcacacccagatttccacagagaccttagagacaatcataaatattgcacaaaattatattggaatatgagctcggggcacataggctctggtgccttgtactagaagcttaggtgagctgttactcttggccatgtccaagcatttgactcagaagatggtcgagtcagcagtgttgactgttagcaaatcacctaagcccactcacatggggtgatcctggtacgtgttgcatggactgagtgtcaactgcatgctgagtgtatgccagagggggtgatctccttgatcttatttacttacctacagtactctgggtacttatgtatttatgtttacagaggaggaggctgaagcattgaggggtcagtggcagaacaggaatcttaactctggtctctggttcctagttctctgagctctaccccatagcccctcaagaaaggatggccattgttgtcctcatacaaaaagctatgacactgctatcattattctcatttggtaaatgacagaaacaaggttcagattacttaggtaagttgctttaagtctcaggctaagggctggagctggatttgccactgaagctctacaccttctagaatctagggtgactacataatttatcaaacaaaccaggatgtttccaagagtgaaaaggggcagcattattaattatggccactattaattacggtccttggccataaatcaggaccgtccaggcaaacctgggtaatagtcaccctgcctctggtcttgatacctgaccaaggtaatggagaattggatccgccagctcatgtgctgttgcttaagtggaagggaatgtgcaaattatgtcctgctattctaagtgaaaggacttgcccaaggtcatgcaacaagttggcaatgtaatattttaaaactggacgagatgttgaaaacatggtaaagttagcactagagcttaattaactggagtatgagttagggaacatttggctatgctgatgtctactactgaagggaaaggaggtggaggtcaaggtcaggtgtgtatggagcaggtgggggtggcagtggcagggcattcacgtggctctactatgtcggcaccatcatcaggccctgtccctttgaagtccgggagatgccactaggcccagtgcaacttggatgatatttaatggccaagagcagagacttctgggacctgacttttcctgctctccactttactttagctctgggcttcaaagggactattggctgggagtggtgaaagtttagtggataatcctgctgaagaattttggaaggccttgaggaaggaattaaaaataacagtaagcatgccttttctttctctttgattgtggtcagtgcatggaatgtgccagggccgctgcggagcaagcacgtggccccgaataacccctccctgccaacggaattctgcagagaacatgtaagggctgtgctgtttcactcctgctttgggctctcagggtttgtttccgcgatcatccaaacctcatcctccttctcttgccccagataatttattggaagtctggagagggacttgagttctctcaactctccaaccagactgttgctgtgggcgaggccatgtcgggtgagctccaaggagagcagttggaatgacagagaggaacggtttcagcctgagaaatgtgaaatataaattcaaaccaaacttggcacctgtttggagagcttcagctgatactacagtgcccctgtcgttagcctttgtggctcagctgggtcttataaatagaacacgatgcatttccccttttgctaccccacagacacgcggaggcatgtgtgggggtggcatggacagagagtattcattacttatgctccagtgcatcagatagtcatcgtgggaactgagccctggtgtcatggggatgactaggccatcttgtgggtaaggctggaagcggcttttgagtctcctgagttacagctcttcttacccttgccagcctcccttccccagctgaggccctcagtccttcatgcctgtgtgccgcagtaagccagttggccccttccgtcgtgagtccatcccacattctgtatcggagcccagcattgctgtatcaggatgcttttggccaaaagtgacttgaaacccaacaaatagcttcaatcataagagggcttattacttccactaagaaggctagaagcaggaaagtcaggcatcagaaggtctcaggagccttacatctttcctcctggccatattctcttcaagcttgtctcctgttggtccaagggtggccacaactgttgcagatattaccgtctataaacgttgcatccaagggcagaaaagggctcctattccttgggggtctctttaggaagaaaaccttccccgggagcctcctggtatcttgttggtcagtattgtatcacatgcagtcaatgacagaaataatggaccctcagaagcctctcgaggtcaagggcccaggctattcctttgactcatcagggtgattagtatggaggtaggtgcttagtaaattttatttgggttagtgcaaaagtaatggcagtttttgccattgaaaataatggcaaaaactgccattacttaggcaccaacttactgattaatgtttgttggttgctggtttccttcgctaagtgagactcctgaacacttactgatgatgtcttgctgacttctgaggacatgatggtaagtctgccctcatggagcttgcagtcaggtggagagatagtgctataattgtgtttggagtatctcctgagtagattgtggcagtctggtagctttggaagaggtgttaaattgaggcccaaggagacaaaaggacctgagaaacagagcagggggactgtctgggcctctgaatgccatgcccagggccacacattttgtgatgcaagccaggttgtttcaggtttcaagcagttgcgatttctgtctccacccctccaccagtcttattttcctgttgacaaaatgataacaacttgccctagggtttgaagtgggggcagggcacagcgctgagagcctcctccctcaggggaaattttctaaagtttctcactgtgttctagcttcaaaaccatatgcagtttaattgcatgtttagtatctttgtgcatctctcttgttttgaatctgctggaaactttctctgaaagcatatatataggaagacataaaaattctataaatgtttagtggttaaaaacaaagtcctgtccaaattatataaagttttgccgtcgtcggacggaactttctgcagatagggaatacccttgagtcttcagtcgcaaagagctaatcactaacttcaagtgtgcaagtgccctttcattccaattcagagaaaacagagcctgtcccaaggcctcgtgttttgttttcctattgatctaggagctgggataacttggaaccccagggaacatctcagagttaattagttttttgaggtcttcttgtttttcttgcttgattaaaagagttacagtttttgctctgattgtttaaaaaaagaatctatcactgctactgatccaagaggtgagggttggcatggggtgggcactccagtaaatacgtaagttgtcttcctgccgtcttgtcctggtggagcagagagaggtgcctttgagcatgggcctggaaccaacagctactttcctggaaaattcttcagtttccagaagcagtggccaggtgagccggggcatgaaaccagacgaagttgccgcagtgcgaggctggttctgtttgcctcagttctgaagttaatggtccaagttcaccactcatagagcgtcagcctgttggggagacggaggccctgacggccatgccagggtgcccccaaccctttgtttaaccacggctgtggaccagtggtctcagatgtttaccatcgcctgtttataagagggaagtgtggtcatatttctatctctcttgtgggctgcacggttgccttactggggttcatgtgggaagtggttaccgttaggaggaggatgaaataacagtactcacaaaaaggctttgatccagggatctttttaaatgtcatcttttggccactgtgtttttttatttttattttttgctatctgctttaacttcaacgatgagaaaatcaaaccatatgctggacatcattctgcccagctgggctgagtcagaattgcagttcaaactacttctgctctccctgggtttcgtgtgctttcaatgtggggatatcttccagatctgcagttctccagagctagggacccctcagctccagctgctctctggacaatacctgaacatccctacaatatctgaaattgaatgtttgccatttcttcttctttctcctcacacaacctactctgatgttcatgattactggagcccccaggttctaaaaagtgttgaattagcaagtgaacaaataaaatgagacccaaagaaactgtgatcttagcatcctgttttctgggtgaggttgagggtccttggcctctcttgctggtggagatgggctttatgactttggggaagtcaacttgacttcctgggtgttggtcttctcttctacaaaatgacaagcttgaagggagaatctgaaagaatctgtgtatccgttctcagattttctttttttttctttttttttttttttttttttttgagatggagtctcgctctgtcgcccaggctggagtgcagtgatgcgatctcggctcactgcaagctctgcctccggggttcatgctattctcctgcctcagcctcccgagtagctggcactacaggcgtctgccaccacacctggctaattttttttttttgtatttttagtagagacggggtttctttgtgttagccaggatggtctccatctcctgacctcgtgatctgcctgcctcggcctcccaaagtgctgggattacaggcatgagccaccgtgcctggccagtctcagattttcatgatagccctctgaactctccttggcttcttgcctttggctgttttctcaatgcatatattttcctgggggacaaatctaagttttcatctgatgctctgccttcagaggggaaccattccttaatgacctatttaattgtattatcattgttgtttaattcatcacatatttactgagcttcttttgttggtggtggtgccatcagacacagtggtccaggagctgcaatgcgttgctgatgaggatggtcacacatagctctgccctcatggagcgtcccagggtgaaatgagacctcccctgagaaccgactcccagggtaggggaaatcagtctgcaggcaaagaggaattcaaatttagcctgaagcacaggttttctgtgcttctaggcaccggctgcattccaaccgtagtgccataaaaatacaggaaggaagggaaacgtgttcacaggttggttagagatgtggaaaccaacaatcagctctctcttatccgtaagaaactagaatctactgctggcttcagtccctcagacctgctgctcaacagagtgccctttcaaacctgggttagactctgtgctaatggcttttttcatgaacctcagacagccggaaagtatattctttgaggattatgatcgactaggatgctcgggaatctttaaagagaagcactatcttggctatatttgccctcagttgttttaaggccagtgaggagactgagcatttcagaggtgaagcatttagaggatggcctctgaaagcatacggctcagtaaacaactgacccatcctttgtcaccgtttttgtccagcggctgtcaccataggggctcctctggtgtggaggagagagaattagaggcagcaggcctgggttctaggtctgcctcattgtgaaccagcttcaggaccttgggtgagtcacttttctgccctggcccctggcttcctcttctataaactgaaggtgttggcttagcaggattttaaagtttcttccaccttaaaaactctgattcctgcacttgcattcaaagaaatgactctattactcatttgaatagtttcagaatcactgtatagtcaactctggactagaaatgggggcctgcagttgaggacaggatggaaagaggtttggggttcagggtgggctgtgagggctaggattcttgattcctcatgatttgcaattggttgttggtgttaccatggaaggttctcaaccatggctgcttttaaaaattttgatgctcagaccacccctggagaccagtgaatttcaaatttctacaggccggcctggggaaatccatgttttttaactttcctaggtgattccggtatgtggccgggattgagaatcacagccatagatgcttatgtaaagctgtgttcagtgttacaggcatctgttctgggtggaaagtgatagtggttggtcaaaaaaaaagcgtgcacacacacacacacacacacacacacacacatacacagagaacagctctaggttctggaagtgtgttgatttggtcaccacaagtgctggtggtgagtagttgccctgaggtttggagttccagttccctcctatctctgggtcagtggtttctcaacatctttgaagtagtgaaaccatctgtagttggttatttctgctcagaaactcacagtacaaagtggggggtggtgcaggggggtggagctggaatggattaaacaggcccttacaaatgcccacacttttttcatgaaactaagttagaggccttagccaactccagcataccttagtgtcagttctttggcattgccccggtggattctaggggctgtgaaggctgtaggggtgtgtgttactccctgctgctttggtgagagagtgtccctgtctttggctgagagcatcctgtcctgccacttcatcagcagtagcatctaaacagcccttgaagggaatcagtatctacagcctaagaaatctgatgggacacatctctctgcattaaaatattaacagaaaaggtcaaactgggaaggggcagctaagttggaatatctcattcaggtaaagggatgggcttgtggatccttaattggtgtgaaatgcgccctaggaggggagactatatcagtgctgaaagcccttgagggctttcacagatgaagggggatggtatgagaagctttacaaataacaaggtttgagatgcagttgtagacacatgccagatgtaggttgctattttctcagctcaatgaggaatctgtcaaggcactcttagaaatggaaaatatagttcctgccctcaggaactatagtgtcacgtgatagcagtgaagaccttctatgtcctggccacacagtgaggatcagaagacagagcatggagagtggaatgggacacatggatcaaggaacgtggacctgagcaagcaaaagcaagtcactcgggtcccactatcacattgcatatcttctccttttttttttttttttctgagacggagtttcgctcttgttgcccaggctggagtgcagtggtgcgatctcagctcactacaacctccacctcccaggttcaagcgattctcgtgcctcagactcccaagtagctggtattacaggcgcctgccaccacacctggctaatttttagtagagatggggtttcactatgttggccagattggtcttgaactcctgacttcaggtgatctgcccacctcagcctcccagagtgctggggttacaggcatgagccacagcaccagcctcttctcctttctaacgtgatgtcagtgtctctgggaagcagccttagttggcacctcactggcagcaagaatgacttcatgttcttgctcccatgaaaattctctgctttcaggaatacactttcctctaggttttttctttgtctgcaagtgggggggtgttctttgccagatccctgctttgatgattaccatctgcccacctgagtttcctgcatagtttcagttggaaactcttttctctttggaccctaagataccgtgtaataggattgttcttggtttcagtaggcacctggcaccctctcagctgtggctgcatttcaggtatggatgggagtgattatctgtgcatcagaaaactcaagattgtcatgtgagcaagttgtgtgatcatcagtaaatgcagagctggctttgttaggccctggttgtggccaaggctttcctttcccggcgggtgattattccagatttcatggtcactagctgagtgtaatcaggagcagataagaaagccctgtatagagcaaagtatgcatttcttaaggtggtgggggaggtggcagaggcattatatagacgtgtgtgtttgtgcatgtgtttaaaaaaagacttatattttctgggcagcagaacttaagtttccagtaaacatctcctccctttttactttaccttttaattttgtgtttatggtctctgtgctttgaaattgtttttgctgtgatgccagccctgcctgaaatgggtggagcaagccaagccctttggaagccatggtttagatcagagttcttgtactgacatggcccagctgattgacagctcagatgtgatcactccgtctcaactagaagaataaaaataaaaaccttgagctggagcggagaggggtcacacatttgttagtttatcccctactctcacctttatcgcaggaggagtgataaagtgctgctgtgtgtaattctggtctggggttggttttctgtagtcccaaacctgggactaattctccctggagcccgtggcccagaagatgggtgcacagtagggttacttgatgctaaacggctttcccgatagacttgggatctcactgttcttgtcttagctttacttgttgggttggaggaggtgaggtgggtgggcaggggcctagggaagcccactatagaaacactgggacagagaatccagcccaggctaggtgagagcatctgccagtgtgaaaacacgtggaagcgggggaggcaggcgagaaaagctgtgggagaaaacctcacaaatgcagcaaagctgcccagggcccaagcggtggggcggtagcgagggaaacacagtggtgtttggctgctgcttcacaccacttttaattcagcgctgctaggaaggctatttcagaatgctcccgagtgggagggggcagctgctctagggtgggaaggggatgctaaggccgggtgcggtggctcacgcctgtaatcccagcactttgggagccgaggtgggcgaatcacgaggtcaggagttcgagaccagcccgaccaatatggtgaaaccctgcctctactaaaaatacaaaaatgagccaggtgtggtggcgggtgcctgtagtcccagctactcaggaggctgaggcaggagaatcacttgaacccaggaggcagaggttgcagtgagctgagatcacgccactgcacttgagcctgggcaacagagccagactctgtcttaaaaaaaagggggtgctggagagcatgtggggtggatagggctgactagagacctttgtcagggtgacctttctccagagagcccagtaggctcagaaggaaggtccctcagcaccctggcccacacagttccagggagaccccaaataaagcatttgcacaaacagtcctgagtggagcacacctagccgccttctcttgcaaagtgggcctttaaaaaaggggtgtatggctgcttagttctgaagaggccaggctaggagaccccagagggacacccagaaatcccagatatacctcctccatctgctctgcctgccagatgacccttgctactttactgttttttctttgagcctcttggtgatcttgaatagcagaaaaatgagccaaatttccttcaatctatgccagtcttcgtcctcagcctcccggtggggtgatgagtcacaccagtgggaaagtgcactgtatacttggtcatgtgcagagcaccttcccattggtttatctttacaactgccctgggtggagacatggcaaggtggtcctatccctattttgcaggtgatcaggcacaacttacagttagcgcaggaacagggactgaggccagccctcagttctttgacagagttctttgtctacactgtgttgcctcagaaaaaaatgcccatggggagtgtgtgtgcgtgggcatgtgtgctctcctcgtgtccctcagaaaagaatgaattcttttccaactgatgtcactgggaaagggggacaccactactttcctgcgtactgcactttacagtttacaaagcactttcccacacgtcatttcgtttcatctccctgacagtccctggaagtgggtgctagtctggatgagcaggcgcagacttggagaggctgagggacttggcccagggcatatagctaggaagcggccaggcagtaagtgggtagcaccactgcatgttgggggtggggaagcatgagctggatggagcattcggtggtctaaccagtggccagcagtagtgttggggtttgctgccctcacctctgaagccacacaggctcctgcttcctgaggtcaccctctcctggagggctgcccccgcatgggagtgtggacaagtgtgcacgagggggaggcacacccaggccgagtggaacaccaccctaagggggtggtgacaggtggcactgggagtggctggagtcggggttcaccttactcagggtcagggcttcccattttgcaggactgagaggtggactctgaaggaatgcagtgcttagaatcttggtgcctctcctggggtggtgggaagagcagggagtctcgagtccgattttgccaaaaatcccaactttcctgctgagtagctcatgagacaggcatttcacctctctgaacttcaacttgggggtactcagatttccttcagaggctgtgaaagagtcccctgccacaagttactcctctgttcagaagtgacttgactgatcatctagcccaaccccatcattgacagctgggggaaactgagctcctgagcggggcagtgacttgcgcaagtcatttgttgggaagaatggggcaggatgatgatgatgtccacttcttggggacgatggggcagggtggtaaacacttctcaatgcttgcttatgggctctgatgtgaaccactcactataggctgaatcctggttttccaagtgtttagaggctgagctgttgtcccctgggattttggaaggtagactcacatttcactgaaagccctagatgcttctccttactgcagttcccctccccagcactcccatctccctgttttctggggatttaaatcagctttgacttgggtctgaaagtaacccgtgacagcagtaagcctctcgatctgttgtttgcagtgtttcagctaaaatattataaacagaccaccaaactgtgtttggtccaaggccaagcccctccctccctacttgaacacttgattacctgctgcagggttgcgtcttgagctccgaggaggaaactgtttatttcagggctgttagagtgcagtgcaggaatccaggagaatttattgtattgttaccatctggtttcatggagtctgtttcttttgattttaattgtgccctctggagagaaagatcctcgaaatggtggaaaaagaagataccaccttcctccctgccctgcccatgccctggcacacacattgctatggtgcatggtgggcatggctgaaccaagtccccttattctttgaacatctttgcgtattattcctgctcccccagccgtctccaggccccagtctcctctggagggatttcccagatggcttccaggccagagcctgacaggagagataggacctgcctccacggtaacaaatggctgaaggcggtttggggtgttgccagtagcctgcccttccgcagtggctaaggatccggtgttgcggtgatacatgatgtgacctcttcaaccagtgagtcactcacccccagataaccacccggtactttcaggggaaaccgttgtatcattgtggctgtggccatggtttctccaaaataaggtgtttttagaaatgaaagtacagggattggtttccttagattcattgtcatggattcatagttccccaacctttttcacgtaaagactcacctctgtttcctcttaaattgtacatttggtgtctgttttatatattaataataactgacactcttctaaagttttttggggaaagaaaacataagtttaccaagctctcaattctagaaggtaatagccttctagaattgtccatttgcataagcatttttatgcttattgctgtaatcagtgtgtcagtcaaacgggaaggaggaactacatcaggtatttagcacaaagggaatttaatacgggaccttggttacacaggtgataaagcagctgagaagccacaatgggaaggtgaggtgacccagaacttggaggaagccgctgcctttaggctggagggacaaagggaacaggtggtgttcccagagcccagggttggggtcaccagtgggcctgtctagagcagttgcagctgcttctaaaattgccgacccaaggtagaaaaggagagaggggagaaacactgtggcctctccctccctcctacccactacttgctgtgagagcctcctattatttaaaccctgctggaggcctcctgatctggagcctggaaagtcagggctcagccccagggaggacacagcagagcacaggaagatgagggatggatcagagggcaaactggacttggaccagcacagggtgcaagcctgatgctctaattttatattttatcagcattttcttatatgtggctttcataattacacatattttatcaagtagatgaaccgcatttaaccattccccagctgttaggtgaacactttaaattactataaatcagcagttctcaaagtgtggccctgggccagcagcgtcagcatcaccagggaacttactaggaatgcagagtctcaggccccgcccccaggcctcttggatcagaaaccctgagggcggtcccagcagtctgaattttgtacactctccgagggctgctgatgtgcatttgagcttgacaatcatgattataggcaatgatgcaccgtgtggaagctgggggcaggatactgaggagggtgctgggggtaggagtggtggagggagtttgtccaggggaatgtggtgtagcggaaaaggcacaggactggtagggctgtgcccctttaggcccaagcctgcccttgctcttaacctcttaatgggtttcttctttcttctgttaaacagctaaaaatatcaaatcatggggttgctgtgacggttaaatgtaataacaggcacgatgttccatatatgttgggtcttctggagctttggggaaggaggtgtggcaataacagccagcttctgcatcatggaaaatggcccccatgcccatccctgagttgtgtggtctgaaaatcaatgatgaacacttaggaggcttgtagcctgctttgagtcaacaggaagactggacttgagagtttggaatctatagtctaacttcccttcctcaccctgtctttgtaaatggtgctcatctaaccctacagttactatcttttcactcatgtctagccacttgttagaggggaaggaaccctggtgtcaggacaggactcctggctccctgagcttgctgtgtattccggggcatatccttaacctctctgagatgtacttttcttatctgtaaaacctctatgttgatgcaaatcaggtgcgatgatggacgcaaaaactgccttgaacaccttagcgggcctgtgaatataaagccttcaggatccacacctctgccagggcccacaccagcctcgccacctcggtgagcctctcattccactgccagtgcaggggtgcataatcaggatttgccagtggaggtaggaagggtggctggattgtgactgtcacgctcctggcatcagatgatactggtagcaagctagggtcgtctgtgcactttgctctctctcagtcttcccagcagccctgtcaagcggggagtctagcaagaagtggccaaggcgcagatcatttaagaggaaggatgtgagcaaactggatcccaaggggacagacagaggcccactttgcctcagagtccagagagctgctgctgctaagaagggaaagaggaactgggtcggggtgcctgctgacttgcagcgctgtgttggcatgcgaggtagcactggttgggaggcggttacctgaaggaagcaaaggcagctggtggttcctatcttcttgcctctggcagcacctaaaagaagcctcttgggccaatgagaggatggactgtcccccacctgcagagttctgtgaagtggtgcggacgtctttgttgatctcatttggtgcctccccctgttgatggctgaggaagccaaggctctgagaaggcacatggtttacccgaggggacacaggcaaggaatctgaacccggattgcattttctgttttagggctctttgtgtgaccacggtgcttcccaggcccacacttccagtgttccaggcccttgaccaccaatcctgtggaggggtcctcagggcaggcagtgggaccacctgaggcctgcgtggggtggcctgtggtgtgagggacccaggaagtcagcctgcacctcggcgagtcagaagatgtggccatccaccaaccatcagatgttcccctacgcttagggctgtgaccagaagtggcatcaagatgggaggcgaagcttctgggaccagagaaccagctgctcctgttcatcctgcttttgggtgaatagctgatgctctgggcccctcatcccaccatcccaccccgtggctcctcctgagcagggctgagggcatttacctggctgccttctaaagcagacttggcacgagacaatcttattcaaactctgctcaaaattgctaccctgaggagagggctgtgaccaggcaggacggggtgtgataacatggaacgcagggcctgctggagcaggccctgatgagtgtaaataactgtgttagaggcaggacctgagcttttcactccataaatatatattacttctaatgtggccagggccgagctgaagatcataattatgtgagatctgctttacaggcatttagggaaatgcgtggggctgcactgatgtaggcaaagatgtggccacatacatttaacgtgtctcagaggagcctttgctttaaccctttaatcagacccttccagggtgctcctgacttgatgttccagagcgtttggagtcaagagttgcactcttttttcttgcattaaatgcacttgagttttaacccagtctctgggcggatggcagggctgcatgagggggtctccgtggatgtggataagtccagagaagtcagctgagctgactgggcaggtcttgggtaagtcacgccacttccctgagcctcagtttctccagcagtaaaatgttacctgtctgttagggttgtaagattgagtcaacatatgtacaaggcattgcttagtgtttaccaccttgctgtgagctggtaaatggttggttggtcccttcctctccccttggtgttaagcatatcaaaagatggctgcgtgctcacctcccctgctttactgggtggacaaaggagctgtcacacagtgtggcagccttagaaaggttaaagaaggccagtgaagtcttctggctcatctggtcctgaggtgggtgagcattaaacccagatcctttttgtgtttcagtattggatcctttggccgtcatatctgagacccagggcctcagagtgtggggtcctaacctaatttggctttgggtgaactggccagcaaatggaaggatggctgtggaagtgtgtcttgagcctgtccttacacaggtgtggctgtcatcaaggccatcttcatgggcacgtgacgagtacagtcacatagagttcatgctcaggagggccctatgcttggtttaatgctctgctgtcaccagcttgaaatcctttttttttttgttattgttgcccaagctggagtgcaatggctcaatatcggctctctgtaacctctgcctgcgggttcaagtgattctcctgcttcagcctcccgagtagctgggattacaggcacctgccaccacacccagctaatttttgtatttcttttagtagacgtggggtttcaccatgttggcgaggctggtctcgaactcctgacctcaggtgatccagccttgggctcccaaagtgctgggattacaggtgtaaaccactgcatccggcccatcttgaaattcttaataattttctctttgacctagtgttttggagcatgagcatggatagaggagatgtgggcagcatgtgcccattgagccttctgccccattcacatgtagcatttgagcacagacttctgccggacctacaatgtgggggagttgagtgagagtcaaagtgagtgtgagatgtcacatctgcgactgagtagcaggggccctgacagtcctgatgctttccatctaactggaacttgtcttggttgtagaaagaaggcgatgacattctaagaaacatcaacgaccaaagaaccccatcatatcctttattactcacgtcacttccctgacaccaaccacttatattgaaaatgatgacggaagaagggaaaggaaagatagggcacccatattgccttttcctttcagatcttccttactcctcaggcagcataaagagtgaggtagaatggacacatagcgagaagtgaagtaaaaacgattgagttagctttatggatgtttctctggttctggtacatcacaaaatgcacatccaagtcctaaaatacaattcatgtaatgttggtgattccacatactagttaaaggctttttatatttgcagttaaaactggcatcacacaatataaataggagtggtaaaattcatgctaattcatgtaatttaaaattttaatgttgctttacttagaataatattaaatagcaaattaaaaataccatgacacatcaagagagagactgtggaggaaagagaaaaagctttctattttagtaccatgattgatactttttttttttttgccttttgcacaaagggttccatattttcattttgcactgggccccacaaattatgcagccaaccctgactggcatcctggggctggaggtctcaggctggtcttgcacgtgcagcctctagatccctggtctgctcacattgtctcctgggttgcggagctaagaagcatcatataggcaagtgagcatgtgtgcttgctctgaagattccaagcttccaggtggtggtggctctgttgatagagataaaaagttgaggaatttcagaggctacaaacatactcttgttgaaggtgctttgggggtctcctgagcatttacttttgtgaatttttgggcagcctagtatagaggtgatccagcagtaagctgagagagaggccctagtttgactcttaactcaggcatggtctccttgggtgagtcatttcttcatcaggcagtcctcagtcttttggttgcagtgtagttgttaaaaatgtgggtacttggaggctgaattcttgggtcaaatcttatctccatctctctgtcctttttttgtggttttttttgtttgtttgttttttgtttttgtaggggacaggttcttcctccaccactcaggctggaaggcagtggtatgatattggcacactgcagccttgacctcccagctcaagcgatcttcccacctcagcctcctgagtagcttgggactacaggcacacatctctatgctgggctaattttcatgttttttttgttgttgttttttgttgttgttttttgtagaaacagagtttcactatgttgccccaggctagtctcaaacttgtgagctcaggctatctgcctgcctcagcctcccaaagtgccgggattacaggtgtgagccactgcgcccggccttatctccatctcttaactagttgtttgatgttgggcaggttgttcaagcctcctggagccttggtttacccatctataaaatgggtataatggtaattatcttatagcatggtcatgagcgtgaaatgagagcagggggaggagtaatcattgtgtctggtccatgggactgaatcaatgctagcaatggtcatgatggtgaagaatgaggggaggaggaagaaacaattcctgtgggtgctaggaccaaaagtagtatcctctaggaatcctggccttcaaggtctaacttccaagattctgtgagtacgattctagggagcctctgcctcagacttctaagtagttcttcaggctgtgctctagaagttactggaatgaaagaaaaattgtagtgtttgaaggtcttcaaggatcctggtcctctcacactgtcactcttagtcacatgacctttgactgtccattccctactaagccttggtttacgcatctgtcaaatggagcattcgtgggtgtgcctgccttagaggatgagacccagctgagatgacatatggagaaatcgtttataaacttaagtactggtgttaggaagagctaacacggtgagtcttcagtgtttctttaagtgctgctcactactgtcctgagagactccaagaagcagttactttgtttgggcctcagttcatcatctgtgagatgagaggattgggctttgtgcctaaactgcccccccaccccaccacccaagacagattaaaaaagaaggaaggagggagggagggagggagggagggagagagcgagcgagcaagcaagcaagcaagccagcaggatttggaatcgtcccctaattggaaccacaatcgcaggtttcagggactcaggaaagggtgcagcccagcttgtggttgagaaatgaatgtcagatgttaggaagaaaaaggcctatctcaacatagcaggggtttcttactgcccctgcctcctcagccccggtagcctgtcactccctggcgaacagcttggcagcacagaggcaaaccacagagtacatttgaggcccagatctgcttatttcgagggtggggccgcgtttttctcctgccacagtgagctaattaaagaaaacaagcttcgggagttgggagagaactgtccacaggacacttggggaggcttgctttggttgtggaggcctccacagcccccggaaggcaggtggaagtgggcatggagggtcctacgcatccccagcgggggtctgagggcccactgttgctcagctgggggatttggggacggtgggagggcatacatggatgggagggtggactccgttcctgagggggccagtgtggaggagggtcaggcagcccatggagatgggacagtgttctgaaatgcttcacaaatgtggacttttgccccaaactgtggacagagcgtatgtcctgagcgaggatcaactctgtgagtacccatgataattctcctttctgtggttgccgccctgttgattcatgtgtcagccttagagaaagtggctgtgacttctgcattcctgggaatacactgacatgagaagaagtagccgctcttgttcacagtcacagggctggaaagtgggataaggactaaggacttctgtctctggattcagcatgctgattatggggaaaagcagacatcaattcctcatgtcttgtaagcatcactgtcctccaaagttggagcccagctcagacagctgcatagtattttatagagaaggtgtgttgttgaaatgttgattatgcaaattgaattgtgttttaagactactgggaaaaccatttaaaggaatcctgttgtaagtcattttgaaaaatggagaattacaccacctccccaaggattttctgttttggtaaatttcatgtggcaagattacttgaagaagggttccagtgttttgctagcttataatggttactgcataaggaaggtttactcgccagaggtccgcatacattggagaactgggggaatatgtaatacttgtgcagaaatgttttgattcatgtactcagaagatgggatctggatgacacctccagcctattgattcccaagtaaggtgtgatgacaccaccaccagcgaggtgtgctatgaggaatttttgttgatgatgaaaagtgaatgctaactgattgcacaccacgtgccccataccttacatagattatcttatttaattgttgctaataatagtactacagtctgtgaatgatttacttagcaattaattcaaaagcatattccactctacaatggaatattttttgagccaagaaatgaagtacgtggccgggcgcagtggcttgcgcctgtaatcccagcactttgggagaccaaggtgggtgggtcatttgaggtcaggagttcaagaccatcctgaccaacatggtgaaaccccatctctactaaaaatacaaaattagccgggcatggtgccacatgcctgtaatcccagctacttgggaggctgaggcaggagaattgcttgaacccaggaggcagaggttgcagtgagccgagatcgcacccttgcactccagcctgggcaacaagagcgaaactccatctaaaaaaaaaaaaaaaaaaaaggaatgaagtatgtgccacaacatgggtgaatcttgaaaacattgtgctgagttgaagaattcagacatcaaaagccacatatcacatgattccattcccatgcagtatccccataggcaaattcacagagacagaaagcagattagtagttgccagggatggaggagaggggaatggggagtgactgcttcatggatacagggtttccttgagggatgttctggaacaaaatagttgcggtggttgtacaatattgtgaatgaactcaatgccaccaaattatacacattaaaatggctaacatggtagatttttgctgcatgtattaatatattaatgtattaataaatgtattaattacaatattaatatattgtgatatactgtgatatattgtgataaatatatcaatatattgtgataaacatataaattgattttaatatatattaaaatcaaatgtattcctctaatggtgtccatgtcactgacttagtttctgataggtttgtattgggtaggaaagaaaggaatgggacatttacgtgtacactgaggcagaagaaagaatgggactttccaatccaggctctacctttatgaggaaccagagacccagagagtgctagtgacttgctcaagggcacagagcagcgtaccagagttgagctttggcttctagcctcctcactttctattggggaagtcacagtggaaaagggggttttggctcctttatgtctttgggtatgttctgggtcactgaggatcagctctattccacctggcattttgtgctttccatgggtgctcaggaaactgtctgtctcaccctgaggtgaggctcaggaggctctggggctttgtagtagaaatagaaatatcccaagtcctgggttgtgtccttgtggatgtgtctagaacaattcctgttgtgctactcgctttgggcagttagcgaaagggactaattgtgtgcaaatacatacgtttggtgtttgttgggagacttgccatgtgacactgcttcttcttttcttctctttttgactatgaacacctgacactacaggaaataagaaactttccagtacctaatttatgcttactctactttcaaaccctgttggccccagcacagggtaaatgaaactgtagcttatagtaatatttacgtatgggagtcaatgagctgtttaaatacttggatgtcagaaaaaggtttcaaatttagcaagccccctgactctcccaccctctggcatgtactgggtaggcctgcctgctctctgaggtcgagctcttgtatcctgtcctggtcggtgccagtatagcaatgatgatgacagtgatgatgatgccactggaacaggctgagctgtaattgaattaaatatctgtgtaatccctaggagaagctgaataaggtttgaggatcttggaagttcagttatactctcagtaactgaggtgagatccgtaggcaaggaatgacaagatcgagattgattagctacatgaccttaggaaagtgacctaaaggttgttcacattcagagtcctcatctttgaatgtgaatgatatttctggcctctcctatcttatggagttggtgtaagcatctgcatgagatgatggacgttaaagtgctttgttagctgttgagactcttactgaaatgaaacccaaggatgggtgccactgaaagaaacaagaatgaatgcaaactagtttgtgttgggagttgtacttgacacagctgaatttgcctttgtctttaggagagccttagctgtgggaagcagggcttggaatgcgctgatatttatttcttccatcaaatcggattatgaggcacctgatctgtttaaggctgtgtgagtagaaccaggtcctgccttccggaagttcatggttaaattgtgttttcatgggtcacctggaaggcgagcttgttcagaatgaggataattgacccagtgaatccttcctgcctcgaggcccaccatgttattcagatcagtcttgggggaaatgctgtgaaagtgtgtgtgtgtgtgtgtgtgcggtgtgtgtgtgcatgctcgcgtgcatgagtttgtgttgagagaaagaaaaaagccaggagagtaggatgagtcagatttaaccactgttttttcccttttgaaacttgttatgttcatacacatacagcagtcatgcacttgctcagaaatgtgtgaaaaccacttaaaatgtgtgaaatgcagccctttagaaagtgtgccttccaccacattcttttgagcagtggagtggatttgtgagtgttcatatctgtcctcatctgtgggaattgtatgtccaaggtgctaattcagggccatactgggatgacctgtgtgtatagacttgtcctgggtgagatgggagcaagaccatccaatgtatgatggggaattctgttaaacaggtagaattctgaacctcttggtggtcctggctggtcagttgcagggagtgacgttgaatggactgggaagatctggatataccatgtttctgtaggcatgatacgtggtcccttagcttggtatttaaagttctttggaagtgaccgctttctggatttacctctgtgcagcccctctgctcctcccaggtgaggctcatcatagctcctcttcaatgtgctttgtccacaactgctgccatgttttagctccccattacgtttcctgggatgctctcctagactcctctgtacctttcttctttcaaacccaaaacaggtcccatctccttagtcttaactgtctatgaatggtctgttgcctcacttcccagctctggtatgtagtacgtgctcagtacacatttttgaatgcattaatttggctcttttctgtgaaggcagcttgtctgtgtgtcattcatctgcccaaatttgattgtcaacttcctttgtatggagctgtactgttctttttgttgtttttcttaactccttgcccctgcctcccatcaccccagtggaagagttatagtcaaggtagtgtagtcaaggtcgtgcaaaagctacacacttgaacctgttccgtgtggtttcacacaaggcacatggcctccttgggactcacttcacatcactcgacaaggggatagcaggacccaccttgactgtattgaagactgcatgatgatcaggagagagtgagggatgagaaagagtttggaaaacagcagaacacgatgcaaacatgagttattcatggttttgtgtccaggctaactgtgccctgacattaaggctgggtgggtctggcccagggcttctggggtaggcgctgtgctggtgtgtgctactgacctggagtccaggatccctgagtcccactcaccctccctgggctgcagtttcctcagcccagctaccctttccagctgtgactgctggttgtggagctgaatgtgtgtggggtgtgggcctgtgtgtggactccccacccctgtgcggttttcctaagcacatagcacaacaaggagctggaacagagctgcaacaatgaggagggtttcctccaactgtcagtgcttctggatccaccgtttcggctttgacattaccgtgagtgaccaccctggacctctttctttgtgccaaactcgttgctggattgccataaacacttacttggattgattagagaggctatttgccgtattgaaggtggcagaattatttcaccttttccagaggtgttgacgttcaagggtagttggtggtgactgtacagaagggagacaggaagcctggaggaaggaaaggggtgcgtagccgagaaagtgcacaacgggccctatttttaaaagtgcctgcctctgctggttttgttgtggcagcgctcaaaggcaggaagacagataagatcggatttcaggattttcgtctgccccccatctccgcccccaacttttgacaaccaagaacttttccccaccaggagtgggtatatttcaacttctgtaatccctgcgtctcgcacaatgcttggtattacaaggtgctcactgagtgtttgaatgaatgaatgccttcccagttctcatcacagctatagggtgtcactgtatacatcaagtcatggttagccgcaggtttgatcggggaagagacactaatcaatgtatctgattctagaagaagatggagcttctaggaagggcctgccctcaggctgtcctctgtgttccccggcattctgcattttgcagtcacccctcattatccctgagtccaggaacacctgagattggaaaggattccagccccatagggcctttatcgtggcccccagtaagtgataaatattcgtactaatttggggcagtgtcctttttccagctgttttcccatgagtgccctctgttccgtcaggtggccgaagacggataactttggcaaagggcttggcacaaatggccaagtttacactggatcactatactccgtgttatcttgtttccccgatggtcattgccacacaagaaagtacttcctctgtgggctttgcccaccctcttctcttgacagagacctctgggcctagataaatgtataaactgcattgcaggaatgaagccgtttccattaagaactggggtctatgtcctgggatccagttcttctcccccttttagtactgaaagctgcttcccatctgaaagctgtctggggacagacaccgtgcagctgcgtgcagacttctttcagagtttgatcttgcaggcttcccagtggctctgctcttccttgtctgcttcctgggggtctctcagtatcaaagccacctgtggctccatctcacctccctgaacaggaggcactgtttgtcaggaggccttgccacctttggccctttctttccaaagaaagatccctggcctggagtttttgtctcagctctgttgtgtgaccttaggcaagtcagttgacttctctgagcctcagtttactccttagtaaacaaaaaggttggatgaggcgctctccaaagttcttgccctctgtgtccttcctctgcgttctacagggagggagtagctgcctctgtttggtggtggggactcaggcaggatgggtagggaggggtaggggaacaagatcatggcgcacctccacggccacagtggaaaccttgaaccttgagctgtatgcggtgagtccaggatgctgagaagatgccgggctgttgggtaagcagagcccctacgggaagcaaagagtattattcagccctgtggaatgctgaggcagggctgagcttgggcagggtggctgagagaattgtggctctagctgtgggcagaaattcatggccttgaagaatggctactgtatataccagtgataaatattagtcactctggcagcagaatgagtttcctgtgctgcatttttggcacttccagaaaagggaaagcctttctctctgacagggcacaggagggagaaacaggaatgtgtctcttaccctgatgccctggctggagatcccgtggggttttcaacctgcctgaagcaacgcagggcctgctaatgcctcctgttgccctaggtcaggccagggcccattgttgacatctgtgctgtgctgcctctgaaggtcttgcttgagcatgtcctgaatggaaggcttcatctgcattcattccccggccctccctgccgtctgcacagcctcctccaggcctccccttcccagtgaaaagcaccaccatccagacctcaggaagcaatcattttagcctcttctccttctccctcaccatccaggacatcactgagccctgtcagttctgcccccagaatatctaagttcatccaatgccccatttccactgctgcttcctcacccaaatcaggatgtttctggccccgtctccctcctacctggtctccctgcctgtaccctcctctccactgggcccattctccaccggcagccagcatgatctctaagaaatgtacatctgtcatctgtcatatctgctgaaaattgttcagggcttcctgctgccttgagaatgagggtctgaatcccaaacaagggttcaaatctcaacctctcaggcctaccctgaccttacgtatctttcctcagggcctgtgcacatgctgttccttcttcctggaatgcttgtccccatagttttcagctggcgaatgtgagtcaggtctccccttaaatgtcatctaagagagccctttctaattcctccccttcatcttaactctatccccaatacactctctcacagagactgttcttttccttctgagaccctactccagcttgtagttctaaatctgtgattatgcactgtctgtcttcctcttgaggtcaggggccatttcttttgttctctgctatgctcaggacccagatcaaaggagctcagtaactatttacaggcgtacatcatatgtggaggacacttatgctgtgatggccccacacacagcttcctttggggtctgtcccctgctctccgttacccgcgtggtagccactgagcactggctcttcctggcttcactctctggcatcaaaacttatcagtcctacatctcagtcttttgcaaggtgacacttatctgattacctaattcacacgaaggtgttaatggtggtaatggcatagtatttattaccccaggggacccagaacggtggtatcaaaacatatcattccccagtggtttaaaactctggtagctttccagggagtccaagtggagtccagtctccttagctgagttcacagggccccgtctgcacgacttggcttctgtcggcttccctagccctgacttcccaagccttagtcatcaccctctctcccacccagggctcagcacagtacctggaacagtcaagccctcaataaatgtttactgagtgcattaaaaaaaaaaaaaagattttaatgagtcatgctttaactgaagattttagtgtagtcagtcattgggccttggatgccaaaggaatgacaaatggtgggaatttcaggcacagtgactgtgatagccccaaggaaaccaagagagaagtagctttatctgggtggaggggagtgggcctttcagagcctcgaaatcttcccacctgctgcgccactcccaccacataagcaccccacccttcttcccagggtgagatttctcagctctgctttctggggtgccagacaaggggagagccttgttgccatgccctcctgccctcctgccctcctgatgcagtctgtggtcacctgcaggcagagacagatgaagtccgtcattcggctgcgagtaatttctgatgggagaggggcttcccccggcccttcccgcctctctgagccttgccacggtcacttggtttgcccagcctaagtcactgcctgtcgctgtggttattgcatggacagggcctccctctgtccctccacttcccttccctgccccatactgttgccctcacccaccccaaagcctcacccttcccttccatagggatatggcctgatagaggaggagccatttgattttgactattgttgaaattgagtggggaattttgggtttgttttaggttttggaagggaggattatctgaggcttgaggcttctgtgatactgacatctggtgtggaaagtcatcctccctcacctaggtgactgggcctccaggtcatctccccgagcagcctccctggatctgctctcctctcccccccacccccccaccacctcccgcgctgtgcccagggtgatctttctaaaggacagatcttgcttcagcacctccctggttagaacccttccgtccagtggttcctagtgcttcggggataactcgccttgtcccttggggtctgcacagcgtcctccatctcctctcacttggccttgccctcgggggctccggtaagaagctttccaacctggcagctgcagactctgtgcggttgtattattgctgtaaatgggcagggattacgcatttgtggagtgactgatttcaagtacaactgccaccatgggagaggtctgtgaaaatcactggaattgaaaatgaccatgctttgcccaaaaaggttgagaatccccactctgatgatactagaagcctgcttgcctccccaccctgtgccaagccatttcttgcctccttgctttgcccataccagcctggaatgtcccaagcctattcaacttacttcctccaaaacgtagtcccatcttgatctccaggaagcagccttcagatgccccctcctcctggccactgcaaatgtgtccccccagctgctgagcatgcctaggtctgacacacaccacgatatgttgaaatcattggtttctgggttattcttctcacagtcccaggcagtgagccctcaaggacaggggctccatgggactggtctctgggtcggaggccaggacccaggtcactaagggcatgtcactcatctggaccacagctccctgccttgtggtgtggactctgttctctgcactgggctcgttctaaaacggagcatttggtccttgcagcctgccttgtggtttatgacttagtagattgaaaatgacagttgtgctctattttcatttggaaagaaaaaaaaaagtggaaaaccagagattgcactgatctggaggtagagagaaaactgtggagatcaaagaagatattatgtattatgaatgttacacagatcaaggcatgtttgaaataggcttaattttcctcaagttggcttttgtctcacaattgagttcttgttgacgaagaccagttattattcgtcttcgtgtctctggagtctagcacctagcacggtgcctgataaagcatggtcacttcacaaatacttgtcgaagaatgcatgggatgaatatgcatttgggtatttttaatgcttgatgattagaacattctcatggcttgttaacttgtaagacataattttcattgtaagttctttgtgtgtgcaaatgctttttgtgtggaatgcttgccatgcactgaaaaatgctttgtgatagcagttttgaaaaattgagtcattttgccctgattgaagctgggtgaccttgtgcaagtcactttaaccctctgggacttgtggccctcatctgtaaaatgggtagaaggtcagagtggacctcgtggcctgagaggctagtaccccatgctgcatgtaagtcttacatcctcctctttggtgattggatactgaccctctccccaggggttcctgcacagagctggaattctctctggtgtctttgcattctagtgggtggaatgccttgtttctcagtagcaatgagaaatgttaatgtgaggttatgaaagcaagccaagagccatggaataattaaaacacacacgcacacaaagaaggaaaagcgagagggggaaacacacttaatggacaagggatgagtaaaacccaatggactgagaaaaccccagagctgaacttcacatgaccccgcgtgctgcctgcagttgcgacacccgcgtgccccttacgctccgccggcctctcagtgatgtcagtgggccatgggccccacaggaagcaggggctgccatcagcctggtggagcgtgccagcccgctcctcctccacggcccacttcccacccacccgggtctccagataacatgaagccatagctcccaggctcgtcagcgggggaaaccaactcagtgcttctcagaaaatagaaccccagcccattagtgatgtccacgcaggcaagagatgaccaagaagaatgtttgccttttaggagttctctgcctgaaaccagcaggtttcctttagggatagggtgactgtgcttgctgaacacctctaggtcgtcagtgaatgaaataattcattctgtgcttgagtgtctaagacccagggggtttaggaataattaggatactggctgtacccttggagttctgtgctgcttgggggatacgactcaaactcacagacatctgtggctcaaatcaaggcatatagatgcagtgactcttggaacattcgagggagaatcaccacctctgctggtggaggaaaggccaggaactgcccacctagttttcccatgaccccagcctgtagcgggatatgtcagaagatttggatttagaggaacttgggtttgacaaaatagaagtgtatgtatataaacagagttgggagtgatgggggataggatgctgacagcaccttggtagtccctccccctacgtgacagtattgacttcatagtgttgttgtgaggcttgaagaagatacaagagggaagaggagcgttccttgccgtgcagatgcaaatgctcattgttacttgttctgcctctctgtgtctgtgacatccagccctgtgtgggctaccctggttgcaaagtgggcctcctgccgttgagcagctatggtccagtgggcaggtacaccacagtcatggaagcctagttaaatcattacataatagttagctctgtatgaccaatcttttctttaaagaaattcttccttttggaataatcgtagatacacagaaaaactgtacacagataatacagaaagttccagtgtacccctgacccagatgtccgtaatgttaacatcttgtattaccatggtacacatgtcaaaactcagaaacaacattggtacattactagtaacacaagtccagactttattcagtaaaccttttgaaaaataatagctttattggcatataattcatacaccataaatctgctcttttaagggatatgatttagtggtttttagtgtattaatggagttgtacaaccatcatcactatctaattttagaacattttcaacaccacaaaaagaaacctcatacccattaacagtcacttcctgcccatcccccttagccctggcaacttagtctactttctggttctctggatttgcctcttttggacatttcatgtagatgaaatcatacaatttgtggacttttgtgtttgacttctttcacttaacatattttcagggttcatccatttgtagcatgtgtcagtacttcattcctttttatggccaaatagtattccagtgtatggatataccacattttgtttgtcctttcttcagttgatagacatttgggttgttttcacttcttggctattgtaaataatgctgctacgaatatttgtgtacaagctttttttgtggaaatgtgttttcatttatcttgagtagatacctagaagtagaattatggggtcatttggtagctttgtttacctttttgagaaactgccaaattgttttccaaagtggttgtgtggttgtaccattttacagtctcaccaccaatgtatgagggttccagttctccccatccttgtcaacacttgttattgtctgttttattttagccattctagtggatgtgaggtggtatctcattatagttttgatttgcatttccctattggctaatgatattgatcatctctccttgtgctttttggcatttgtgttttttgtttgtttgtttttgagattgagtcttgctgggatgtccaggctggagtgcaatggtgccatctcggctcactgcagcctctgcttcctgggttcaagtgattctcctgcctcagcctcctgagtcactgggattacgggtgtgtgccaccacacctggctaatttttgtatttttagtagagacagggtttcaccatgatggccaggttggtcttgaactcctgacctcagatgatccacctgcctcagcctcccaaagtgttgggattacgggcatagccaccgcacctggccttccatttgtatatcttgtttggaggaacatctacaaatcctttagccatttctttttttttctttccttttttttttttgagacagagttttgctcttgttgcccaggctggagtgcaatggcgccatctcagctcactgcaacctccgccacctaggttcaagcaattctcctgccttagcctcccaagtagctgggattacaggcgcccgccaccactcctggctaattttttgtatttttttttttttttagtagagatgaggtttcaccgtgttggtcaagctggtcttgaactcctgacctcaggtgatccacacgccttggcctcccaaagtgctgggatgataggcgtgagccaccacacccggctagccatttctaattgggttgtctttctactgttgaattataagagttccttatatattctggatataaattcctttatcagatacatggtttgcaaatattttcttccattttatttctttcaattctgtgggttgttttttcactctcttgatggtgttttttgaagcacaaaagtttttaattctgatgaagctaaatttgttttactttcgtcacttttgctttttgtgttgtatctaagaaactgttgcttaatccagggtcacaaaaatttactcccttgcattcttctaagagttttataattttagctcttatatttaggtctttgatccatcttgacctgatttttgtataagatgtgaggtaggggttcaacttcattcttttgcatgtgaatatccagatgtccatgcactgtttgttgagaagaatgtgctttccccagtgaattgtcttggcacccttgtagaaaatcatttgactgtaaatgtaaaggtttctttttggactcttaagattctcttttattgatccatacatctatcctcatgacagtcttgactactatagctttgtagtattaatcaacttttaaaatatatatatatgtgtatatatatatatatatatttttttgagacagagtcttgctctgtcacccaggctggagtgcagtagtgcgatcttggctcactgcaaactctgcctcccgggttcacgtcattctcctgcctcagcagcctcccgagtagctgggactacaggcgcctgccaccacgcccggccaattttttttttgtatttttagtagagacgaggtttcaccgtgttagccaggatggtctcgatctcttgacctcgtgatccacccatgtgggcctcccaaagtgctgggattacaggcataagccactgcgcccggccttaaaatatatttttcaaaatctacattgttcaaaaaaagaatctgtggtaactctcagaaatccaataattacaatagtaaatacaagtaaagatagacaaggaaattaggggagaagacaagaaaataggaaaataagatgacataagagttaatgttagtacaacaactaatatgttgtaaggtttgtgagattgttggaagtagcctgcacatttggccttgagctttctagcagccaagggtaaaatggaaatgtgactaatgacaagattaacacagatgtctgaaagattgtttaaaaaaatgtccccacctccaatattttcagggactgaaatataagcatatttctcccatagatcctaggaacctgagcttctcacgcacaggatcatttcatttgtgttagttctttccctttagacgaatagctctttgaggacagtaactgtgtcttatttccctcacatctccctgtagtgcttaggacaaagcatgggagatgcttacaaaatcttgattgaattctttttcaaattgggaatgtttattacattctttggcagcatttctgccaccaggttgaggttagttgggaccaatttggcggtggagaagtggcaggggctgccctcctggatgcattttagaagtgttttcttgcatcatgcttcctgagtgctggctaagcagtggaaacattgggcaggtggggttgtgtgcccttgccctgagagatggccgtcactttggagtgaaggtaagcagcattgcttcactcatgtggaacccacccgccttcccacctcctcagcgctggagggtcctctctctcgcccactccctctgacatgcctctgagactgcctgcccgatggaaatatccagcatgtatgagggaggtcctggccaaaactgaacagcttctcatggaattgggcccctcatcacctacggttatgtgtggcgcacagatggccactctgcaaagaggcccacccagatagctccctcaccgggggcaaggaacaagccaccttcaactgattacatgtcatattgggtggacctcttcgtcccacacccaataaagggctttaccatttttcagtagcatcctttcttaagagaaacaaaaaatagatttgaataccagtctttaaaggggtagttgtcattacttcgcagttgacagatggggaaatggaggttcagggtgcgttacctgcctgctctaagtcatatggtgagtgggttgcgaagacctgactccaacccagagaatcttgactttgacttcatcctcccctccttccacctgccagtacccagtctttatctaaatttagggggcttgagaggccattctttctattttgggtaccttcaaacaggtaagcacagttttctttgaagttacctctgcctccatgtgggagagtatcaacaaacagttcccccttccccctccaaaagcactctctgcacagtcacccctaggccaggagcagccttgtaatatgccacacatgttgttactgcctgtggcttttcacacctcctgtctcaaatattggagcttttttggctacagccctgtgatgaaggcagtgtgggtgctgttgaccctatcttacccatatggacactacatcatctagggtcaccctgttggttgggatctggagtaagcccagaggccaggattctgacttctggtccagtgctctgccctaggccttgagcaaatgtgtatcaagttgcactgacaatctttgaattcctggaactcatgccatgagcacttccaggagcaccttagtgcttcattacaaagatgatgagacgtaggaaagtctttttttttttcccacggaagcagaatctcacccacacccgcagattttgttgtgtcccttcagcactgagctgtgttctcagaacagaacaggtagaatagagtcaaaatgcaaacagaatggcctccctccacagtctgctttgatggaaatgtgatgccaagcaaacagaaaagttgttttggctccatctctgaggtcatttagttgctatttccatctactttgaatccacatctgctgtgtgctcagagccgtgctggttgccaaagaatccaacaagaaaaaggcatggccccctttggggcgcttgggtcctctcgcagtgccccaagcccaggtgagagacatgccctctgggccgtgattccctcatcagtaaagcaaggaagataatgtctggttaaccaccctcctggagtcatggcaaggctgatacagattcagtggcattaactcatttgttcattcagcacattttactggcaacttatgctgtgctgggctctggatatagtagtgagcaaagaggaagcactcacaagggtaacactgcaaatgctaggagtcatgcatgagaagtccagggagcctgattccatttgagcaaggggtggtggtctgggaaggttcccccaaggaaaagacataggagccaagaccaaagggtgggtaggagtaatcagaagagcatgtctctcatctctggacttctgtagagagacttctgtaaccactgtaccctctggaagtgggtacagaagtccagagatgagagagatgtttaacaacagagagaaatccacccgaaggactttttacatctctctaacatctcctgttcagtttatctcagctggcctttgctgagcaccagttagttgccttgtgcatccttgggtgatggattatggagatggcagtggttgacactgtctgagagcagctcccagataaaccagcgcactgtggttgatgggctgcctccaggtagagagtgaggccctccaagcacatcctggccatccacatcttcacatttgcagtgcctagcacacagtggacaaaagggatatactggacacgttgtcctaggatgcagattcctaccaggccttcaaggcttgtagaaatcttccctaaaactgatcatgtggcctccggtaaggaatctaagcttttgaatcttggatccatctcgggcacagggataacggtggcgcccatctcacggggtgtgtggacgttgtctcaataatgactgacgtgctgagcaagtacctggctggagaagcgtgtggtaaaggggagcagctgtgattattatgggtatcattcctagtggttctgcaattagtcttgacagtaagtgctgcaggacttcagacaaggagaggctacaggtgtggaagtgctcctcaaagcctgtgggacctaaatgggcacagtgaaggagagtcttaggtggaagcaagaaaactgagcatcaggaagggagcaagacccttggtgatgggggtatctgttctgcatggaggatagatgacttctcagccattgggaaaccagctaaccagctttctgcttgatggttgtagtaaaatcccatgattagtgacaatggcatgccaggtttgaagagcaaaggtcaggaggtgagaaagcagataaatgcaatgtttatcttgaaagaagttgtcaactacttggaaatccccaagcttacttcctccaggaagccattctggactacttcacccagttctcatagctcccgggccctccatcttcccagcactgaaacacacactgaaaagggcatttttctaaatatgtctctgcctccccttgtggagggatgtggctccttgagatctggggtcacggctggcgtgtttcgtggagtagctagaaagagtaataatcctttttgaatgcacagcatttacagaggcctcacaggctgaaaatggtaattaggatacacaattgggtcttttgacctcaaatccaggcattttcccaccttgtgggcctcactcaaatgatgaccccaggttctgcctgtgatgaatgagcaggcatggttttgttctgttaggatatgacggtagaagagagctgtttgtcagaaccagcagtggcttcagatcttgaaagtccaactccttcattttacagaggaggaaacctgtgccccaaagcaggtccccccaagttccagcccagtgccaccccactgcacagagcagctgtctccttttgatcatgaggaagccaccaggtccctggtggagttcagcagatgtgccgggtgggcgactctggtgggtgtgaggatgtttcctttcctgctgggaagtcctccaagctcttgtgaaagagatgtggtttgtcgagcatggattttcaaactttctttatagagagctgttgttagcttaaaaatgcctggaaacatgatcaagtgtaatgttttaatgataacatagaagcacatagtactaagcacatgtaatgagaatgtacagaactctctagtaagagtctgaaatttggccgggtgcagtggctcatgcctgtaatcccagcactttgggaggccgaggcgggtggatcacctgaggtcaggagttcaagaccagcctggccaacgtggcaaaaccccgtctctgcccaaaatacaaaaattagccgggcgtggtgacgggtgcctgtaatcccagctactcaggaggctaagacaggagaattgcttgaaccttggaggtggaggttgcagtgggctgagatcgcaccgttgcattccagcctgggcaacagagtgagacaatgtctcaaaaaataaaaaagagagagtctgaaattcattctttcaacatgcttgtgttgggtgctgcctggcacagcaattggtgcccactaactcacagcgtcggggaagataggcacggaacaagtcatctggtgtggtccctgcagtgggggagcccagtgagggcctgtccagcccagctgagaggagactgagagaaggctaggtggcataagtaaagatatggatagcgctttcctcttcagagtgtttattaccagggttagataaagcagatctcatgtattttctgctactaagtagaagttcttgttttgtttgatttctggtgggctttgatattttccaaaaagataataactcattgtagagtaagatcaggactggggccagcagacttgggtccaaaggtgtgtcatttttataccagactagaatcgggtgaggggagatgtaaagagatcactattgtcacggaaggcgctggaaggagctctgcttagaaaaaatgcctttctctaggaggttttcatccagcatgggaacacaaaacaccagtttaaaatagctaggtaaggcttcacagtctctcaatgtgatgtgggtgtcctgagtcgtgaacatcccattgtgcaggataaaatgctggtttctgagctgtctttcaagacacaacccaaatgctgtctttgccatggtgccttccttgggaacccaagccaggtgaggtctgccttttctctgatgttgcctaacttttcctctttgtgtcccttgagctcagggacatgcatcccctgttgtacctagcacagaatcatgcacaagcaggtgcttgttaactgttggtgtgtaccaacaaacatttacggagcacctattagcaggagcacaggccaaggagctggatagatgagcgtggagtttgggggagaggtctgagctgagatatacatttgtgagtcatcattgtatggatgaggccgggctggggaggatatgagcgtagaatgagaaggtccagacctgcacctgaagaacagccccatttagggaatgcagggagagacagaggaaaagcaagatggtgcacagtgacattgaaggtgagtgacgagaccctgcagcaagaggaaaggagcagcagtgctagatgttgcagagaacccagaatggtaaggcctgaaaaccatgtgttttagattctgtaacctggaggccactaggtgaccttagcaagggcagtcatgatggagtgttggggctgaagcccattgcagggaggcccatagtcaatgggaggtgggcagtagacacagagagctgggttattcttgccacacagctgtgctggggccatggcgggggtgggggtgccacagagtgggagccagagagggacctgggtaagggctgaccgtgggtggggagcgcatggagtgctttcagaggccaagtgagtggaactgtctatgaagcagatggatggaaccctggctgaattatctcagacttgccaaagacattcataaaattcagacccgcacacactcgggaatgggaaaaatgaattattttgtaagaagcttatagtccaaaggtagaattgcccaagagagcttctgaaaggaaaaagtcatagcaagttgatatttttaaagtgaaataacataggttggatttttctagtaacttcaaggggtaaagactttgaattttttttttggagacagagtctcgctttgtcacccaagctggagtgcagtggtgcgatcacagctcactgcagccttgacctcccaggctcaagcaatcctcctgcctcagcccctcaggtagctgggattataggcacacgctaccacgcctggctattttttgtatattttgtggaggtggggtttcaccgtgttgcccaggctggtctcaaactcctgagctcaagcgatctgcccaccttggcctcccaaagtgctgggattaaaggcgtgagccactgtccctggccaagactctgggtttagtaagcctcttgcaactcactaggagtggatttctaggacctccccactttcttgcttgttgtttcttttgctagccgtaagtccctggagtacactgggtactttatgggaaaaagaggaacagtgtgggacagactttgccctgggctgcttaacgtgatgtggggaacagaggtgataagagcctgtggcagctcaggcagccctgccatgacctggagttggggaggggtatcaaggataacaagtcttatacacatgccatgctgtttctttggatcaatagatggataatttttaaaaccccctgtatgtatcaaactcactttggagatgtaaggcatggcctctgtcctggtgacagtatctgagtgggaggcctggtaaaatgtctgtgtttaggatgatgaacgccataatctaagactgctaagtgctgtggggtggtctagaagggcagatgggctagctgcgaggagggcagaggcactgtgcaatggtgttgcctgggaacactccgtggagagtgtgggaatctcaccctggccctaccaggtaagaaattgggcctgggaaattgggaagggaatttttcaagcttcatggctgctccaggacttgaactaagactttcctttagagcaagcttgtccaccctctggcccgtgggccgcatgtagcccaggagagctttgaatgcagcccaacacaaattcataaactttctgaaaacattgtaagattttttttttgcgattattttttagctcatcagctatcgttagttagcgtattttatgtgtggcccaagatgacgactcttccatcgtggcccagggaagccaaaacaccggacacccctgcttagagaaagtgcgttttctgttataaaaggaccttgaatccccatctcatatgttgggactttgtcttgcatgttttcaggcagggcatgattgtatctgtaacataataatatgtaagaatgtgtacttcttagcctttgcagagaggcgggaggcctgtttcctgcagcccccgccctgtcctggctgaggggtgggaggcagcttgctggccagccccgctgagtcaccctccggcgtggagcccagtggggatttccacgcggccccagtgttctcttctcctcgtttcctgttgggctgtgacgcaggctggctgccagcgggtgccggtgggcactcctgacacaggccactgccagccggccttgtgggtcctgagggcatcgtgggtggctctccccccacgagtgactgtgcctggcagggtgtgccccacatgtcagttgcactccgttctgggtgggcagctcccagaggccccggggagggctgcagatgggcggggggtggctgcctgggaggacgggaggttttgttgaagagagagcttgctcttggggcagtttgtactgggcgtttagggttataaaaacctagatttgctgaaaacggctctcttttatcttctgacaagaacatttgtgaagaaaacaaaacagaccttcagccatttagtctatacaccgagagaatggtttctacagtatgcctgatttctctgggtctttctaacacatccatgtatgtgcttgtcagcttctagtgcctccatttcttgatatgaggaaattttgcttaaaaaaaaatctctactgataggacctctgcatattcatgcatgtttttcctccagaactttgtgtcccaccactgtgctaggcagtttacaaatgccatctgatttcattcctgccactacagtctaaggctatattgtccgatacctatccaccaccctcatgtggctatttaaatgttgggtcattaaaattaaatacaattacaaatgctgtccctcagtcacaccagccgcatttcaagtgcacgggtaggctagtggccatcagatcagctcatatagagcagcacgttttcatcaccaccaaaaattctattgggtagcactggtctaaggtccggacatatgtccccattttgtagatgaggaagctgagtcctacagaggttaagttgaccacttagaagaatgaacagatgaaaccttttcattttacacatgaggaaactgaaggttatactcccctttccttcttagaaaagagaaattgatctgtaggcttcagggactcttcagttagcctgggggtactgtgcgggtcagctcttttgctgttccccccagaccctgtcagctgtgggtggtggctggtttctcttggtttcctcaccagagtttgggaatgagcaagtcaggactgctttccgtacggtaatcctttggcccatttcctatcgggggatttatggagctggtgatctcttgggttttttggccatttgttagagccaaaagaggtcacaggaaatgatatactagtttcattgcccaaaatactgaggtccagagaggtgaggggatgctgagggtcttgcatctagctaagagctgagctggctcttaaacttgttttcaagccaggacttacctgactttcttaggaaagtaatcactccatagacaaggataggtttttttcacagagcaatgatgttccctgtggtccctatgtagggtggtaaggaatagggctttgggatcctacagaccagggttcaaatcctggccccaccacttgtaagttatgggacttcagacaaggacttaaacattctaagtcctcagtttcttcatctgtaaaacagggataaaatatctcagtgaatttgttttaaatacttgcgtccgggcatggtggctcatgcctgtaatcccagtactttgggaggctgaggtgggaggatcgcttgaggccagaagtttgagaccagactggccagcataacaagaacataacaagatctcatctctacaaaaaattaaaaatattagctgggcatggtggtgtgagcctgtggtctcagctactcgggaggctgcagtgtaaggttgcttgagccaggagttaaagtctgcagtgaactcgccactgtactctagcctgggcaacagagtgagaccctgtctcaaaaaaaaaaaaaaaaaaaaaaatcagccaggcgcagtggctcacacctgtaatcccagcactttgggaggccgaggcgggtggatcacctgaggtcaggagtttgagaccagcctagctaaaacatggtgaaattccgtttctactgaaaatacaaaaaattagtcaggtgtggtggcacacgcccgtaatcccagctactcgggaggctaaggcaggagaatcgcttgaacccaggaggaggagtttgcagtgagccaagattgtgccatcgcactccagcttgggcaacaagagcaaaactccgtctcaaaaaaaaggaaaaaagaattctaacatgtttgagattgactgcaattcctagcatattacaagtgttagtaaatagtagccattaatattatgagcttatcatcaccttcagccagcattctaattttacagtatagaatccagtacataggaggcactcagatagacgggatgccccaaaattgggagacggacaaacttattttgaaatagtctttttttgacatttccaaagaatatactcaatgtttttctgcaaccctttgccttctttttaggtgaaggacctctacatttaaagcagtgggttcaactgctaacctgaaaagctataataaaacatcccagagtatccaaaaagcctggaaacaaagggaaaatagtgtgtcctgctttccaactttcggatatgctgtagaatagactgaaacaaatcactggaaaataggttgttgtcgattttatttagaagcttttgttcctttggattttcgtctcttatttttagacagagtctccctctgtcacccaggctggagtgccgtggtgcaatgatagcttactgcagcctcaaactcctgggctcaaatgatcctctagccttgacctcctgattagctgggactacagaagcaggccaccacgtctggctaatttttgtatttttctgttgagaagaggtcttgctatcatgggcaggctggtcttgaactcctggcctcaagtgatcctcccgcctcagcttcctgaagtggtaagattacaggcatatgccaccacacccagcttttttgttcctttgaaagaaggcattgctaatgattgccctgaggtgtctagatgacccggccagccatccacctctgcagtttacacagcttgttgatctccacagtgagaattaacttcacaacctgggtccaagaggctggaggattgtcagtctttagaaaaaaaaaaatctattatctttagagaagatggacttgttgaggaagaagagtagacaaatactttctggaaatattttcaaagggaattagaaaaagaaaaagattttggttgtcctttggtgaatgagaatattcatcagcagaatgcctcattaccacgtcacacagctgaccaaggcctcatctgagactgtgtttgaatagaaattaaacagggctgacagtgaagtttctgcttttaattagctttcaaaggtacacctctacctgtgatgttgaaacatcttgaaaaacctctctgctctgtgcctgaatgaggggcatctagagggcttggaagagaagatgtggcacagggcagccggggagaggctggtggccagaagatggacctgagcttggtgaatttacctggcatctgagcctggcctgaacaattcagaaacctcatttcatcagtcttggagtcagggctcctgtctcttagcaaaaagctaaagcatacatcaagcatatttattgacaagcgtaaccactgtgaggttataaccagggtgctctgtctgcttatgggcaccccacccgaccagccaaatggtcagagagctgggtgggtcggggaaagggagggagggagtcatgggaagcagttgtgttgaatggctacaggccctggtggctgggtgcatccccgtatgccatccaggcccacccactgctgggccggaccttcccctctggacagttcttgcttgggcactgactgggtttgctgctgaacctcctggcctggcagctctggttgctgatccacccgcttctttctttatagagattaagagcggctccagtgtgtgtacggagagcctctttgaagcgctgttgcctttctgtggctagatccacgatcttctctctgggatcaccccataggacatttgctttccaccttctccagtcccagtgaatgcatggacctctgtcctcattgttactggctgagccagatgtcagtcctgtgacctggcctcaggaccactcttgtagcccaccgtgggtggatgaagccggtgggaacagaatgataggagttaaccactttttaggcgttattgggccttttcactttaatagcttaacagagacatctgtgatggcttgcatccagagtgcgtggtgtttatttttgatttgaaatatgaaaagcatttttttaagacaactgactcctctgagtcatgcccaggggagcaaacggcctgaaatatgagcttgtgcttgctggaggaggatgacagaggagcctgctgctgagttcactggtgctggggttaggtcactgctgggctgaagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacgtttgagtaagagttatcttatttggcagggtgggttaggtgtggggtatttgtcactgagaagcagaaactgtatgctcgacacacactccctgagtccttagggaattgcgtagtttttttcttttcttttctgggttcatcttaccagcagtcgtgtttgagaatgtgcacagctcaccttcgttcagccctttacagtttacctccatagccttctttgcgtcttggcaccatcttgcgaggtgtcaggccaggtgttaggatgctctgtttacagatgaggagattgaggcatgagttgtgattgctcacaattgcctcctgagtggtggggccatgctggggcactgtgcccagactctagacttccaggggtccgggacctcctgctgccagtctcctagcccgttaccacagctgtctgtttcttggcctctccctagatttctaatggaactcttggggtacagtctggaaataggtattttaaacatgctttgcagtgattgttacagatcttcatgttcaggtggcccaggggctgaccctgctccaacttccccctcagacattaaacctgtaccacccactgagatggttttgattttctattctgcgtttaaggcccatcttcaccccataaatgccagctccccaaggacagagccctttcctgtcttgtccacaccatgttccagggccctggacggtggttggcacacagtaggcccttggtaaatgtttgtcggatgagtatgtctcttcctcagctctgtggttagctgggagagctccgacagtagagtctggcaggtctggttcaagcatccctttggtgtaacatggtgtgaatggtggggcctcactgaattgtggagtggggggcagtgtgtctccctacgacctcctggtgaggagaagatagtcaccacccacacaggcacactcttgaatattccaggacgaggtgggcactcattagagggcagctcttacggccactgcctggtatgttttggcgtgagcagtagggtcatcgtggtggtcagtttttccactgccatcaaatgggatccatttagctctcagacagacaaggtatagggctggactctgtgccgtgggctaaataccggccacctcgagcctcaaatcaagcccagacaccggcataaacccaggtggcccaagccgaggtcgctccccagggccaggctcatgaatggataagtaaatatttaccctgtctgaggtcgaatgtgaactgtctaccaggtgttttgtttttctgtctcctccctctgtttctgcagtgcctccccctgtaaaaaaggaaaccaagaggctgacaggttaagtgacaggcttgacacagctagccatcagaacgtcctccagtcccatctgagtcctgttcctcctcaggcacctcctccaggaagcattcccagatgactggcccatcctgccctttccctcctctgagccgcaccctgcagacggccctctacctgtgaatccatacaggatgtaggcaaaggggaagaggtttgctcatcctctctccttcacccttgtgcatattaatactcacctggcaattagtcatatgcaactcttatattgaccttacatgttccgtgtcttctgtgcccgtctctggagttcctgaagatgaagggctgtgtctgctgcaccttcagactttttgaaattgattggttggtttgtacatccatttattcaccccacccctcatcctactgtacacgcttatggtcagtctattctgtgtcgggctcagggcctttctccccaaagtgcgttcatgtccaaggctagagtggatggctagaggccagaggacagcttaggctgaaagtggtagggagactatcaatgaagctggggggagctgagcttctgaaacttgggaataaattttcagccttgctaatgtgttcctctgaaaaaatatcttatcaggccctcagatatccaccagttctccctttccaacttgcagcctgcacccttggccaggaagttcataggcaacaaaatagaatccaccttccctatcactcaccccttttaaaatgtgactaactctgagctaaccaagccttggccagacgtggatatggttatgcacggactccgttttgtggtttgtcatttctgacttgctgggaaatcctttgttgggggtggggatgggaagtagagcatctctggggctggagtttttctaagatgtgtaagatttagaggctgtcatactgcaaacagggagagcgggctgtctgcttggcttcatggtcagtggagaacagcctggacttggagtaagaacagctaggttcagatccctgcttttactcctgaccacttagtaaccttggccgagtccctcaacctttttgcctcagcttccttatctgtaaaacatggggttcttgaaggattaaaagagctggtgtgtgtaaaacccaggaacatagttcctggtgtatagtgacttataatttcgaaaaccttaagattttattcataagattttttttttcaaggccaacttaagatttctaagagtttgtttttcaaagagctggggtcttgctttgtcgcccaggctggagtgcagtggtatgatcatagctcactgcagcctcaaacctctgggctcaagagatcgtcccacctcagactcctaagtagctgggactgcaggtgcacgccaccacacccagctagtttttaaatatattttttagtagagtgaacctcgccattttgccaagcctggtctggaactcctggcctcaagcgatcctcccacctctgcctccaaaagtgccaggattacaggcctgagccaccacgctcagccttctaaaagtattttggtgtgcaccattagcactgtgtcttaaaggcgatgtgcaccttgagcacagagtgttgagtgcgtggtggatggatgtcatttgcgttttacagatgcggcaacagaaactcaggcccagccacttacccgaggccacatagtcccaggtagagttggaatttggaataaagcctgctgactccaatcctagatgccttccacactcctgtccccctacctctacaccaggcgtccccaacccctgggacccctgggaagtgatgtgcacttagcacctcactatgggaaacataaagcaggaactaacaggactcctctctcaagaaggaatttcagtctacttggggaaagaataatagccaagcagtaactcaggtttgtttagccttctagagcagtgttgccggatatcactgtagtgtgagctacagtgtatggtagcccccacttgttcttggttttgccttatgaggtttcagtcagctacagtctggaaataggtgaatatagtacagtcagatgtgttgagagaaagagaccacatttatataacttttatgatagtatattgttataattgttaatttcattattagttattgttgttaatctcttactgtgcctaatttataaattaaactttgtcttgggtgtacatgcacaggaaaaaacacagtgtctatagagtttggtactgtctctggtttcaggcatccactggtggtcttggaacgtattcccctcggataattgcaattacttctaaaatctaaaatcttctggccatgttaaaatgtaaagagagggtgaaattaattttaaatactatatcttgtttaatacagtgtatcccaaaccatcatcactttagcatatactcaaatataaagattgttaacgagctatattacattcttctttatcatactgagtctgaagttgatgtgtcctttatacttgtggcacatctcagtttgcactgtccacatttcaagtgctgccatgtggctggtggccaccatattggacaccacagctacaggatttcttcgttaggtcagttgatgtcacctgcattttggagtggagtcattgagctcactggctgagttacacagctagtgaggagccgggtgggaccagagcttggtcttcttcccattaaggaagaagggaaacttgcatttgctgaatgtctactatgtcccaagtgctgtgctagatactctacctttgtcattccatttagttctcacagcagccttgcatggtggatgaatatcatgtgcattttacagatgaggcaacagaaactcagagaggcccagcaacttacccaaggccacgtagtcccaggtagagttagaatttggaatagggcctgctgactccggtactaggtgccttccactcacctgacctccttctcttacaccaggggtccccaaccccggggccgtggactgatacccgtgtgcggcctgttaggaaccgggtctcgtagtagtaggtgagtggtgggcaagtgagcattacggccagagctccgcctcctgtcagataagcggctgcattagattctcataggagcgtgaaccctattgtgaactgcatattggagggatctaggttgcacactccatatcagaatctaatgcctgatgatctgaggtggaacagtttcgtcctgaaacatcccccccaaccctcatctctggtgccaaaaagattggggaccactgccctacacagagaaagagaatttgcacgtagcaacttaggcaaagtattcaaggaaagtgccaggggacaggaaggacaccatgggctggtggcctgttcagtaacagcttcagggtatcagttcagaaggcctaggcctgctttggttggggtggtgtatgtgtaaaagcagcattctgtctaatcacaggttctgcctgaaaggcagacacttttaacccttcggtggacagggttggtgatagctagtggggggtatgaggtgggggtgaggaggtggtggtgggcagcaattgcagaggccagagatcttggctgtgttctacctgccacgctgggaatgctaagtacttctcaagccttcaagcaactgagactttctgctcggggaatccccaaggatttggggaggctggaattgagcaagctcttgaatgcatgcatggattcatgcagtcactcactccacaaatattcacgtgctttgggccagaatgatttcggcaggaatatcttgtcctacatgctattgccatgttctctgaggacccgcggcttcgcatgtgtaaatctccctccagagtactcggcagattcccgaagctgactgaggctcagggagtgtcagtcccttgccacaggtcacatagtactgaatggaagatatgggacctcagaaccaagaggctttgactcatttgtccctctttctgtctgttttgccatcagccaggagatagtcgttgagttgtttctatttgccaggcatcgagctgtgttctcgggtttcattgttgttgttttcattttgagtgtgtttgttttgttttacttttaggagcaatcacagtgctcctgttgctgaatggtggctgatgtctgttgcatgccaagcactgcgcagggtgctggtcacagtttgctccagggattcctcccagtcccgctgtaaagaggaggaaactgatgctcagagacttggacctttctgaacatcatgaagctagggatttcagtcccagcctctctctcgagagccctaacttagccactatacctcactgcctctctgtgaccagggttgagtcctggtcctcaaatgaagcccgatttgccagaaccttcttttgaggccttacctggtcttcagttttaccacgtgttaattgggggcagggcagccagtccatcctcttctgcagaaatcaccctgtccaggagatgggtgcttcttcaggacactacctggctaagaacactgcattaacaggagatagagatccagtgtgtgtgaaccttgtgaaaacatctctgtctgttcctccaatctcccccttctgtcttatcatgcagggcaagctcaggttgttgtcctgtctctgttgggaggacccttgagtggtatctcctatgcccaagcagacctgcagagaaccctgtccaaactgatggtcatctgagacatggaacttcatgataggaaggtgtcttggaggataactagcaagtctttcactttatagagggggaaactgagtcctcagcgatcagccacatagattctgtgttgtagagacctgaggatgtgtctcatctccttatctgaacagcaagttcccatgctgcgaacgtctcaccctgaccctcaccgtattttttaggaagtgaatggggctttgagaaggacaacctcactgttttgcccatttctgagatggaaaatcaaggaacattgccccatctccaccccgggaatctatatgcccctcccataggcaagatggaagctagaccagaatgtgcagcttgtgcttcttgcgggaatggtgaggacagatgagggcagggagacagcattcctaaacccagccttttgacccaagaggcagggactccaaggctgtagaatgggaggaattgtgggaggaaaagcactgggcagaaggtctcagtcaaatgcacctgcagttattagctatgtgacttgggcataatgccacctgtgagcccccattttcctcactaggacagtgaactcaccaataggtttgagttgttgccctcccagaactgttgcatgaattgaatgaggtgccttgcttaactgtactgaatactggggaagcctgcttaaatggatgacaggctttttatcattagcaagctgccgcactccccactcatcactccaaggcagaccattgcattttctttcattctgataaactccttgagttgaacagaaatcagactccccgtaacttctgctccacagtttaaaacagcccaccatgaagccttatgtccttcaggacattctgccctgttcacttggatttctctcctccctgcaaagcatcatcagcttcctcctctgacccatgttttgcacttccttgcttgtcactcctctttaaacacttgtccaaactgtttgtggcccgtcctgtattacgcccagggcagatgcagtagcccagcccaagcagcagagaccatggcctccctgatgtggggtctgtgcctcttctccaggcaagtggctgtgacagtctaactttatggaagggtgaactcaatgacattggctgaactgctggtgaacacgggaaaagcccttctggacctcttatctctctctcctggccagaggaaaaccatgtcccatttgtcctgtttgagcactatcaggcctatagccataatcttttacaccgtaacataactttgccaatgccaatattatatgccctttttttttttctagaaaaacttaattgggattttaaatgcatttgggggatgggctgcgtttctgtttgcctctaaaaacaatgagaaggcaaacaaagtatgatcctatcgccagaaaaatggagccaaatctgaaattaatttacaaagtcattagtattttccatttgtgacccccaaaatgaatgtaggtgtagttccttgcaattaactgcaaattaggaaagggttgggaggatgtttcagggaccaacacacagaactgtagcagaagcagatgggggaatggaaccaagaattgccttggttttcactcaaggccgtggtttgggagagtagtgccgactcaaatattccccagaagagagcactttttcaacagtctgaaaagtggcagggacctttggaatgatctgttttaaccttttcattttctgaatgaggcaactgagagattcaggaagggtaagcgacttgcctaaagtcacatagccaggaaggtcagaaccaggaccagagctctgcttctgactccctggccagtgctccagctgccactgcccccctctctcctgggtgcttgtctgcttgtgcctttaatgttcagcacttgagatattttcacgtttagcaccttcacgtttagcagtactcctcattagaggaaaatgggatgatgtgggcagagtcacccacagagtcactccaggtttcagatgtgctggtgcttaccgagtgccacagggagaaagtggtggtttctcccttcccttaagaaacctggttatttccaaggctcaacccctgcaacgccccaccaagccagtcacccaccactgcacattgagaatctgctgctctgtgaatgaaattggcctggggttaatgagtggtgaatgtgtgtcagtgtttggtatttgcagcaggagctcttctgcgattccctaagctcagatgaacggggcctttaagatgccatccagccatcggagagatgcaggaaaggccttttgaaatgctgtttcccctgacctatttgaggtgaggccctgtgatgtcatttccccagtggtgtgtgtgagagagcaagcagcactaagaaaagccactgctgagagttcacagtccttgcttcagtgttgtcttacgctcggggtgccttaaagggcttacagcgaccctacctccagcttctccagctccctttccttggcaaacacttgacccatcccagccccttgggctttctttcctcctcctctgctaccacatactgtgggtgttgggaaattactaaaggcgcgactctggctctcaaagactctgaagtccaggatcgagaagaactgtgtttacacggagttgtcaaggatcattctgccaatgataacctattatcgtgcaactctgtgccaggtcctgctctgggagctttatgtgtgctgttgcccctcacactcacggcagaggtgagacagaatgctgagagatttctgcagacaaggaatctgaggtttaaagaggcaatgtttgatgagccactgaggggtggggctgggattggaaccgaagctggctgcccttcagcccccagggtcctgctggggagatgtacccagggggtcctgtgctgggagagtggaagcaggggtgtcactgggggctttgtcctgggagctgggcaggtgctagggacagagctggcctggttttggagccacaggagagaagatggccgggaagagctgtgtttggaaggttcctttctgtgccaggggtcagcaatctgggttctagcactgagaggggcaaaacgtgggtttgtaggggagagagggtgacccccagtgagggtaagaaagataagctccagtgagctcttctcaccctgggtcccagcctgtaccaaaaatccaggggcagcccccgggcccagcctgcccccttcacagtcccctgactgcttgaggctgtgggccagtggctttgccccttggaagcttggtttcctcatctgggacagaaaggggtcaaaacaccctttttcattgttaagattagataatttgagagccaaaacttcttgcagggtgcctggtaccaagtaggccctctctaaataaataaatgatagttttcattttcccttccacttaattgtttttttttaaaaaaaacttttcttccctgtaataacaaatttcagaagacaagttaatacattgctgtgtatactctcaggccaagaatttcctcagtgtttacataccagagcagtactttgaactttgattttctcctctgcctctgtgctggttcagacaccctctctaagatgccagaagcattgccctgccttggcctgttggtggtggggtatgtgtgtgtgttttcatcgtattataaaaacgtgaaacatttgaattacgggcaagtggtattctaccagatttaataaacgttaatattttccatattcacatcaggtatttgtaacatctctttctttactaaaaataaaaaccttctgctgaagacctcctgttactccaaccccttcccccttcttctcgctcccgtttcacaggtgtttactctcttttaaattggtgtgtgtccttcccagctagaattttgtagtgtattatttgtaaagccaaataaccccactgcaatgtgtttgaaccaccaaagcaaatgatcaccttttgggaaaagaaggctgaatatccaaggccagatcagtgattcaagatcacagaacaaacctaactgctctcaaattgaaatctcaaaattataaattcattgcctttgacttaaaacttggaactttcaaccctgcataattgcagatacattaaagattgtgccatcttgagctcccagggtcatctgaacctttcatgtgaggaaacacatcccagagtcagtcattcttttttttttttttttcttttcgagttggagtcttgctctgtcacccaggctggagtgcagtggtgcaatctcggctcactgcaacctccgccttccggattcaagcaattctgcttcagcctcctgagtagctggtattacaggcgtgcaccaccacacctggctaatttttgtattttttagtagagacagggtttcgccatgttggccaggctggtctcgaactcctgacctcaggtgatctgcccacctcagcctcccaaagtactgggattataggcatgagccactgcacccggcccagagtcagttattcttagagcaggtgttttggcttttgtctttaatgcttccctccccactttaacataactgtaatatataattattgtggaaaatttagaacacatggagaagtaaagagtgaaattgctgactgccctattaccccaacctccaccctatagagatattttctccccatccccccaagggcagaggatggagatccctgggcttctccaggtggggagtggtaccatggtctcttcaggtttcgtagcagacaggccccattgaccataggatatgtgtccccaaggtggttagaggccatcacctgcctgaggtcagctcaatgggcagggctgggcatctcctggtggtctacccaccatgccagttcatcaggctggggtctgacctctttctggtgtctggtgctgatctaggcaaggtgacaagtgctcaacagaggagtcctggttccttcaaggaagctgggaagtgtaagacggagcaggctgcgtttgtggtttttgccaaggcttgacttttgaccacttttctgaaaaaggacaagggtgtttttttgttttgtcattttttttcccagtagatgttcctatttggttcacagatataaacacttgaaccaggtgatatcagcactgcaagttgatttagtaccacagccattttctgtgtaccaatatgaagctgttccttcataagttcttccttttcgcttttttaaactgaaattattttcattaggatcactaccttcccatgtgcattttaccacaaaatttggttctgattctgttggcttgcttgctgttagtactcatgttagcttctgccattctttccaccattgtcctgggtaaaattttgcatatctgagttgttggattctttcatcagtttttggttagtgactttcatggtctgcagttttagttgctttcagttttattttgtgttgaagttttttctatgaggtttgattttttcagggtcagtttttaaatgtagcaaggagtgtgctttttcagtttgcttattattttcaacaaatgtttttggtgggtaattttacctttgttgatcaccagctttgtttggggtgcatcatttctctcaagccgaattttctctggtaatctggccagaaggcccatagggtcagaatggcaggtcaaaatgtcttggtgctttcttgaagagtttgaaacaagcttgcaaagtactgtcctccctttggatttcttctgtctgggtgttgccagggctcttctgttagcgacagagaaaataggaggtactagaattcggacttctaggaagggctgtattgtccttatcatcagaatccctccctcccgtccctgtgacctcccaacttcacaaacatgtcttgcctgcaccctaggcaaacgtggaaaggcgcagctctggtacaccggaaagcatggtggatggggaggtaggagccccgtgccgggacatgtcttttctctttcttgaactcgtctccccacccgtccacagggttgctggccagagatctgtcagagtttctccgggcttctctttctctgggtggggatgtggactcttaggatgtcaggaagcaactgtaggaaaccccctgtgtgggtgaagcagaggcgtcgctcagggccctctgcctggttctgggctctgggaccctgctcccctcccctgaaccccccctcccccggccccaggatggagcttgcttgccatcgcagtggatttgcggaagagggttccagagtgtggggagagcgtgctggggaggggagctatttgttcctttccagtcatcgctgtactgagcggttccctgggacagttgaacccaggggaactgaattcatctgtgtaagtaaacatccatctccccttaaaggaaaagcccctgctcagcctctctgggcagctggaatgctgctctgtgggtctgggcatttgttccttctttctttcttcctttgatttcttgctgtctccttcaattaggcctgtgactgttttcacatggctatttgtatatacaagccatgccaggcatcataatttgtgtttgtctagatcaataagagcagctttaaccaaaaagtccagctgagaatttataaatacccctcacctcctcccctccctggaagatgtgaaaacaccatcccattaaccctccaaagcagttggttgacttgatcagggaagatatgaaatataatttctttgaatgtgctttctctttactcttttagtggaatttgatcagtgtttaaggaactgtagccgattcccagcccacttcaaagcaaaagcccttcactgtgcctatttgcaaaattacctttgagagactgaagtgtcggaaatgcatttagacacagattgtgccttatattagctctccgttgccccataaaatgggcttgggcatatctgaggcagctaccaaaggaaacttaaaaacagattctggcggcagcgattcttgtgttctgtgctcactgtggaaaagaagggggctagagggatttaagtttacgtggatcttgaggattttaagaaccagatttcttctctttgctcacattaggggaaaaaaaataaacctcagatgccccgtgatatctcgttgcgtcaggttttcctataaaatgtcaagacggcaatattaggtttcctggcttgcttttccccactgtgtctgctcttgccagaatttttattagggggaggggagcattctctacccctcctccctcaatgaaatcatttcttccctagcctttaaccctttaaagtttgggaagggaatactttgattttagggttaaatagaaaacttccttaatgactgtggctggaattaaggtgtacttaaagctgtagcagccctggtgggtcctgggctgactgggtgctagggtttggtatggaaagcagcttgcatcacctgcttttcttcccatgcctgtgccttccccaagctccccctcctaagccaggtacgattccagctatgttaaaaggccctgggaaatgttaactgatcaaaaatgctgggtaagtagaattattatttcaccctgaccaacttcagtcagattagcatatctgctgtcaccaggtatggcacaggcatgggtggaagctgtgcttggaaagtgaatgtgtttaggccaggtgtggtggttcatgcctgtaatcccagcactttgggaggccgaggtgggtggattacttgaggtcaggagttcaagaccagcctgaccaacatgacgaaaccccgtctctactaaaaaaaaatacagaattagccaggtgtggtggcacatgcctgtaatcctagctacttgggaggctgaggcaggagagtcacttgaatctgggaggcagaggttgcagtaaaccgagatggcaccattgcatcctagcctgggcaacaagagtgaaactctgtctcaaaaaaaaaaagagaaagaaaagtgaatgtgtttgctggaagctgtgcttgattaagtgaatgtgtttgatccaagagggcaggggattctggaagagacattaagtacagattgatgagtgtcttgtctcaccgcaaaaacctcctttctctcttccttcctagtccccactgaaaatggagtggtgatagcttagttctcactttggtttcaggcaagagaaatggtacccaggaggtagagttgagtagagactcctttagctctcttcttttttctaacttctctttattccaccgttctctctttacttctgcctaccttagcagcatgctgcagaataaactctgctaggaggaagtttgaaatctccaggctgagaaactatgcagagagcaaatgaccttctgagggctctgggtacagaatccttggtatgacaggtgggtctagagccggcagagactcaaggcagcctgacaggacagtgagagtgaaagggaacgctattaataatgacaccaggtcaacacatgcgaacccaactgtcctgaacaaacgggggtttgtggttgcgctacaaaacccaggcttcagtctcttcgagttctgttttgatttggaaggagtgacgccttcccctttggaagcttaggctagggttgcaagctgaggtgttcacagggacagacagagtgtgggaaatggggccaggtgtaaggaaacggagcagaacttggggttcattcatagtctaaagggggcattggcaagtcggcatcagacagtagcaacttgttgccagatcttctgagtttttttcaagagaagccaaaaatcaagatttacacacaaaatctcccagtttgtaaaagttggcaaccatttaaaaattttaaaaacgctctgcaggccaagcacaacatctgtgggcagtgggcagctgcctgtttttgacctccagcccagaccgatcaattgatggctgtcttctgggtctcccaattccggcaacgggaagtttcttaaggaagttgcctgggctgaccgcaagtgaggtggggaagtggaaagggagcttgacttggcttcgattgatcatttgcacaataaatatttattgagcacctgttatgttcaacgtactatctgtgttgtgccatgtttcctagtctacattttgggatgagctgtgtcttcctcatgcaggtggactctttatgccctgcacagggatggttccatgcttctccctgagattatggccaagatggatgcagtgggaggaacttcagtgggggaatgttggggaaagacctgggtccgattctcagaccctgtaaagttcattgtatttcagcttaacccagcagtagtccccaggatgagacagtcttcagctgaggaaagccctggggatttggaagctagagcagagagagtccagccagggacccttgtctggcagtccctgaaggctgtaccaggaccaggcggcaaaaatcacagaacagcctccattcagctccatacatggcagaactttctaacagagctctgtaccttgtggttgttggactagatgatctgtgagctgtttttcattacctggaaagtccgataccttgagtccaccccccatacacccattagactcctgagtcttaaatctgctctggttcatggcttacctcctgcagctgaacttggggttgagtgccccagaaaagccgatacaaactctaagttgaggccaactcagtttgcctggggatgaggtggggtggtatgggggaataaaggcttctctaatgctgtgaggtgtcattcatgttttccattctcctgctctccgaatttaaattagggtcaatcatacaaacctcacaggcttgttcagtcaacaaaggcacagagagcttaagtcacttgctcaaggccacgtagcgaggcagtgaagagctggggcctggaccagctcatctgtcatcccccgctcttttaccccctttcctaaactgttagattttaatttccttttggtatattcattcttttgtgtgtctcctccccacaccccccccaccattgtttctagaactgtcagtgttcaaatgtttaatagctaggttttttttttcccccgtacacttggccagaagtaggaattcatcaccatgtgtgaacatttactgtacctccatggtttgcgtggaattgtactagaaacactcaaccccggggctttgttggcaataaactaggtctttctgcagaacttttgaggacaaatcaccaatgggttggaaagcatttccttcaggaatggcgaaactctatttttcaccttgttaatgctgctcccacctttgtttctcccctagtgtcagtcttaagtgtgttaagtgcttttttctgctcagtgtcctagataagaggtttccaaatgatgtcccctgatctgtaccccacccccaattctcaggcttctggatagacagagaatggacatctggtttgttttggaatgacaggctagactagaggcgtccagaggcctggtaacggcagaggctgctggcatcttaagacattcaaaaaccactgtgctaagtaacagtggagatatattgatctcaacatttcaaggagaaaagagcttgtgaaataggcttgtgatgtttgtgataagggccctgtggggcagctggtgggcaccccatgtagagctggaacacagggacatgatcccatgtgcaggagacagctccagcctctgcatacccgtcggctcactcctgggttggaacatcctcctcattttctctggcatgtccttttgctcaatgaatcattcccggccaggccagacgtccttgctggagagccagctctccgtgcaccagccctgtgattctctaatgccagcttgaaattcggtgacccaccttgggatgctttgcctgtcaaggtttttcaatgatgaatagttgttatgagcatgtcagccagaatggtacttttcaagtcattcagtaatggatctgtatgattattttttgcacaaagaactaaatagctaagatactattgtggcagatatgccataagtaccttttcagtgaaatctttagtgtacatatttgtcacactgtattagaacatattaaggcagctcattaatgttttagtatttagagtttgtcatacagtgagcaaaggcagacacctttgacacagtctattggagcaaaatatgtctaggcttttgcttgcttttttcattttcaaatccatatttccatcagaattttagagttgtttgtttggaggcagagtctcaccctgtagcccaggctggagtacagtggcctgatctcagctcactggaacctccgcctcccaggttcaagtgattctcatgcctcagcctcccaagtagctgggactacaggcatacaccactacgcctggctcatttttgtctttttagtagaaaccattttcaccatgttgaccaggctggtcttgaactcctggcctcaagtgatccacccacctcgacctcccaaagtggtgggattacaggcattagccactgtgcccagcctagggagtttttttgtttttgttttttgagatggagtctcgcactgtcgcctgggctagagtgcatagtgtgatctcggctcctgccgccacacacagatcataatgtgatctgcaacctccgcctcctgggttcacatgattctcctgcctcagcctcctgagtagctgggagtacagcctgctttggcctcccagagtgctgggattactggtatgagccactgtgccctgccttttttttttttctttaatgtttgtattgaggtgtaatatgcaataaaaggcacatatttaatgtgtacaatttgatgagtttgatatttgtatatgcccatgaaaccatcaccagtcaagataatgaacatgtccatcactcctctaaaactttcctcctgcctctttgcaatttcaccatcttgtttgcctgctgcccccatccctaggcatccactgatctgctgttattatacattagtttgcatttcctaaaattttatataaatggaatcatactatatgtatgacttttgtctgattttttttaatgcagcataattattttcagattcatccatctttttgcatgttttagtagtgactttttgtggttgggtgatatttctttttgtggatataaagggagggttgttgatcttcagggattatttattttcattttaaaagtttctcctgaagtagtattttgtttttgaaaatgtgctttgaaagaaatttgtttagaattcatttggccctaaaatccacgtaattaatgatttaatgagttaaatagtgatttaactatataaatatagtttgctaccatgtttgctatgtgccaggcttgatggtgcttgtagggcacagaagaggttcctgtcctagccagtggttgatgtgttcaggagggcctatcagtagtgcactagtgcaccatatcctacatgtgatagagctgccgtgttcttagacacaaagacagctgttatgctgtctttgcaaaaatgttgaggtcttgctttccacaggcttgtggcctgatgcacgtttccagttttgcacaatgtcacagcagatatgccttccacgcccttggtttttcacagccaggcatggggctggaatctcagagctgcggttgctgtggttctctgattcctgctcagaggattgcgtgatgggggctggagtgcaggcaggaagttagccttgtggattccctcatcctcacaaagccaggcgcacagggaggggttgggggtagggggttgccatgggaatttcttccccagccagagagccagggtggagtgtgttgctggggagttggaaatgtaccctcttttccatatccattgttcagtcacgttctcctgaaagaagtcttcttactgtgtgtaagaaaaatcagtaagcctctgataaatagtcaaagactgtcagaaaagggaccttggaaatatctggtccagcctgcccattttataggtgaggaagctgaggctcagcaagcaggagtgactcaggaataagcactcatagcacagctgggacttgggaaacccaggcactgctttagaccttcattttcacaatccacgaaggggggagtttgaagaaggcttggcaaaatttgatagacctgggaaagagattgttaatctctcattctgtgctcaaggatgctgtgccatttaaaaaacaaaaacaaaaaacagaaaagaaagacaaaataattctcccagatgatgtttctagaatgttctgacatcttacagtgtcctgaccttgcacaagcttgttccagtaataacgttaaaattcaggagtggatgttcggcaacatcattgggcaggattttctggttcgtgaatgaaaggttatgggtgacactgtatgtcagtgtggcgcttaccggtttatgaagggcctacatgtgcaatctctacaggaaccacttcccacatggcccctttataccaatgaggaaatgggcccccggagatgaggcacttgacctgaggtggcccaggtggtaaggagaggagccagctttccaatgcaagtcccaatttccagtctcctgttgtttccaccgtgtctccctgcaaggcggctggggcacgcagaacaacagcttgacacagtgggaagaagctgggctttaatgtttagagttcagagttcagctctgctcccctgcctgctgggtgaccttgtggaatactcctaacctctctgagcttcattgtcatcttttggaagatgaggccctgtcctacaggattaaagtatttaaatatagagtgcttaccataaaacttgcttctaggaagcaactggtcagtgttaactccttaatgaggctgaagtagacatggtaaaactagttgtggaaagagatcctataaagcaaaactgaggacacatttacatataccaaggggtgcccagccctgttcttcctgcacatagaatcttaaatgtttcctagattgagccattaatcttcgattttttgcaaaggaagttaagacagagataccaagtgccttgcacatagtaggcctgtagtaaacacagactggatgatcaactgctctttggaggagcagagagtatgcctacacatcatttgaataaaatgtgacagcctgccagagaccagactttgaaggttatagacccagggcacgtggccagagcagctgtcagtggaggtgcggcctagagcgggtagtgtggaggctggagggggctgttccatggcaccagggttgagtgggagtcagtgcagacttaggagagggaatgtgtgttcggggatggggagcggggagggacttctctcagacacttatatggaatctcaggtcatacagagacattgtctctgtgttttatattttcctttgaggacatctccatttaagtagctgatgcctgagcggggagagaagaatgagccttttccttctgttagagcctgtagctgcctcttcagggtcagactttaaggtgtatggggacaaagttgggtcagtgtttgtagaaaaaaggctctttctccatttctccctcctgcttaatccaaggagcagagaacaccagggaaactcggaagtagcggggttgatttgggagctagatggggcctgacatatgaagctgctacctggttacagccaggcagagttgaaagggtgtcctttggcggggtgagaagagagcagcctccaaagattcccctgcaccccgccaggccctgccaggggcccctcccacagttctttgctccttccacggagcctgtttgagaattcagtgattcacttcccgtcgtcaactcttgtttaacgttcccctccattgttaccaaacaatccaggccccagtgatgtgtggtgttctgagagtagaggagggaagagagagagagagccagaactgtttacagagcccgggagatgggcccaggcttgacagccgggccgacttgaaagacaggctgcagtggactgtggccccaacagctgggtgtgtgcagggtgggaaatgccaggcacagccgctcctccacagaaaccactctgttctttctgctcttgatggaagctcctgccctttattgtggtgttagcttctttgttcagttacaccgacagctgagttttctatttggggccatagttttggggtcatgattcctggagtagaaaaaaaacaacataggagctcactcagaaggatccctgggtaaatgccatcctttcctgggccccagtttcctcacgtgttcagggggaaaagaaggtggtggtgaaatgccccccaccagctccaaagtcctgtggttctgaggctggaatattctgcaaaaggacatttgcacaccacccttccactgcccccgccccagtgtcgtgtccaggtccagttctaccagccacagatgtgagcatgtctggaacctgtctacctgtctcattcattccatgacctctgatttttgaggtcagtaattctgcagcctccctcacctttctggtttaaagcaacctcctctctcaggaagttgtttgaaatcaatttaattcctttatatcccacatgacagctacgactgccactgtttagttgatgttggcgtcgggtttggggcttacttggcttttgtgtttgcttctaacctgcagaaagagtcaaagttctgaagttttctctctcatcctttctgtttgttgctccatgtacagtagggaagaggaatttttgttggtagtccacatttttgattacttatttgctctgctgctatattatgattcaggttttctccaaggccctaggtgcctaaaagcattgaaggaatgagaagtgtagacacagaacacctttaagccacttccccctgcaaattagtgtatttcacaggtatttggaatgctagaaggtactagaaggtgagaagacactagagatccgttgaacccatcattttttaaatgagataatccatacctaaagactcctccatgagtcggtagcacagccagagggagggccacacacacccctgtcatctaatgagcagccagggctccagtccatccccagtgtgggccatatatctgtgtgctttctcctctattaaatccaacacttgataaaaatctccagttaacaaatatttgttgagcaagtttattgcaaatcgctgtatttaatgtctgcctacaaccttagccacagatgactctctctccctggtatggcaagtgggcagagcttcctcattcaaaaacattttagcttcctgcacttccccgctggttgctttcgcctaactggcacctgtggctgtcattcccctgctgtttttaattgcacctctcaagaccagctgattgcttaaagaacatttctggtattgggcccatggcagtaatgtgcgtctgtggatccctttgctatgaggcttgacttcttgatcgggttcacaaggctggtgggcagcctgagatctttgcttatttcctacgtcttctgaaaggtactatgaagcttaccagttgctgatgcacgctatcagctaataattccattaccattactattttctgagcaaatgtgacctgcaagcccctcgctccatccaggatgcaggcaaagttaagctaggtttcctttccctcaaggagctcctggcacagttgggaagggaagtcagaaacacacagaagtcacttcatcataccaggcctttggtgctaaatgatgatgaatttgaagagtgtgggacagtggggatggtggactgtaagagttcgaggaggggaggatggagagaggtcattcttagcagagagccacagagtgggttactgtttgagctggaagataattggacctccaagggctctgtccccacctgcacctcagcgcactatgctggtggccaagagtgcaggagcctcacattcagatactgtggctgcaacattttacctccactacttgggcctgttcagcattttgagtttctatgcctgtaaattaggcctgtctaggaagtgggggtgaggtggtgggtgggcaggtgctctgaatctcagctgggactgggtgggctgataccggggagagttgtaagtatctaggacccagcgggaggacgcctcacctggaaccctttgcttgttcctgattgtagctgttttagggatgcagctttcagacaagggccacttagttgatgaggccggcttaatcgaggagggctgttgccaccctgacattgttaagtgtgggcctggcttctctgaagtcctcctttcttgcttgtgtggaattcctgttttcctgcccataggggttctttgctgtcttaggtgaattgccccaatgaaccagaacctttttttttttaggtacaataggaggtctgtacccttagacagaaaggaatgctaattggccacttaactgtcctcagggtacagatgccagaatatacagggcacccattctttgttaccatttgggatggaaactgcttatataagcttgtaaagctttggttcagaaagcaagagaatgtgtatggaacgttagcaattgctgtcatgcaaatgctgcattttttgcatgtaaaggtacctctttacctccatggtccttaaactaactttttcaagaaacatggtcatttcccacccttcctttacttccagctccccattcatacccaacagtggctaactgaaaggtttgcaaatcctgaaggctttggggcttcttttaaaaagaagagactgagttgtaaatgtcataagactgagatggttgtaaatgtcccaaccatactgtgtgacatttgctaggaattgttgtaaaatcactggagtgagcgcttgtcctgaggcactgcctctccgcgtgaatgtcactgagtcgcccggttgacccgttgcatgttatgcagcacttgtgacattgttttatctctctagccggtgactcataattaaggaagtcaaaactgtgcaattaacacaaaacctcctcatttgccctcttcacctctccccaacccccgcccccagtcaggaatgcccgcctgacattttctctaagtctttggaaactttaagatttgttttgatagaacaaggccgccagttatcatcgcctggttccacttgttttaccccaaaagtctgtgagaatcttttccaggaaaaaaaagaaagaaagaaagaaagtaaatcccacccccaagcgtgcagtctgcccacaggaagtgattcatggtgctccgattcgggcagacctgactgcaggaggcgggaggctgggaaccaggtctgggaaaagagggcagagagaggatacccagacctaatggcttctgctctgtggaagaaagtgaaaaacagaatgactaagagtcctgtaataagaattgtttgttttgtgaagttgaactaatagtgaggtttgccggcagataagacttgagaaattgcagttgtcaggggaggggacttttccatgtcctgctttttttttttttttttttttattaagagagcaaagctatttctcagtcttttttttttttttttttttttttttgagatggagtctctctctgtcgcccaggctagagtgcagtggcacaatctcggctcactgcaacctccacctcccaggttcaagtgattctcttgcctcagcctccccagtagctgggattacaggtgcccaccaccatgcctggctaatttttttgtatttttagtagagacggggtttcaccatgttggccaggttggtcttggaactcctgacctcaggtgatctgcccaccttggctacccagagtgctgggattacagacgtgagccaccacgccaggccttatatctcagtcttaagacattcatatattagtggaaggcccagatttgtgtttcagttctaccttgccacctctaagcctgttttcttttctttggagaagagggtctaagatgagaccattatctcacagtctccaatagctctttctccccattttcccttttatttatttatttatttatttattttgagacggagtctctctctgttgcccaggctggagtgcagtggcacaatctcggctcactgcaacctccacctcctgggttcaagcgattctcctgcctcagcctcctgagtagctgggactacaggcttgcgccaccatgcccggctaatttttgtatttttagtagagacagggtttcactatgttggccaggctggtctcgaactcctgaccttgtaatccacccacctcagcctcgcaaagtgctgggattacaagcatgagccattgcacccaggctattttccctttttcctttccctctaaagttagagtttttgaaaaatatttgatttttttaaattgacaaataattgtccatattcatgggatacatagtgatgttttgatacatattaatgtcattatggtgatcacatcaggttaattagcatctccatcctgtcaagcatttatcatttctttgggttggaagcattcaatatcctccttctatttgaaactatgtaatatatgaatgttactatgtatgttactatataagcattcaatattctcctatttgaaactatgtaatatatgattatacatagtaacaatcatatattacataataattgtaaactatgtaataataatattgtaatatatgattgctagatatttgaagctatataatatattattgttaagtataatcatcttacagtggtttaggacactagaactgatttttcctctttagctgtaattttgagacctttaacaaatttctccccatccctctgttccctttacacttttcagcctctagtatcttctattctgtttttacaaagttagagttttggggctgataaatgtttttacctaaatactcatttttgtttccaccaaatggaacatcatgttgtcgtagaatgaaggaatcctttctgtcctatgggttattttcttctccctcaaactgacaatgcaaattaatttgattccccaaagtagtttggaaacagagaagactctaagtgttggctacatgaacaggcctgctgccgagcgagaggcccagatcacccagaatgagaagatgggtctaaacacacctggctttgtgacttactccatttcaagcttcctgtattgttggaggtcagcttttgggggtgagggattttaatgaaagctgaggtgaagtccactgttgccttaagcccatcagaacgttgccaagggctgtgagtatgctgaatgggtccatgagtgatctcttaaaaaaacataaaccattgtcaggcctaattttcagcagagtgaaatggccacccagaagattctgtgaagcctggcaacttttccctttcttccagtagtcacagaccaacccagatctttgtagcatcttttatttgtgacttgaaagttctatgatcctgctgacactcaagaaaaagcaatccccatcaacttggtgcttggagaaaaaagtttgtgaagaccaaagctattaaatagaaaagccctaaacactctcctcctcctcctccttcaatatttaaccgtcttctttgcatgggggaagggaggggctctcaccacagccaaaagagaatctctgctgatttaaacccagtgtgctttgtagtcatagagaactgagtttggagtgtaacatctaggttcaagcccaggcactgttccttgctgggtgactttgggcaagtcactcagcatcaaaaatttttcatctgtaaaatgggagtgatgagatactcagcctgcaggatccctttatccagtgagttactgagtgagaagtgctgggtaaacgcttgctctgaggtgtaaattgcttctgtttggccaggtgcagtggctcacgcctgtaatccaagcactttgggaggctggggcaggtggatcacctgaggtcaggcgtttgagaccagcctggccaatattgtgaaaccccgtctctactaaacatgcaaaaattagccaggcgtggtggtgcatgcctgtaatcccagctacgcagaaggctgaggcaggagaatcacctgaactggaggttgcagtgagccaagatcactccgctgtactccagcctgggcaacaagagcaaaactccgtcttggggggcgggcgggggggattccttctgttttcccgcatcttgctcatctcagagcatttccttagcccagggggatctcaaggggagggaagagagcagatttgccccccaggggacatttggcaatgtttagaggtattttttttcagttgtcacagctgcaggtgggtcacagctaccggcatccagtgtgagggagccagacatgctgttaagcattctatatctgtctctacacaggacagccccctagccccaacaaagattagcccaaaacatcagtagtgccaacgttgagaaactctgggcctcgccaaatccatagcctgatgttgaaaagttcttggtgtctgcgtgctttacagataattatcatcaggctgaactttctccagtaaccaaccttcttcttttccagaaagtacaaattctgtgcccacccatggcccttgggaggtgggatagcccaaggtctaggcgatctttgtgtgtttccagtggagtccagccctcccaaggataaggcaaggtgtttcttggcttccccctccaaggatctgcccaggagccttctgcaacctctgtggctcctgcccaggttgccccatctgcctggggcacttgtcatggacctgagccggctgctctggagaactagcagagggaaagagaggactaaatataatgggaagaagtgaagaagaggccagctgctggtctggaggatggcatagggggctgcagcctggcattttatttggtttccccctagactggcagcattcatgcccaaagcactagatattgtccatttataagttcagatgaaaattgagttgttcttggtggaaatgttttagtgactggtatcaagggttatgaaatcctgttttcagctcttcatgtccaatctaaactggaacattcaaaaacatgcttagcacacttacagaacttgttgggaacactcaggaaactcagctacaggcagagcacatggtcactgtggtagaacttgcagtgagacctcaattatctagaacctggccaaccacatacttgacctcactagatgtctttgtggcaccaaatgaaaagaacaggctaatgttggaaatggagtttaaataaacaacaacagttttaaaaatctttgaaaatgccagggtgtagtatattcagtgtacatcctgagttctgtttgtaactctttgattccaagcttcagaaaattacaattataggctaattttttatactactactaatcgtaatataatcaaattatatgtctttcaaccagagtcaacaactgctcagtccctttttttaaaaaaaaattaaaaacacttgtcatcttaaagaccttcagacaacttaagattcaatacaacaaagaaaaaattgtcttgctgttcttaacctaccaaagcaggcaagtagacgcacatgtgttttacacacgtcattggaagaaggctggcaataccagcttggttgcaaggaaagaggcaattgtgaggactccttctcacactgcagtaatttgctgagtgaccttgaacaaggatcttaatgcatcagagtctgtttcctcaaccccaaaatgaagggattggaccagatgccctcaaggttcctcaagggtcagctgtcacagttctccaaagtgagttttcaggcagacatagagttagccagtgtcgcctcaccaggacattttgttttctgaacattgggcctctgtggtttgtcacatacacccaggggactgggctcataactccctgaagaacctctgcccagaacaaaggatgctttggatttgactgtgtgtaccaaagggaataagtgaacccccaaatcaaacatccctcttggcagatggtgttttcagggctttcttatttgttcctttattaagcagttgtcctggggcggtccattgcatggaagaaataaaggcatgttctaatacttgcgtattaaagagcagcagaaagagagctctcagggtgagcttatagttcaaaggccaaatggaaccgatgcaaggagactttcaagccacaagcagaatttttttctgccttcccagaaggtccgatggaatgagcacttcacccaaacttgaagtcactcaagtcttgcttttattttgaaccagaaaaaaagaaaaggaaaacccacgtagaatgcaaaatttaagtaaagatttttgggccagtcgcggtggctcacgcctgtaatcccagcactttgggaggctgagttgggttgatcacaggtcaggagttcaagaccagcctggccaacacggtgaaaccccatctctactaaaaatacaaaaatttagccgggtgtggtggtgcgcacctataatcccagctactcaggaggctgaggcaggagaatcgcttgaacccgggggcagaggttgcagtgagccaagatcgtgccattgcactccagcttgggtgacaagagcgaaactccatctcaaaaaaaaaaaaaaatgtaattgcaggtgagtgaacacggggatagtagggtagcttgattgctgttcaaagggaaagagatggggaggatatgaaactctgagggcagatgggcatatatctgctgcagcatgtatgttctgggaacatgtgtgtatgtaccagtgtgggttcagggcattcattggcaaccccaagatctaaaacagctcctttttgtccattaaacatagcagatgggaaatgtaaagatacagaataaatggaggtgaaatgtatgccgtaggtttggtttttgagttattaatgtgctacttggggctacttcaaaaaatgaatattagaggagtatttgggggtaagttcacattttatgcaaattgactctaaggcctctaggtaggttgtccttctgaaatggttaagtcttatccagcttcaagatctgggcataggggtatgccccatttagaattagggaaaagaatctgagtcatgcagcctagcttcactttatattaactctgggaaaagttaggaaagttgggtaacctctcaggtgctctgtttctcaatccatgtatggagataatgatacctgcaagttaattgggaaaactggtggtggagtcagtgcatcagtcagctagtgttgcgtaacaaagcactctaaaaacccagcagcttaaatccattgtttatgctcactcatgcttctgtggtggcttacctgggcttggttccttgctacagatttggtttaggtctgctccacatgttttcatttctgggcccagcctatggggcagtagctgcctgggggtgggcgggtgggagagggaagtcccatgatgatggcagaggtacgagaggacaggcagagacatacaatggcagtctgtcccttctgctcacattccactggccaatgcaagtcaatagtctaccccaaagtcacgggacaagaaaatacatgccactcatggtaggaggagtggcagagccacagagcaaaaagtgtggctgcagagaggggtgactaattcactctgtcacagtcatcaagtggccaacacagtacctggcacatagcagcagtcacttccacctctgttgttactattactactcaatgggcaagttgaaaaagaaagtttgtctgaaagtgactagaaagttcggtattaagagcatgtgtgtgtattcaataaaataggtttcaactgaagtgtgataatgttaacaaatttactctttgttcacttctatggcccagttaactggcacagttcttgggatatggtaggtattcaataactatgctgtgattgatgaatggtcacttttaataatggtgatgcagcatgggatgacagaaaaagcgctgttcatccaacctgcccctatctcccatgtatcagccctggtctgggtttgaatcctggctctgccatttacaagttatatgaccttgggcaagcctcctgagttctctgagctgggcgagggtcctgggggtgttgccgtttctgcgtgctcacatagcagtcgtgtgcctggcacgtagttcatgctgaatggatcttggcatgtttctggaacttatgtgctgtgctcctcaccttctccccagcctctgtgttgtcccacagatggctgtgagtggctgatcggtggaagtgcagacgtgagtagcacttggcatgaggtgggccccagccccaccctctctccttggggtacactctggcaggcttcaccttcaccatcggctttgggctctgccatggccacatccttggctgtggctctcaccaccattttgggacactttacgggtcccgcttgaagccaatgggaggaaacctaatttcctgccacaggaaattgttctgctagggaagaatatatttaaggattaaaaccttctgtcagaggaacttgagggagttgctagagaaagacctttgggggtctctcatcaggaagccagtgggtgtgggagagatctcagtcataaatggggaggaggcccaacggcaggttcctgagactgtactcctaatgctagcagctggtcttgggctgggaggaagggctgggccagggagaagagtgggtcataaatagaccattttctgcaaccaagtatatttatggtaacatcagctcagaattaagacttatttattggatttacttaatgggcccagtgccctataaggcctgggagagtgtgttctggacacatcagctatattaaatccagcagctgaaactcccaattcactcttattactttggtaaggattgctacatattttgagtggggcagagggagaaagaaagaacaatgccagggctctgggcagcccagactccgaaccaagaggtgttgttgctgatgcgtaagaagtgaatgagatgtcttccctgtcgtgagtttgggaattgcatggcacagagaagcaggggcatggtccagatgacttttagaaaatactgccaagccagactggcggtcgtgtgctcacaagctggagagtgagaggtgcctgtctccttgctatcagaacccagcctgacagccaggagtcctggccacttggcatggccctgatacagactgctgtgtgatcctgcgacatgcactttgcctctccaaggtatgggtgtatggtgaggtgggaccattgtaagatgtgccttattatccacacggcattgtggtgagaatgatctgagataaggaacacagaagccttgtgaacattcaaagcaccagacagacatgaggactcactgtgaccctcctgactgtgcacccagatggccaaggcagggaaagagatgtgttgttgaggacctaccgtgttccttactttgccggccactatcatagtaagcaggcagtaatagttacatgacaatactgacaatagattcctgccactttctggaatatctttctgggtagtgtctgttcaaatcatatatctctttttttaaaaaaattggattgttaatactgagtgttcttactaatatttcattaaaaaaatttttttaatccctctgggggaaaagaatttttttttttttgagacagattctcactctgtcacccaggctggagtgctctggtgcaatcacagctcactgcagcctcaacctgctgggttcaagcaatcctcccatctcagcctcccgagttgctgggactataggcatgggtcaccacgcccagctaatttttatattttttgtagagatggggtttcaccatgttggccaggctggtcttgaattcctgggatcaagtgatccacctgccttggcttctcaaaatgctgggattacaagtgtgagccaccacgtccagtcagtgttttagatgaaaaatattaagaccaagacactaagtgatttttttcaactttgtacagttagcaagtactgaaccattatttaaactgaggcttattaagtccattgcctttttttggaatggtggtataatttataaataataagccttgcatatttaaagtgtgcagtatgacaaatgatgatatatgtatatacctatgaaaccaccatagcagtaagagaatatacataacctttacccccaaaaaagtttccaagtgcaccttggtaattgctccctccaatccctactccctccctgtaactccctctgtccccaggcaatgactgatccctgctttctgtcactagattaagattagtgtgccttttactttagtttaaattaccttataattttacacgaacagaatcatgcctggcttctttcacgcagcatcattaatttagattcattcatagcgttgcatgtatcagtagttgatccttttttgttactgagttgtatttctttgtatggatatgttatggctcattcatctgttaatacatgtggagtagttttcaatttggggctattacattcatgcacaagtctttggacataggcttttatttctcttgggtaaatactttgaagtggaatggtggatcatatggtaggcttatggttttttagctttttaagaaacttccaaatgtttgagggatgaatatcccaattacccagatttgatcattacacattgtatgcttgtatcaaaatatcgcaagtaccctataaatatgtatagctactgtgtatcccccaaaataaaatattttagaaaggaacttccaagctgttttccaaaatagttgtaccattttacatttgcaccagcagtggaagggagttccagttgttccacatccttgccaatacatggcatgatcaggctttttaattgtagccattctaataagtatgtagtcctatctcattgtagttttaatttgtgcttctctaatgatcaacattgtcaagcatcttttcatatgcttgttgtcttcatatctttctgggtagtgtctgttcaaatcatgtatctcttttttaaaagattgaattgttggctgggcgcagtggctcacgcctgtaatcccagtactttgggaggccgaggcaggcggatcacgaggtcaggagttcgagaccatcctggttaacacatgaaaccccgtctctactaaaaatacgaaaaattagccgggcgcggtgccaggcgcctgtagtcccagttgctcgggaggctgaggcaggagaatggcgtgaccccaggaggtggagcttgcagtaagccaaggttgtgccactgcactccagcctgggcgacagagcgagactccatctcaaaaaaaaaaaaaaaaaaaaaaaaaaaaaaaaaaaaaaaaaagaagattgaattgttaatattgagttttcagagttctagaaacaggtctattatcaaatatacgctttgcaaatattttctcttagttagtgcttgcctttttattcctttaacagtgtctttcaaagaccagaggcttaaatcttgatgcggtctgattttttttttattattattaagtgctttttggtgtggtatctgagaaatcattgtctatcccaaaaagtcacaaagattttctcctgttttcttctagacattttagagtttaagtttcacttcagtttgtttttgtatagggttacaatgtgtagtttgaagattatcttttttacatatccagttgttacatcaccatttgttgaagactgtccttgctccactaaattgtctttggacctttgttgaagccagtcgtccatatatatgtaactatttctggactctgttaggttccattgatccgtttgtcagtccttgtgccattaccatactgccttgattattgtagctcccttgtttttaaaagtttaattaatatccaagtgattcatgtatgattaatattactactaaggcaagagggccacccacttctatcacctagatggagcttacctccacagccccattctcccccgctgctggcatgagcttttctccaaggccttctcttgcagaggaggctatgatgtccagctggcccttttttgggagttttgtcaaacaccgaagagcaaatacggccacttccctaatctgtgggcacccagtggctttgcaggagaaggagaacagctgaataattctctattcccactcaccacttcccactctcccttttactcctgttcaacctccagctcaccctacttatccagggctgggtttggggagtatctgctgtgatagagaataataacgctaatttgtgggtgtttatgaagcactttcaaatggaaaccaagcttcaggaggtcggggggcagaataccccattttatagatgagaaaactgagtgtcctaggaagctcatgagctgcccagtgtctcccagctaggagagtagaaccctcctttaccccaggtcttatggctccacatccgccagtcctccttttatacctcagggacgagtcccaggctgtcttctcgatctgcctggtaattactgtttttcagctgtagggcttccttgttctggggccccaagggaggaaggtaattacatccttcaagatgcccttagtcagcagctccaggtcagttcctgtgaccaagcccagctatgacctttgtctgtcctttccccttcccaggccagtggcttggagagtgtgattggatccctctgtttctctctttggttggtgctgttggtggcatctggccagcccttccttcacagagtgcccatgaattctctgtattcaggcaaatgggtgccctcggtcataagaaggcacagagggaaagcttgcaaatgtctcactgccagccctgccagctattagaaaaattatggcactgactggcagggtcctaggatgggcctccttgaagaaaaagcagtcctgcctcttaatagggtacctgtgactcatgagcatccatctcatctgctccccacttctatccctgctacccgcaatctgttggtcacacgtagccagagttccacagggcctgtctctttcacacgtatgcacagcccacttacacatctcagaggctacatactgcttttagaaaacaggagaagcctttatcatggcctttggggccctgcagagtacccctgcctgcctccccggcctcgtctcaagccagctctctctcatgatcccctctccagtccttctggccttcattctgttcttccgacctcaccatgttttccactttccacagggcctttgtgtgtgcctttccctctgcttgtactgcccttctcccgcacccctttgcctggttagttcttacttaccctttaggccttcaggtcaaccatcacctcctctgagatgccctgtccagtccttcagcaaagtggggtgccatggtcatacactcttggggttccttgttattttcgttcaggacactttcattgtgtgtaattgtaggtttctgtgatgatgatgatgatgatgatgatgatgatgatgatgatgatttgaaacggagtcttgctctgtcgcccaggctggagtgcagtggcacaatcttggctcactgcaacctccccctcccaggttcaagtgattctcctgcctcagcctcctgagtagctgggattacaggcgcccgccaccatgcctggctgatttttgtacttttagtagagacagggtttcaccatgttggccaggctggttttgaactcctggcctcaagcgatccacccgcctcggcctcccaaagtggttttggtgattatttgattaatgccggtcttgcccagtggaatggagggtccctgcagacagggaccactttgctggccttttctcatagtgaagtctctttccttaccactgtatccttagtgtcacacataataggtgctcattaaatatgtgttaaataagggactccattttagtggcacctcctcacctgtctaataccagacactatctgaagttttacgtccctccagaagccttctgcctcccagccttgcctgtagctgacaatgcttttgccgccccaagctccccagtcctttcctgtaagccacccagactctcatcatccagatcacctggggatttcacaaagggaaagattctgatttagtaggttggggtaggcgctgagaatgtacatttttaacaaacttccctgaacctctgctgctggtcagggaccacactttggcctggcttgagaggtaagggcaccgggtcatagctgcttggccaaatcaccatagaagacatggttcacacagggtcatggcactggccaattgtaagtaggcacagtagtgtgcccctgcagtcccagctacttgggaagctgagctgggaggatcacttgagcctgggaggcggaggttgcagtgagccgagatcatgccactgcactccagcctgagtgacagagcaacaccctgtatcaaaagtaaaaaaaaaaaaaaaaaaaaaaaaatccctttaatttccgtctttcactccctgctcaccacaaataactaaaaaagaaaggaggggccaggcacggtggttcacgcctgaaatcccagcactttgggaggctgaggcgggcagatcacgaggttaggagatcgagaccatcctggctcacacagtgaaaccacgtctctactaaaaatacaaaaacaaaattagctgggcgtagtggcgggtgcctgtggtcccagctactcaggaggctgaggcgggagaatggcatgaacccgggaggcagagcttgcagtgagccgagatggcgccactacactccagcctgggcaacagagcgagactccgtctcagaaaaaaaaaaaaaaaaaaaaaaaaaaaaagaggaggaaaggcaagttttctttttttcccctgactttctaatgtgcaagggaagacctgagtgaatgaggggagacagcctttgtactttgtcactcttctttggatcactgtagtcctcatatctgtgcctaaagaactctcattgtcttccccagccctgtcccctctccacacctctgggctgagtaggaagccgatgagtggctcctggaccttttccaagcacaactgaagtgactgaagtgcgggcccttcccatggaatgccactccctgaagagcagtacaaagttggggaacccaccggggactggtgggtgaggcccgctctgccagctgggagtcctcacggggcctttgttgtcttctcctgagatccctcccagcactctcagctagcagtgctctgatctcctggacctctggatctgggagaaatgaggggagagagagctttccaagtgtctgaaagtaggaggccggactctgcagaaagcaagcacaatccacatttccctctctttctgcccctccccgtcctggcaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccaggtatgctgcctggcctgcctgtggggacagcaggtgccaggggtcatcacctctccccggctccccatccccccgagggtctgcggtgcacttgggggtgcggggactttggtgctggtctggcatcgacactgagccacctctgctctgtctcccccggacagttctacctcctgtgttggtgccacgccacacagagatcccggccgagttccccccactggacgactacagccattccatccccgaaaacactaacttccccgcaggcatcgagccccagagcaatattccaggtaggcacgtgggcggcacaggctggcctgggaggcaggggcagcggtcagccccgacatcagtcctgtggccccaatctctgccccctggccgtcccccgctcaccccctctttgcgcacagctctggcctgagggcccctgactcagaaccgcatccctgttgggagaggacccatgacctcagctcccccctcactagtgatgcttttcttggcatagaggagcagcgtgacccttccgcccggccttggtgcagtcatttattttggaagcggaaatagcaacactgtttctctcaccgcccttgaggcccggactggtgttcagtcccaatagactgggggtctgcagaggcggggagtgagctgagggccaggcagcaagtgcggagagctggctctgtaaattcgcctgggcatcaggcctcggtgaggggctccaacctgggtgggaattgaagtgactttgagttttcactctgcagggagaaatgggctttgccgtcaaagactgcaaatgtttttagaagcccctcatttacatgcaaataacgtgtgaatcaccagcactttcagactccaggaaagctgtgcttggcagcacttgggctagtcacttttgcttgctggggcagtaatcctgctgcgttcctcttagagcattctaatttggacgtgacgttcatcctgggttagtttactgggctgagattggctacaggcctgtgtgcttgggtcagagtgttaaggaggagacccactgtccaaccttctcagatcctttgcgggtagccctggcgtcccgcgggtaagtcaactactccctgttcaaagagcaaatcttggagggcttcagtcagggtctgggggaggtttcagagaaatagatcacactgtctttgccgtcattgaacttgcaacctaactgctgagtgaggacacgtcccttagagacaacaaataataacacctggtctgcacagaagaagatagtagggaccaaagggtgggtctgagcctgcagatcttcagaggacagaaaggggtgaggcggaggcaagtctggacgcctccctggagggggtggggcttaaccctcaccttgaaggaccaggataagttagcctggcagaggctctaggagtacacatttcagacttgggagttgatccggtcctgcgtgagcaaaggcagttatgatccaagcgggagtcagaggtggacaggggcgaggacaacagaaccaagagctggaacctctactccaagacctggagctcctacagccacggatgctagcatcatggtgtgcatgtgtgatgtctttgcaaaaggtgtctcagagccaagctgtgaaggccttttaacagaccaccttccttctgattcccagagaccccaccccctggctacctgagtgaagatggagaaaccagtgaccaccagatgaaccacagcatggacgcaggtcagtcatgcagggtcatgctcttattcttaactgattagcagctggtgggttcatcccttccatcccttcctcttcgccctctccctccctcccttctatctctctctccagtatttgtagagcaaccgcgatgtgcaaggggcagggcatagaagagggtccgagctgctcacagatgatgggggagattgacaggacagtcagtagtcactgggccatctcgtgtatgccctgatggaagatgccgcatggcaccaggcacacagcagggccacttcacccggtctggggaggagcagcaccttgcagtccaggtttttccccaggttgagtcttggtgatgtgtaagtgttagccaagctgttagagtgggcaaggggtgtgccaggcagagtcatgggggttgggcaggacagcctggtgcattctggggacagtaagagctcagtgtgtctggagtccagagagtgtctagcccagggagctcagcgtggctggaggatacactctctccagtggggagaagatgggagggcctgccacacaggggtcccagtgtggtggaccttcaagctagccagaccacttggcatttagtcagggctgatgggaaccgctgcaggctgtaagcagggcctgtgccttagtgagatgtcaccagcagcagggtagagagtggccttgatcacctcaagcagtcacatgggaggcaaggagaggctgaatggaactaatgcctcttctgatgaccagtggagacccctgaagccagtatttttgtgtgacaaccacatgtgatgtgtgtgctcctgccgtgaggggcagggcttatttctctcctgctacatctccagatgtttcccatatcatttgttataggaccaaattggctccagaccagcagcttcttgaattgaaccccagctgccacatagaatgtgtactgagttgtgtgtggttgggagaggaggagaaggggagagggaaccacgcagatgttccattccgatggtggtgggcatgcctcgtacacacagagccgctagacacagcagagccacctgccctcgcacacagcccagaagagattgtgcaattccttcccccacctttcccagacagagtctccctctgttgcccaggctggcgtgtagtagcgcgatctcagcttactgcaacctctgcctcctgggttcaagctattatcctgcctcagcctcccaagtagctgggattacaggcaatgcagcaccacgcccggctcatttgtgtatttttagtagagacagggtttcgccatgttggctaggctggtctcaaactcctgacctcaggtgatctgcccgcttcgacctcccaaagtgctgggattacaccgcacctggctgaggttgtgcaattcctgagagaccgaaagagactcgcatgtacattgtagttgctgaaatccagcctggacatcgtggcacttttgggttgagcacacccggtgaaacacacccacccggcggagtgactagtagcgcgaaccagctggaatgcatcgaagaccttcctgtatccgatgccaagtgaccgctgcaagcttgcagctattcagtgcaggcgtgggaagcaggccagcggagcagcatgtctccagctgctgtgtttcttcccactctgcgctccctcttccctttctgctgctctccatatttgcacaatgattattgttacaaacaaacatggaccagaggggctggagattggaaagagcagcccagatttcaccctgtcagctcttgtttcttctccctcctcttcctccttgtgcctccctttactctgtcccctctcccttcttcctttcttctcattaagtgtgcctgcagggtcctgttgtgaacatgagtgatttatctacagtagagacagaccagacttgcggaccccagccagtgtgtgggtgggggctctcctgttttagtctctgttcttcagagttgcctgcttggatagtccagttgctcacgggcttggcttccctgccccccagggtgtggtagtgtctcgggccagagggtcacgttgttccccatgtcccttcacctacatatgcgcccttttagacttgtgagaaggccccttggacttcctaggtctttgtggttcaggccagcacaaaacaggggacaagcatttatccagtgcctaccatgtagcggtcatggtgtaagcatttttatatgcacagtcttacttaatttttacatgtcacacagtagatgatattatcctcattttatacctgaggaaaaaattaaggctcatagaagttaaacggcttagccaaactcacgtagctgattcgtggggttgtctagaccctgtgactgattctgtaacttagttctctcggtgaatattccacatccccctttgcatttggggttacaggggagaaggagaaatccgtggttcttcccttgccctcaaggaggttacagctgagttggggcaaaagaagagattcccacaaacagcgcaaggcagcattcacttgaggccagatgctggacccagtctcaggactgatagatttcatggggtggaattagaccccatagggtggttaacaaatagtctccttttttatttttattttttgaaacagtctcactgctgcccaggctggtgtgcagtggtgcaaacacagctcgctgcagcctccatctcctaggctcaagtaattgtccagcctcagccttcaccacttacggcttatttttttttttttttttttctgtagagacagggtctccctatatcacccaggctggtctcaaactcctgggctcaagtgatcccccagtctcagcctctcaaagtgctgggattacagatgtgagccattgcacccggcctccgcagccttcttgatagaggaacagaggagcggggacgagcaggatgctgctctggaaaagtgtccactgttttatttttgaaggctgataccatgtgagttctttttttctggaggtgagaggtgtagagaacataatagagtaagaattgggtagattgagactttttcccacgtgcatcatcatcttttgcataaagtgtttgtctggttgctgagttgcagggtttctgaggcaggtttgtgagtttcctgaaattgatctttccagcacctgagctgctgcagcctctgaccaaggtcggtggctggtgatgctggggaggcctcaagccctgcctgtgtgggagggctggcctcctgcttcctgggtctttgcagcttgggagaagggcttccctgctcctctcattttcctgagggcatagttaatagggcaggtggtgtaagctaaagaaaaaatgtgtcacttattctagttgagaatttagcagccctgagctgggagtcttggttaggatcataaaactatctgagacctctgagatcataatcataagagacctctgagatcatccactcaatgcattcattccagacaagaaattggggcccagggagggaaagtagaggcaagggtatgggctaggccttctcctgggacccctcagtccagggttttctttctgctgtgttgggctacccctccttgatatgtaagtgtttagtaacttggctctccaggccaagaatcttttgtgaagtctcacaacttgtctcacctcgcaggttctccaaacctatccccgaatccgatgtccccagcacataataacttgggtgagtatctccttgtgcacacaactggaaccccctctagctgcagccctggcgagtcgccagtgtggggagggggccctgaaggtaaggctctcccccgacccctaccatcagcccagctcagcccatcaggtttctggttacggtgatgttgaggtcaccacggaatggggaaacttgagaacagtggtggcaggaaagacaaccatatgccaggtttgtatttcccctggggggcgggtagacgtgagtgaatgaaaattcccccaaactttatgcccaggagaacgagggtctgtggtcagctaagcatacgtgtgcagtttggtgcaaagccacggacagccatgcagactccagccccctgacatttatagacctgtttcagatatacttatttgagtgtttcatcttataattgtgtaatttttcttaaaatagcaacatatacggaatttgaaaataaagtcaaagtgcccataatcccaccaccctaacataactgtctatgtgtgattacagtcctgatgtttgtgcatcaggcatatatatctctgtgccttgccactgagatcatagtgcatatctggtgttttcattctcttttctccttatgttattttgtaaacacgtttccgtatttaggtgtcttgtttatcgttgtgtgttatctcatgatgttttggagtggagggtccattgtttccgcaacatccctccatggttagactgctgggtcagtttttccaagactcaattttctaacccagtagggtccttcagttctccagcttgggataggctttggcatggaacctgccaaagggcttcaaacaaatgaaatatccatttagtttttattgaggggagatttttatattctggtctggtagttttagaaaatgtaagttggattttgtttggaactttattgctgaggcttaatttgtggctcaggaaaagaaatagttaatatttcttggcgaatcaaagtggattggactggtttttgtgcccatttgcttccagaccttgactgacagcgtcagatgaagaaactcatcatttggaatattaggagatgcttgaaaccctttagaacaggctgacctgggcagtgtgggatgtgactttgggagatctgttttaacatttttgtaaaataatatcaccatgagtgccgggctttgcagagggaaggtcagattcctgatatgaaaggactgagttattaaaaacaaactgaaggctagaagcgaagttaacacttgagaaattaaaggccatgatggtgaacttgactccgggctttcagcttttgagattggctgctttagatttattttctatggcatttaaaaaccctcctggggccaaggtagcacttttagtcaacagccttccaagcagacacttgcctttgaaaccatagcagtcccagggcaggttggaggtggctgatgccggacacggtgctccagactgaaaggtggtcatttgctgtgaacttccctctagattgtgtagactaggatgaggatgatgggatgtttcttgagctctgacccaaggcagcatcctctgttgacataattctccctccctactgccccttcctcgggcagcttgcctgaaagttgagaattcttaggttatttcttccaaagggaggaccctccccgagcctggccagcagagaatgagtgccactttgcactggcctagttgcacctctgctgggaagatgtgaatcgggggcgagtcgcccagtgagtcagggttaggcttctgggtaagacaccgtgctgacaggcctggcttcccctctgcttcatgagcccctgtgctccccttcacccattcaaaccattgacttcatccctacccagaaggtcacctggactcccagtgtcatagctggaagggggtgagatggtgatgatgatgggaaacatttcttgagagtttgctgtttactgttattcggagtgcttcctgcatgttaacctgatctttataactttataaggcagaagcgttgtgatttttcattttacagattaggaaaccggggaacacattggtgaactcatgtgtcccagattcacagctagtgaatggagaaggtggctttgaactcaggccctctcactccagagcgtgcactcccattgtggcatgacactgccttgctgggccgtttagaccacctgtccccaccttcctcacttggaggaacaaggctcagacaaggcatttgctgacttttacgttggagacgtaaaagtctgtggctgtggctcccggggggaagccctgcctgcttgtatgcctcttcctcactccctcattcccagatacttcttgtctgcctgccgttcaggtgggggattggaagagggaccacagacatagccatcgaggggctacggccttgttgggatcaataaggcaggaccaaaaatgattctaaaacaagaaggaggtgcagatgaagtactctgagggttcgagggatggagcgatgggattccaggctggccaggcgtctcctctgtatccatgcgctcagtcaacattggctgagttcccactatgtactgatgctgggggccagagctgggagagcactacacatttgcagcctgggggcggggaggggggcagctggaggtgtccatgtccacctgtaatgcgttgtgccaggtgcccagggagaaagtccagaagagggaggaatagtatatgccaaggaggaaagtgtggatggagtggggagacatgggagaggttgtgccatgtgtgagcgggcccttgaaggacagatgggaccctgtgaggcagagaaggatggaaggacattgcaggtccaagggcattatgtggtctgaggacagctggcatggtggttggttgttgtctcaagagggacaaggtgggaaaaggaggctgaaatggcaggtggggcactgggaaaagacccctgagtgtctgcttagcgccctcttgcctatagaataaagttgtttgtgggttttgattggggaggttttctgatgacagcttcataaagattaatctggccactgtgtggaatctaaattctaggggaaattactggaggcaaaacaaaacaaaacaaaacaaaaacccacttagacagctcttcctctggaggaggctgagataaatgctttcgagaaatggtagcagagctgggagaatgcatttgagagggaatcatgggcctgaatgagcagggtttgttgaccagcgttaagtgggatgatggtgatgcccccatcgaggctggacacccaggaagtggaatgggttgggggtgaaagatggtggtgggttgcctgtgcttaactatgtccaggaagcagttggaaagtcaggaaagcggctggcgctggaggcgcagatttggaaaccatgaacacatgtggcagcctttcccatagcggggcctgagagaaggggtttggtggttgaatgagtgtggaaagcctgtattgtggcctctcctccagcccccactcaggagggactcacatggccacgctctgaggagcctgcagaaggaggcctgtctgacccagccttcctcccatgcactgatcactgttcctgtacttctgtcttaccgccccattacccatccatagatctgactctggaaacaccgatgaagtttggctgaagtcatgccagtggatggatttagtggagaggccgacccagctcaagatggaaagacagccagagatgcgctcgggtggtgggggttccttggagaaggctgaggtcagggggatgatggggtcacagcagctcagaggggaggcaagccctgaaggacagtggctacaagcgggccctgcagagatgcaaaatgagatttaagaagaggccttggatttggcatcagggtttcaagggggagcttttagggagcagtgtgtaggaggggaggggctgcagtcagtcagcagtgcactgaagggcaagtaccaggtggggaggtggaggcacccagcagcgcagcctttgtgctgactcacagtcagtgcgtcccaaaccctaggatggaggcaagcacacagggagctcttcctaggaaaaaatggggacatctcaggacatctgattatttcctttaaagagattattatgaaattactgtacaaaaagaaagaaagcagaggacatctggtttctcctttcatttcctccccactccaggtgttagccccagggctcaggtctggggaaggttgagcctccttgccccagcaaagccacttctggtaaggggcagggactcctggttgagacctggctcagcatcctgccccaggcaggctctcggagaccctgggacctgggaccgttgtttgcagggcaggagatatgagcaggtgatgttcctgttattacacagcgtgctgggtgagtcaccgggaatttcctaggcatttaaggcggaaggattggggtaaatggaggggaaggaggaggcaggtggagagaggaaaaaggtagtgagctggcttctgcctggtgagtaagttgttccctgctttaaagtgagatgattagggcggagccatgactgaggaaaataatgtaccagggagagccctgagggagcagttgagctggagttaaaggaggtgatggcttccagagtgccagtggcaggagtgagaggcagggatggggcagcttggagtgagagggatagggcagcttggaggtggctgatgccggatgcagtgcttcagactgaaaggtggtcgtttgctgtgaattgccctctagattgtgtagactaggatgatgggatgtttcttgagcttggacccaaggcagcatctcctgttgacatagttctccctccctactgacgcttcctcaggcaccttgcctgagagttgagaattcttaggttatttcttccaaagggaggaccctccccccagggtgccactttgcactggcctagttgcacctctgctgggaaggtgtgaatcgggggcaagttgccccgtgagtcagggttaggattctgggtgagactccacgctgacaggcccggcttcccctctgcttcatgagcccctgtgcccatgtgtgagcacaggtgtggtggcagggcggcccgaagaccaccagccctgagtgtggacggcggcccagggcagaggcccaacccagttccaggcatcttcatgctgctgcccaaggctcttttacaatgcagcctctggctccggtcttccccacacttgtgaaatcacaggcagggtcttccccacacttgtgaaatcacaggcaggcaacataatgacaggaagtcagctgtcggctctgtcttcatactcctgagggcccggtttttagactttgccactgttcctggttgcagtatgctggtcataagctaaaagggcatgggggtctctgtgcagcttggtttggtattttagtccgcagatacataggttggaattagtaccctgggtgctgggacacagctggcgtgggctcacagagacctcatcctctagcataggagactcaggtacacagtttctgggacacaaggttaattctgcactgaggcagtgagggagtgtttcacagccgtgtgagctgggccttaaagatcgagtccctgcagaggagggggatgggcagtccaggcagaggacccaggcaggactgagaagtggtggatgaggaacatgggaactggagtgtggaatctcctagattgaggaagagctgccttccgcaggtgaggtgggcccagcagaaaccagcccatttctgttttgacctttcgtcttgcagcagcagtgctcctggcctttgcccgttccttgctttcgatttataggagaaagttaatttccccccttgcctccccacctcttcctttacgggatttgaatctcttgcacatgtttttaataggcatcccttaatccaagtgttgccttctgggttttattctgttttctttttcttaaacataatggaacgtctgtgccagcttggaacaggactgaaaactgaggccagccaatgcgttaggctggcagggggccagccatggattaagtgccctatggcacttgagaagtctggccgacaccacactggtgggggagggggatccacaaaggctggagctggaggttcctgcgtctccaacacctctgcactgggaggagagattagcacagactcagaaatctggccaggagcagggctgtttgaagggaaggccgtgggcacgtgccatcgtctaccaccccagctgtgcaaaatgctcagcctagaggtgaaactgctcttcaatggggtgtgtcaccttaccccccgtagtcattctcctagaggagccttctatagaactgcttctgcatttgttggtaaatccttgaaaccagatcttaatttgcttgcttgcttgatcagttgattgattggtcaggggaggggttgccacctccccctgagagatttcttttaagatttaatgccaggacaaactttgttttccctgaggaactagtaagcattgcccatccaccaaccagagccatagaccatgtcatgttccctttttgtcttgtctactaggaagctcagagccaaactggatgcttttgcagtaactataacctcatggttatcccatttatagccgccttctttccagagtcctttttgtttctctggtactaaccagggtaaggataagtactttgggaaagaaatgagggcatatttagtgttttgggtttttttttttttggtgtgtggcagagtcttgctctatcccccaggctggagtgcagtggcgtgatcttggctcactgcaacctctgcctcctgggttcaagtgattctcctgcctcagcctccagagtagctgggattacaggcacccgtcaccacacccagctaatttttgtatttttagtagagacggggtttcgccaggttggccaggctggtctcgaaatcctgacctcaagtgatctgcctgccttggcctcccaaagtgcttgggattacaggtatgaaccactgcatatggtctgtttttttgtttttttttttgttaaggaaaaatgtgccattgaaggcagaacccacaggtggtgaccatactttctggtctgccactcctcttgcacaagttctgggaggaagcagctgaggcatggtgggcgggagggacctagaaaggagggaaatcacggctggcttttagttgtttgcagagaatagaaagcgcatggctggggtgctgctctggctcagtcccgcttctgaacacagggcagcttgtccaaacagcactctctgaaatggcagcctgcagactttgccactggcctgatttcactgctccctcaaacaagcatcttcttaatgatgtgtcaggttcctagtgtccggggttttccacaacactgtccggtgtgtgtctgtgagttgcagggctgtttggataagggctcagatctgcttgggagggcctctcggcctatgaccccaggcctgtctttgattctgagggtccttgaagcccacccttccccagagcatggttctagcaccatgcgacacaatgggtggcctgccagctttttctttttttgaatggtgggctgggttgccgttcctgggagcctagctctttctcttctgcctggactaaacccagagaatgctgggcagggctttatgattttggggtgaggaccctgttctgttctacacattgctgagtaagtcagggccagtcaaagctatatgttcaagctgacccgtgccagagaatgatctaggtggtcagctttattgtagctttattgtcttctagtgtaccacagtgattgtacggactacaaaactgaggttacagaaggaggtcatgtccccaaggtcacacagcaggatcagcagagcctgcgcttgggcagtggtggccagcagcactgatacattgcttgaccactctgaatgcttgggttgcacttggattttttttttttaagtttccaaatcaacatagctcacattttagtgaccacattgtttagaatatagcttatctcattggaatgttgaagcatcaagcaaagccagagccagacgtggctgacgtggctcagcctcacctcaggggccagggcacaagccgcagctgctcctggccctgtcattcctcccttccccattaagtacttttgatgccttcatccttatcttcctttgctccaccccaggaagagagaaaacgacaagaatgctttgcctctccatcttgatggtgatcaagataggaccaggctattttcaagttcacagaatcgggctattatcattgttgttaacaccatgtgctgagtgtttgatgcgcgccctgcacctcacatgagttatctctgtctgtccagaaacagcgccgagagtaaagaggatgaggcccacagagtgtagctggtttgctcgcagttgcatgtctagtctgtgcctgagccaagattgacctccagtctgtctggaggatggctttatagcttgtgccccatgatccagttaaatatctagggcaatggttttcaactggaggccgttttgccccctagaagacatctggcaatatccgcagcctttttttattgccacaacttgagagggtgttatggatgtatactactagcacctagtgggtaggggccaggatgctgctaaacatcctgcaatctgcagatcctccctcccacccatccacccacccaacaaagaattatctggccccagatgtcagtagtgctgaagttgaaaaacctgacctagggtgtcctaatcctccagctgacacttcctgggtgtgtgtggagtgcaggggtgttactggcctgccccttcgccattcgtgatagtgttctccttgctcttagaaaggatcatgcacctagactccaaaaggggattgggacactctgtcctgcaggggcaaccagaccccttccagtgggcagaacagcttctgacttttctctcttgggctttacacaccttcagaaggtctgatgagcagggatcctcccagtgggttccccctcctagacgttgcctggcatccagtgagcagggttctcaggccagggctgagacgtgggcatggggagcgtctcctgttcctccctgaggaggaaccctcagccccatgctgagggttaaagcgagggaggagagatgtcagcctgggccctgggacctcatggtcaagttggacagtcaggatgctcacagagaggcacacccttagtaactgcgtcgcttcgggtatatttaagagccagagggacttcagaggcaggctgaagctttgagatggaagagcgagaatgagcaggggactccctaattcttcagcagatggatggaattcaggtaggcatcaagcagagtgtcgtaggctaagggctcgcgcccagcagtcagtgcagtgcagagaagcagttggaagaggttggcccagggcgcagggcagtcctggtccagaggctgtggcatcggtgtgagtgggaattccgagggcccggccaagggctgagagaatgggcctggagatgctgcagaggcgtgcagtaggagggcacagtgccagggccactgggccggggcaagaggagggcgaggaggccccaggaaatggaaggctgggatccatttctagtgtgaggagaagctgccatttactcttctgagaaagagaaccagccccttgtagaatggcagttttgctttgaggagcccctaatggagactgtacagacaactgggacaaatacagattttctttcagaagggtttgtgtccgagccaccccaacagccggcatctagataagtgtggaaaatagtttctgtgataggaggcatggccccaggctcagtctgcagatgatgcctggtgtgtccactgcgccaacatggggcgctgttgggaacccactcggctgctgcaggcttggaagctgctgctccacaggctgggagtttttgcccccaaggctgtgcagagccaaaatctgaaagcccttttaggggcagggattaatgtgggttactctggggaccttgcaacagaggctgagaggtgactgtgcaggaggtgtggcctgccccacagtgagtacacgcagtggctgtcccaggttcatccaggtactgggtggcccctggtcctcttcaggtttggcccagcccctccttgaagactccttccatccagtcaaggccaagcaggcggggcagggcctttatgagctaaataaataaataaataaataaataaataaataaaaagagaaatcaatggccctttacacacaaggctgatggaatctcctccagacacctgagcatcttgttctggtggctcttgccagttttatacgataaaaggcatggggtagggagattataatccctctgaaatgcggggaaatggttttccagagtgtccatgggaccccatcgagggagcatggggcttgggacacccaatgacccagtagcccaccctgtgtccacagacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggtatggggtggctccattccccgcccccccaccctgcccctgccactctatcccacccccagccccaggcctgaacacacagcctctgaagggaaccttgcgtccatccttagctgtgctctgcctcctgctgggcatgggggaagactcactgccccagcaagtcccctacactctctgttgccctgtttaggggccagacaggtagtgttcaggccacttgatcattcccactcaaagatataatctcagaaaatctggaagccacagaggaaaatagttcatctaagggatcaagaagggaacgtctatgagaaaggcaacatatgaaatctattttttttttttttttggagacagagtcttgctttatccaggctggagtgcaatggcacaatcttgcctcactgcaacctctgcctcctgggttcaagcgattctcctgcctcagcttcccaagtagctgggattacaggcacccaaccaccacgcccagctaatttttgtgtttttagtagagacggggtttctccatgttggccaggctggtctcgaactcctgacctcaggtgatccacctgccttggcctcccaaagtgctgggattacaggcgtgagccaccgtgcctggctgaaatcctctaaataaaaatactctgaaagtacagatggataggttgataagtaggcagtcattgttggaagagtgatcttctcttattttcatgtatcattattctaaacaatttagaaaaggtagaaaagaattgtccactatccaaacaccactactgtgaaccttctgccttctagcccccagaacataagtaaaagatgactttgtgagtttaaggaagatgaagctgtgttacgcatcacttggtttgcttatgaagttatcaagcttagaggattttacgatccagaatcacaactgtcagaacttagaagggctgtagagagatggcagagtgaggttttctcagaccttgtcctggagccccaagggttggcaaagggttcctgcggcaaactcaggaggtgggcaggttagcaaagggaagcctggtcccacgtgaaccagggcacctctgcactcgcttgctttatatctcgggctctcacagaagacttcatttgaagagaggattgattctgtagtgaagagaagaaaagtttggaggccatgggcctaggtctgtgctctcattttctaggaaagggacctgatgtctagggggttggggagggtagggaacggctctgcagagacctcattgtcagtgacagacagccaccactaccagacctgttgttcccatttcgctttttgttttttacttcaaaaaagatacttattctgggtggcataccactgtttgattgattgattgatttagagatagggtcttgctatgttgcccaggcccagtcgcaaactcttgggctcaagctatcctcccatctcagcctcctgattagctgggacaataggcatataccactgcaactggcttttttctatattttattaaaaaaaaaaaaaaatatatatatatatatatatatatatatatattttttttttttttttttttggagcggggagaccaagtctcgctcttgtctcccaggctggagtgcgatggcacaatcttggctcactgcaacctccacctcccaggttcaagtgattctcctgcttcagcctcctgagtagctgggattacaggcatgtgccaccacacctggctaattttttgtatttttagtagatatggggattcaccacgttggccaggctagtctcgaactcctgacctcaggtgatctgcccgcctcagcctcccaaggtactgggattacaggtgtgagccaccatgcccggcctatttttttaagttactgaaacgaaacaaacatttttggtctgggtcttcgcatccccacctctgccttctgctcttactgacatgatacagttgtggacagccaggaagtcatccctcctgtggactctgagccaccagcaccctgcagaactaaagccagaaaaaatggggagtggttggaggaaggggacagtagtgggaataggaggcaggacaggggacatccagtgatgcatgggtcggtcacctcgtgttcatcctaccggatgctgggcctgtaatatctggctccgtgttctgacctctgagcttcttccccaggaatggagcagagactttgccatgcaggagaagggaccatcccctggccgagcaaagagctcattgtcagagtttacgcaactgtttgagttgcagagccaatttaaaaataatttctgtccatctggagtggatttaagagatgaaagaaaagtaaatgatataaacctctggaatgttttagaaaaatgcattgagggaagaaaaaaataagggcatagcgttaaaccatccctgcaataaagggctccttggggtgtctgctgcatcagaaggagccctgcaggtttactgaatgaatctctgaatcttggagtgtgaagagaccaaataatagtggggtagtagtagcagtagcagcaagaaaagctgacaccaggcacttactgtgtgtctcacagtaatcctgcaagggtagaggttatcatcattccctttttttttttttttttggagttagggtctcactctgtctcccaggctggagtgcagtggtgtgatgggagctcacggcagtcttgaacccctgggctcaagcaatccactcacctcagcctcccaagcagctaggactacaaggatatgccactatgcccagttaattaaaaaaaaaatgtttttgtagagatgaagtctcattacattgcccaggctggccttgaactcctggcctcaagtgatcctcccaccttgccctcctaaagctctgggattattggtgtgagccaccgcgcctggcccccatccctatcgtagagacaaacgaagactcagagggtgaataacttgactgaggcccatgcctactcagtggcaaaggctgtcactgagacctatcctgtgtgcccatctcttgtcatctgcctcccttggctttaggaatccggcagtgcccatttcccctactttaggcttgggctttggggcccgtttgcctggggaagctggcagtcactgggagcagctctgctgttctgcctcctttgcgagcctcaggtggccccagggccattgtgtgtgagcaaaggcaccctgtccagtctaacctgaatctctgtaggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggtaaacgagccgcacaggcacccctgccttgaggtccctctccgagtgcatgcctaggatgctggagagagtccacctttctcaccttttctgctcactcatgattgcgttgtcaatctggaggtgattggattaggttttctctatgcccacagatctaactgtgctttccctgaacttccagggagcagatgtagcatctgataggtctgcctttaacctgtgggtacctgcctgttgccctgtgcgtagatgctcaggcagtatggcttcctttcttcactcattcattgcacaaacagcatgcagggctctgtgccaggtgctgtaggggatgaagaggtagatgcggccctgctctgcccccgcagaccttacaggcctgcagagcacagaagacaaagacacggatgagttcaatataagggacgggtgccaagcaccaagccagcagcccaggtagagagaaggcccatttagctgttgggatggatcagggaagtcttcatggaggagaaacatccggatcctgaaggataggtaggcactaggcacagggagggcattctagacagggggagcagcccaggcaaagggcctgaggtaatggagggcaggacatggatgggtagctctctggctggaggagggtcatgtatgagaccgtcaggggaaatgtttcaaaagcacaacagcatgaggccgtggaaggacaccagagagtttgactctagggaactgctgagggttttctgagtgagcctgaaaaatcccacctgtaccccaagaagaggtgtcaggctgcacccccgagagtggtttggacagggccacgcctggacagcaagatcaggcaggtggctgatcccatctaaggcctctttcctcaggaaaccaaggcagaaagccccagccaaagtccacttttcacaggacgtgcagccactgtgtaggcagcccacagaacatggcctgtgacagactagtggagcaggtaacctggccaggccattgcctgtggcacgtgtgtggcatgccccttcctgcccactgagtagcagatggtagtggagaagtggtagaccacaggcaggggaaactttagaatgcagaaagtctgaaatgataatagcacaccaggtttccagagcattttgtggttgcatttatagagtacattccgatcgttgacctcatttagtcctcaccagttattctctggctctataagtaaggagacgctttgagagacaagttcagagagtttcagccacctgcccaagcgcacacagctagtaagtggccaagccgggatggggcctagggctgatggactctcaagtttggtgctcttctgcttcttggctctgctgggggtcagggcccaggttcagccctgttccaccacccttgtccttggagagaatgaagaagaggaagctcagtgacgctcttggccttctgcctcttccattccccggccccacccccatcttttgggtgagggctgagttggctgtggtgttgtttgtcagctcatagaatgtcagagctggaaggacctctgaggccagcccttcattatacagagacacagggtccccaagagaaagcgaccagctcagagtcacacagcaagaacaggagcctgctgttggctcattcataagcgtcaccccggctcaccttttggctatttccagcatgtgcttttgtctttatttttctggttgacacattcctggcactcaggcagtaagacttcaaacgacatttattttaaactttatttgtgactgtctttagttttactgtctggagaatcagatgcacaccttcacttagctgtgaatgtcacctccacccagcccagtgcccagaggccaaaatttggcccagatctctccttacctcctagccccagcaccaggtgtattcatcagaggagcccaggtggagggtgcactgggccctctgccaagcttcctgtggggacggcaggcccagtagcctttcggccagcccgtctctgggggcactgcctgctgtggaacggccagagctcctgttcctaggtgggtgaccagaccccacacagcatgggcaacctggcccaggtcccttatctctctgtcccctggtccctttgcccaaggaaaggcccccctctccacaccatctccctatttttggaagccctctttgcagacttctccctgctctgggagtcggagcttgtgggccagccttccatctccccttgcaggtatgtcagtggcacctcccagtgaggagatgggttcaaggggagggactgggttggccttccctttgcatggtactgagtgtggagtgtgtggcaaatgcatcacacaccatgtgtccctggagctgtataaatgaggctggtctagggggtccaggacttgctttatccaggaggggagcaacggacctggccacttccatccccacagccctgtttctgtgtttttggcaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggtcagttatgggtgctgcctacatcaggggacccaactccaggtgactctggacagcagagcaggcagggctcctcagagatgagctaggccagccctagcgtcaagagcagaaagaccaaagatcagagagaggccaaggcctggcaggcaggaggggccgggccaacagcagatgatgaggaattgcagaacgatgtttgctggcaccgaacagctgtaggcactgtaaacacacgctccatcttatcctcatcccagccctgggtggggatgccagcatcatccgtacagatgagagaactaaggcccagggagggagagtgacttgcctgcagtcacactggtagaagagctgtgtctagaactctgccctcttggcttcttccttagtctcattttaggcagatggctttaggatgaccctcttcaggaagttaggtcttcagctcattgttcctctcctcctctgttgctccatttctgactcagggaccctggtgatgctgaggagcccaggatattaaaactgagagtccgggaagggaggaggagatttgggtagttataaaggaacaaaattttctcgctgagaaatgacttttttagagtcctacatactggtttctttttctttttctttttttttttttttttttttgagatggagtctcactctgtcatccaagctgaagtgagtggcaccatcttggcttactgcaatctctgcctccaggacgtgcctcagcctcccaagtagctgggactacaggtgcgtgctaccacgcctggctaattttttgtattttagtagagagggggtttcaccatgttgcccagggtggtctcgaactcctgagctcaggtgacccacctgcctcagcctcccaaagtgctgggattacaggcgtgaaccaccatgcccggccctagatactggtttaaacatggccctgatatagtcaggtctacctggtctgcttggttgaatctctcaggccatcctgctttgggtttagagaatccagtcccttttctttccactcacggaccaaagtttgcggagaggcagggctgtgtgcccccgccttctgctccacactcccccctgccagccgccagctcctgcggcagatgcagaggtgcccacatgtcagctagagccagcgccttgcaagctactctccctttctcttcatttttccagatgtttggaatccattttgttttgcagtcatgctgcactcaggccaaacccatttcaatattggccttgggccaccgtttgtaatgaaatccagatgagcatgacttatggaaagtcagattctcattagaggatttcatcctgtaaaatcctcctcttccacttaccgtattttagctgctgttcttctgtgtctgccccagggtgtcagggaacacagccccttggtttcttgggtgtctctgaaatccaggagtgaccagtggagcaatcaaagtggtcagacctcaaaagaacttacaactatgttatggcctgaagagatcagcccaggcccaaaggtctagccagagaaatgttttaagcaatcttttagccctggcttagctcatttagggaacaggagtgaaaggttagaaaattaatctttttttagtgaagaagggaaatatttaaagatggactgcagtggaaaagagtaaggggatgtccatttgctcttcttataccagactgtagtctggagggccacactcaggtaccctcgctcgtgcagacaccccagggtctgtctgcaggcccatttctcaacctccctgctacacaagcaaagtagaggccaagcaaggagggtggtgccttcaagacagcaacactgttcctggtgtggcattgcagctctcccgctccaagtgctaggaagaggctctttggtggcagagcctttccctggggacactatcaccacgcgggatgtcctgccagcacacccagtcctctgtggcccaccgcgtcaccgctgcctggcagcactgcacagcagcctgacgggcgggcgcggccccttcccagaacagccttgtcgtcctcctgcctcttgggccaaggagagtaaggtttcagctcttctctctgtgaggtggctgaaagcagggcccagggcccacacctctcacctccagctggcaccagcgactccagcctcagcagatagcctttgctcagtggaggcctttgggagcctgcctgcaagctgcgtcatcaaccagcctgaatttagacaaagtgctttggggaaaagaaacgtgtggtgtgccttgtttttttccagtaattgttccatggctcgttctgcttgtaagattttccaaaataaggccgtagatgagaattatatcagcacattgggaaccgaaggcatgcggacactgttggcgctttgtaaaaaacacccctcaatcagacagacacacgtcatcgtcgcctgctggggctgggcccagatttcgagataggggagcggcacgtgcccgtttggtacagatgggagccaggaagccctttgctcaggatggaggtctcctctattagggggcctgttacagtaactggtgggcctctggggtaccctgcaattgactttacatatttaactctttgccattgactttacatgtttaactctttaaagtcgacttccttccccctcaagagaacttaatttactcaaagtcctccctgggtagaggagtttggccgggtagtttcagcaagttactggtaccgcttctaggacagcgtctaacagcatctttgggaagatgactgtcaccaaagcagaaaaagctttctgacttgtgtaaccccctggagattttttaagtcccccaccccacccctttccctatttcttacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 99 - DNA, 54830 bp, Homo sapiens
atgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggtaaccgcgccatgtcccctccccttcccccggccgggcccgcgcaccccgcctgtggcttccccgccccggggcgggctcccgacgacggcggcggcggcggcggcggctgggagcgcgcggaatcctctgggagggcgaccgcggcggcctgacgagccgggccgggcgggccggctgaatgccgggcggcggtgcctcgcgtccctcgggcccccagctccgcttgcagctcgtgggagaatcaagttaaactcggacgggactcctgccgcggccgccgctcctctttgttgttctcagtagtttcacggtcgccccggctgagcgcgttgggtcggctggaatgtgttgccttagggtctaagtgaaagttgtaaattgtttgtctaaatttattttctccagccaatttctgttttgtctttgtcccctactttctcttcctagtcttgtcatgccagtttacgcttctggctttgatatgtttactttttgagtactgagagtgacagcggtatgcaggacacattcttagcacctaactgaacccctccttgcccccaataaaacatgcttcctaataaaagacacagctgatcttactgttagcactgcatgtactgacagtgaaattggtgtagggtggagggcggtggctccatcacttgtcccaaactgctgttaggatttctcaaactagattttcaaagacacaagtgtgtttagttaacctgaaaggtttatttgctggtgcagaggctttaaaaagccctgttgaagattgatagctgtttcccttcaaaaacctaagtacgtttgtttttatttaaaaaaacacatttatttcccaattagtttcttaatgcatttagtttttgcaccgtagtttaaggtggaattgccagttatttaggaataataaacacaacaggataatagcggaattaccctgaattgactttctgcaaacatataatcttagctaatttttgttagtaacctttgacttttgccagaattagcatccttctagtcttagtagcagcttggttactcgggtgttttaagaagtaggttcactcctttttgctggcaaaaaccatttagtatcaaaaaaaaaaaaatgcgtaatttcgtaattagatttagaacaaggcatttgaataatttttatggtggatttcataaattacttttgccataccctgcagagactagataatatatatttcagttgaaatctaggaagttctaaaatgtaacttttttttaatgctaaggacttactctctctatattggaaagttctgatatgattagtacataatattccaaactgtaaaatgattaacatttaaaaatacggtttttaaaattagtgtttcttccataatgctgtcatgattttgtttacttaaatgggtttgttacagaacaaatgtaatagagatggaccaagcatttgtaattcggagtagctttaggtctaaagacgatggtgaattatgtaggtttaagttgttggaattaaaactaaaagcttcttttgataaaagtcgttataacattttgtgactctattaatagaagtggctttttctttgctttccaggtttttgggcgagttttaaagaagtattgcatcttcgttttttttatttttgaagtgggagtgtatgtttctgtttaggtcactgccttcattgtaaatcttgagtttagaaaaaaccaaactgcaaatctgtttttcagacttaatgaaaatttgtgccgagaaagtcactttgaaatattttggaataagttttacatgaatgattgatcttttatgatagctttgctgtttgaagcaattctccctctactaggaagcagcaaatcttacttttaaaaacctctgcttcactttcttaagctacattttagtcgagcgattgtgtgtgaattctttttctgtattccccttcagtttttctttctccccgcaaattaaggagcgagaattaacctaatttatgctgcccagtcacactccagctctcccacttggaagcagtttttttctgattgagccagtgttatagtaacatcattagacactattctaattgaggtgtgagttactgaggcctctgctagggaggttaaccctacagaatctgtagggttcattatatttaaactgcatatttcggcttgtctaaatttttgcctattttggtgaaaacatgttgttttgtcgatgtttaaacttagttcattttgtccctctctagttcatgactaaccatttttttcatttttaatccagcgatttttttagagtggttctttaagcatcttgtattagccatttcaatggtcattatatatgtttggatttctcttattttgttgaactagaagactgtgtggttacgccccaaaatttttttttgtcttaaagccatgatgaatggggtgactctgaggtgaccattaatcgcgtataaaagtaacctgactaaaatgttttcattgttttctacagttaaaggacttacaccagcataacacagcatttttttttttttttttttttgagatggaggctcgctctgttgtccaggctggagtgcagaggcgcgatctccactcactgcaaaccccgccttccgggttcaagcgattctcctgcgtcagcctcctgagtagctgggattacaggcatgtgccaccacgcttggctaatttttgtgtttttagtagagacgaggtttcgccatgttggccagactggtcttgaacaactgacctcaggtgatccgcccgccttggcctcccaaagtgctgggattacaggcgtgagccactgcgcctgtcctataacagcatttaatacagttttgtaaaattatcacattttgggctttttgttcaacagttgatgaagtctcaattgttttaaaatgagaaattcaaacagttcacaaatatatctagatatattcatttgagctacttgtagaatgatgctgtttgcatatatcaagcatatgcttgatcataagtcagatttagaatttttggattttgttttctctttctaaaatgtgtaattttggtaatgggaaatttgactgaattccagtttctcaggaacaaggtattttaggttgtgtcaccttaacactattacctggtgtaattggcatccgggaacatttgtttttaactatgagagtgaatgaaaactagggtagtgcttacatatgtaaaactaagatggtaggtagtcggattcttacaatttataaggttctcataatctaagccttgatgagttgctactgcaaattatattatagatcagataagtaccaaagaccagttgtaaagagggtctgttaacattttaatcagtttaaaattggcggtaacagtaaagaccgttcagcccaaagactgtatttcattatttatattccaaatgagaattttttgcagtttggaaaacttgtaaatgtgttgaattcatctttttattgcttttttactcccaatgtttagggcaacggtcttttcttctctcctgtctccctccctccctccctttctccctttttcttctttttcttctttttctttttttttttctgagacggagtttcgctcttgtcacccaggctagagtgcaatggtacgatttcggctcactgcaacctccacttgctgggttcaagcgattcccctgcctcagcctcccgagtagctgagattacaggcgtgcgccaccatgccaagctaatttttttgtattattagtagaggacggggtttcaccattttgggcaaggctagtcttgaactcctgacctcaggtgatccacccgcctcagcctcccaaggtgctgggattataggcatgagccaccgcgcccagcctttttttcctttttctttccatcttgctcagtgccccagcctggagtacagtgctgcaatcatagctcactgcagcctctaccacccaggctcaagcaatcccacttcagctgctgcggtagctgggactacaggcacacaccatcacacctgtctaattttttgaaaaatttttgtagagatgggggtctctctctgttgcccaggctggtcttgaactcttgggttcaagtgatcgtcccacctcgacctcccaaagtgctgggattaaaggcatgagccaccacgcctggcaagtagttttcaatcttggctgtacttttagatcccttgaggagctttacaaaatactgatacctgaattctagccccagaaattatgatttggttggtctagggtgcagccaggttagccctccgcagtgattgagtcattagggtcctctgactttttcttttgaactgtttcacttgtgttagctttacattctttaatacagtgttacacacatgtacagtgtagccatctcacacatctaacttaacgggtcttttgaaagtattgccacatttgctttgcttctgtgtctgtctctttcttttctctcccccttcctgtcacctattcctttctcctctgtttctttcttcactttcagtttatttgaactgtctggtagtaagttttaggaagctgtatttcccatgatgagaagttagtatatcatcactattttaaataggaagttgattttcttttaaagtatattctcaaatgcttacttgtactccttttggagactaattactttaagtccccaagttagcatctgaactccctgtgggcttggtctggtggctcacatctataatctcagcacttcaggaggctaaggcaagaggatcacttgagcccaggatttcaaggccagcctgggcaacaaagtgagacctcatctctaaaataaataaataaataaataaatataactcccaatgcaaattgtcttcttagggcgttaatctacttggtaaaccttacattttcaagcccccaattaactagtcacttaactggtttctgagaggcaggttgcattgggctttttctgtcagggcttaattaatacactgtgagacatttgctcagctaggccagctagctagtacttctgtagagatcatctagggcatgttcagctctccatttacatcacctgaagtagttcccaagtgctgggctatggagtagtttcatctctgtctctggaagagctatttaaaaaaataaaaatattttttcccatctgattgcaacacacatgctgcttcagaatgggaatggagtggaggaggcatgggaatctgtgttatttttaaaaagtgcctcttgattctaaaggttttgtttattttggtatgcttatccttactgctttatttatctattttttagagacaggttgcccaggatggagtgcagtaacatcatcatagccctctataaccttcaacttctgggttcaagagatcttgcctcagcctccagagtagctaggactacaggccggcaccaccacgcctggctgatttttttaaaactgttttgtagaaatgggggggcgggggtcttgctttgttgcccaggctagccaaatcttatttatgatttaaaactaggaatgctaccgaatatatatttttatagtaaggtattatttctgtatgttaatatggatgaatgtatgctactcaggtcttttcaagtcaaaatgtatttctaaatataagatgaattaaggatatttgtcagtgatattcactagtgaattctagagcatatgttatcagtagatgggcagtccttgtaaaaattgaataatctagtgaaaggatgaccggaaataatatttaatggggtaagctaagccaggaatcattgtacataaacacattaggtgtgtcttacatcataaatatgcctactaaaactagttgaaggaagaatgtgtatagatgctgaaataatgaaggggctggctaattgtaaggaaaaatgatacaacttctatataattagtctttttaatcagttgcatatactcatgatacttaatttgtaaagtaaagattgtagactagatcaatgctttgtaaaactaacagtacctcagacttccagagtgttttttaaaggtacagccccacccttgattctagttagtggagctggcctaacctgcgggggattttgatacatccccctttgaaggaataagctagatgacttgaaactctgcttcagttaaaagttttatgaaatgaggccgggtgcggtgactcacgcctgtaatctcagcactttgggaggccaaggggggtgcggattacctgaggtcaggagtttgagaccagcctgaccaacatggtgaaaccccgtctctactaaaaatacaaaaattcattgggcatggtggcacatgcctgtaatcccagctactcacatgcctgtaatcccagcttcttgggaggctgaggcaagagaattgcttgagcctgggagacagaggttgcagtgagctgagattgtgccactgcactccagcctagctgacagagcgagactgtctcaaaaaaacaaaaaaagttttataaaatgtatttttcagttatcagttattaaaattcagtttggtttccaccatcttttaaaacagtggttcccaaagtatggtccacagactcctggagatccctaggatccttatatttaaggggttcacaaaatcaaaattattttcataatgaaactgagacgttatttgccctttcactgtgaggacatttgtatgggtggtgaaggagcagtggtgggtaaactgctggcactttaaaatgactctaggcagttataccaaacatatgagtcctcattgtgttctttatagtcaaacacacataagcatttgaaaaaatgccggtttcacttaataatccccttgctgcagcagtaaaaaggtttaattttaaaaaaatctctaccttggagtatgtctttttaatagtgtgattaaatgggaagtatgcataaagcatttctgcacattgaagtacagtgttcttttctaggaaaagcacttgtgttattgagctgcaagctgaactagctgctttttagtgggacaccatttttatttttatttaacaggatgacagataagctcagatagctatttagatttgagtatttggcaggtaattccttggaaatgaataaagtgagctggccacttcgaggagaacatttatagccagtgctaaaatctgatgtttcaagtgaaaatcagatttttgggaaactcctgtcactatgacttgccagtttcttaatacttaaagacttttctgatgagatgggtggtgatattaaggaatgtgattaaaaaaaatatgttgggctgggcacgatgatgcacacccatatttctagcactgtgggaggcggaggtgggagaattgcttttggccaagagttcgagaccctgtttctacaataacatataaaaattaggtgtagtggcatgtagttctagctgctcaggagggtgaggtgagaagattgcttcagccagggagttcaaggctggattaagctaggatcgcaccactgcactcgggcctaggctacagagcgagactgtgggggggggggcagtatgaggaagtgtgtcaacactgggaagatctgtgtaactcattgaaccaatattttcccaaatgaccaattcatgttacaaaatcgtgcatgggtaggcgatccgttcaaagtacaacatagacaaatggatttttatatacaccagagccaaaaagttcactgatacagtgaattccacattgcaactaacctttcagaattgccacttgagttttggtgttgaataaaagatgaatatccattgttttctgagaaggctgttaaaatactcctctcttccaattagctgtccatgtgagacacgttttcttcatgtactttaaacaaaacaacatatcatagcagattgaatgcagaagcagatatgggaatccagctgtctcctattaagctaggcattaagagaaatttgtgaagatgtaaaacagtgttactctgattcctgactttgttttagaaaattctgtttttcataagatgtttatattaacgtaatgggtttattattttaaatgaattaataaagcaaataccaaaaattttagtagttttatttatttataatatgataaatatcaatgtatatagcccgcataaaagctatttggtgtctttaataatgaagagtataaataaaggtccaacttggccaacatgacgaaaccctttctctactaaacatacaaaaattagctgggcatggtggtacatgtctgtaatcccagctacttgggaggctgaggcacgagaatcacttgaacctgggaggcggaggttgcagagagctgagaacatgcctctgcagtccagcctgggcaacagactgagactatgtctcagaaaaagaatatgaataaagggatcctgagatcagagagtttgacagctgctgttttaaagtaactatttctatgcattatcgactaaattactgattgattgaattgtttttatggtttgtactatattgctgttatttctaaggacgttagtcattcagtttctgttcagttatcagggaacatgtaagagtcagacttaagtaaaaaggggaattcattggcttggtctggagatagagctgacctcagattgctatatccagggtttcaagcagcatcaccaggactcttgactttgctttctttctgtttctcaggtagtttgcaggctaactatccccagcttcaaggaagcatgaagagggccttcccccccccacccccccacccccccaccccccgtagttccatcggaagtgctagagctatgtcacttgcctgccttgcgttctttttcatcagaaacaacactgtggccagggggtggctctggttagtctgggaattgtcccacctggccagatggggagattctccttggaaaatcagactgctgttttacaaatggagaaatacatgctggtacacaaaaactgatgtccacctatagtactttgttatttcttcttttaacagcctttaatttattaatccaaaaagggtaatttttaaataagatcatttaaactgaaggtggcataccaaaatgacatttaagacacataggtaaacaagaagcatacatctcgatttgtcctttgtcattcatcttaaaagttaaaaaaaaactttttgttgcttttattgctgtataaatgtgctcttggaagttcgccaactgccctcagtttgaagaacctcaacttgctgtctaggatttagtctttagcttgtgctgcagacagttgcactaaccgtgaacacctttttttcctgttggtaaacctaagtttagagtttattcctagtaataacattgatatattaccaggcccagcttttttctcctcccctagttaaatttaagcacttttgcgccgggcatggtggctcatacctgtaatccagcactttgggaggccaaggcgggcagatcatgaggtcaggagatcgagaccatcctggccaacgtggtgaaacttgtctctgctaataatacaaaaattagctgggcatggtgatgcgcccctgtagtcccagctactggggaggctgaggcaggagaatcgcttgaacccaggaggcagaagtggcagtgagccaagatggcaccactgcactccagcctgggccacagtgaaactctgtctcaaaaaaaaaaaaaaattttaagcacttttctcaaatattcccatagtaagtagtttattgatcactgatcaaaacacttacaacttctagaaaatacatgtttgacacatataatacagttaattcaaaagtaaactaacatctgagaaaaaatgtcaacactccttacctaaaatacatgaatttacatgagaacctctctctggccagtattcagcctgtttaattttagagagtatcttaattagtttggttatttggctttctcgtccatttattagtatacctatggtcaacgtcaggtgacagcttacaattaatagcaaggctagaggaaaaacaacaggcagataacaagaatcagctgtctcttcttgctaactctttacctctcataactcttgactgcatctaatacctgtatatgttagtgcctttcagataggcctaacttctcatctcttcaaactcaagatatctaaagctgaatttgttacatacctgcttttaaattttttaatcattgagttatctagaaatgggtcgtcttttatttgtcccccctttttcacccttcatatttcagttggttaaagactccagtcttttctacctagaaatagctcactgatttccccctcccctccttggcccattgcccatgccccagtctaggatcttaccgcttttctggtaattgtttcctaactggttttctatttccttttccaaagctgttctccaggctctcactgaagttttctaatacaaatctaatgctgttttttctcctctttctaccatgaacctactctagacaaagctcttatccgtctctgcttttcctcatcattttccttcagcctggcaaattcttattcgtatgtggtaatccattaatactattctaccaatattctgatggctgtcccctggcacatggtagtattgtgcttctttgtctccctcatccctaccttgaaattaggcatggcccagagtttcttgcattggcactgttgacattttaggctggataatttattttgcgtgttgtccagtgcattgcagggtatttagcagcaaccatggcctttagccaccagatgcccagtagtatccagttgtgaccatatattgcctccagatgttgccaagtgtcccctgagggacaaagttgcccctggttgagaactcctggcatggccttatgactttggccagtcaaacatgagcagaagtggtagcctttaaaagaagatatatgagctgtcctatcccttctcctgccatttaaggacatatgtagaaatggagcctttgtcagtctaatttctgagcgatgacagcagtgcccccagttgatctgtgatgaatgtgtattatatcctaagcagaaaataagcttttgttttaagctactgatcttttgggggttggttgtcactgcagcatagactagccaatcctgactgatacgttgtgccaagacctaggttacctatgaactttccatgctccctcatttatagtcccaaatcactttatacctacttcttttagcatttattacttatgtaataatatgtttgggtcttccagattagtagttctcagtggagtaagtactgctctttaagggatgttgtagaaatttgtggatgggtttggtggattggtggccagggatgccatcctgcaatgtgagagacagcgaataattatcttgcatcccacaagactttcagatgccccagaaattcatgtaggaggaaaatataattagcccagaacctaactctataatatatattcactttgccaggagttaaatttcttttaattcatttttttcttgcctgcctgcctccctccctccttccctccctccctccctccctccctccctctctccctctctctttctctctgttttctttctttttccttcctccctccctgcctccctcccttacttcaggctctgttacccaggctggagtgcagtggcgtgatcttggctcactgcaacctctgcctcccaggctcaagccgtcctcccacctcagccttctgagtagctgggactataggcatgtgccaccatgccccactaattttttgtattttttgtagagaggaggtctcactttgttgccaggctggtcctggcaaccgtgcctttgttgccaggctggtcctgagcttaagtgatccaaccatgtcggcctcttaaagtgctgggattacaggcatgagccactgtacccggacttggttgttttgttttttatttttgagaccaaatcttactctgtcacttgggctggagtgcagtggctcagtcatagctcaccgtagccttggtctcctgggctcaagcagtcctcctgccccagcctcttgttaattcattttcttagttcaagttgtttaagagttcaccatttgggaaaatccatgttactgactgcagtgccattgtgctatttgagttgccagtataacacgtttgtcttggaaggtctgaatttgtagctgtcacatttgtaatgattctgtatataagtgctagcatctaacttctttattatacattctaacttagttggcatgcctgagtatttataggtggaagtacacattatatattaagcttttcctcctttttgttatagttagggcattgttaaattttcaaaatatgtttaagtagtttagaattttgtttcagtaaagctaaggtggtgatataaattatttgttggaaaaaaaatgggatgttggtctgagagagtccagacccactttcttactatgggcttcctgtttttgtatctgtagtgctttgtatatacagtgtttgttgaattggtcaatttatgtttcccacatttcttttatgtacgttgttgcatctaattaccacaataaatttgtgaagttgtcagggcaggtgtttccattttatagatgagagaattgagagagatgttaacattcagtcatgcggctagacctttaattagaatatataattttatttatatcgatattatgctcttgcctaccatacttccataatctagaaccatttaatgtaggaatacatctctttattcctgctagtattattttttatatgcataacttttaattatgtttcaggcacttgtggtcataggaatacaataaagagagagatgagaaagctgtttgtttaagaaagcgaggtcattatcatttgtattcaaagcaacttggtattaaaacaaactttgagataccgttaaggccccagcatagcataaattttagaaatgatgacatttgatggtgagattgtggtgaaatagttaacacttaaacattttaattgcattgtagattcatacacatcttttggaatataatatcagaaaatgacttcaaaagtgtctgcactcttctaatttgttgtaagacaattccacagaataaaaagctatggtcagtccagaaacacttgcctggtatatgtcaggaactgtgcatggtgctgggaatttctaaaatgagagtgttgttgctgttttcttggatttctaatttgtggcaacaatgtgagacagatatgtaatcaaataactaatgtgttacattgtaatttacacatgtaatttacaattaaattgtaatcgtaattgttaaattgtaatttaacgtatctttccttttccctctttcccgattcctttcctttctactgagtctcactctgttgcccaggctggggtgcagtggcacaatcataactcacagcagccttcaactcctgagctcaagcagtcctcctgcctcagcctcctgaggagctgggactacaagcccacactaccatgcctggcgaacctcctacatttttttagacagattttaatagaaaatgcagaaaaatgcgtaatgcattttaggaaaaatcttcttgtaaaactattattatttttttgagatagggtctcactgtgtcacccaggctgtagtgcagtggcacaatcacagctcaccaaggccttgacctcccaaggctcaggtgatcttccagtctcagctccccgcgtagctaggacaacaggcgtgtgccaccacacccagttaatttttttattttgagtaaagatcaggttttgccgtgttgcccaggctggtctcaaactcctgggctcaagcgatccacctgcgtcggcctcccaaagtgctgggattacaggtgtgagccaccgtgcctggccacaattaagcatgttaatatttcaacagtagcttttttactgaacactatgtatcagacacgttatgcagaatttttcctttgagcttctgtataccctccttttaatccagattcagagtaacttcattttctgactactatgaaaactggaattctaattcaaatctcttgactccaaaatctcccatgcaggttatctttggttatttggaaagtgtaccttcagcatgtgtattaatgtgggcaagtgctctaagacatatgaaaaactgcttctctgcatggggtttatgagttgagacagacatttatgtgaaagagataacaacagagggaggagcaagtcttcaatatcaggtgattgatgtacattctgaagaggctcaaaactacaacagtggcagggagaatgggaggagagatagaaaagactgaggtaaagaatcttgtaactgtaacggaatgtagggatagtgaaggaaagaggcacgtcagagatcttttgcaaagcttcccaaggctaggtaattgagtggaattgatactttaacaaaggtcttcagaagaggaagagattttggtagaatgatgagttttattaatcttgtgggaggatactttaaggattcaagtatgcagtaaaagaaaatgaaagcaagataagtctggaatgcaacttcagtgaacaaataaaatacaaacaagcacacaaagtacaggctccagtcctgctttatcttctttattcttaagctaatggccttttcctattctctgtggggtcttgggatcagataagttagttttctacctgttgaatggattctttattaatcttcagtttttgttattttaatttttttgaaaataatttaccctgctgcttttacaggtaaaatcttttgaggaatttagtgatctctttaaagaacagctgtattgagatataatttccataccataaaattcactatttgaaagtgtacaattcagtggtttttactatagtcagagttgtgcaaccatcaccattatcaatttttaggactttttcattataacaaagaaacaccatacccattagcagtcattcctcattccccttcctcccaggccctggcaaccactgatttactttctgtctctgtggatttgcctattctgtatatttcatataaatgggattatataatgtgtgaccttttgtcactgacttctttcacttagcatgtgttttcgaggcttatccatgttataatttgttagtactttattcttttttatggttgaataatatttcgttgtatggaattttatctatgcattcatcagttgatggacatttgagttgtatccattatgaacaacgctgctatgaacattcatgtacaggtttgtgtggacatgggttttcatttccctcaagtagaagtgtgaagagtagaattgctgggtcatatttactctgtttaacattttgtattaataccagactgttttccaaagtacctgtgccattttgtaatcccagcaccaaggagtgagggtccaatttctcggcttcttcaatacttactattgtctttttgatatatccatctcagtaggtatgaagtagcagctcattgtggttttgattttcatttccataatgtctaatgtcgagcatctttcatgtgcttattggccatcgtctttggagaagtgtcctttagaatccttttgttcatttctaaattggggtttttttttttttttaattggtctcttttaacaaaggtgagtgttaactgctaggtagaatttcataccaggcgatggtaaatttttcataaatattagtaatagacttttaggtttaactagtgctgatcctcataagtaatcctttaaaaaagtgctggtaagattttcctttagggtgactagtaaagtcagtaagacttgattgagcatgccactatcataatgagaagacctaactttaatatttttggaatgtcaaaaacagtgacattttaattaagtaattttatttttaaaaattatttttaatggctaatattttgtaagaattttaagtaattttcaactctgagcatcaaattttaattatgtgcattgaatctctgacttaaccagagcaatttcatcttttcccaagtagtcagatctacttcgtaaaatgtgttctgatgtgtgtcttttttttttttcttttttaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggttagtcttataagagtttttctataccctctatggtggcagatttaaaaacttgctacgtttcctttcaagctactacagggtaatttaatttgtgctccatctcttcagatactgtgcatcctgtacaaatatgcattatgggaatttctggaagaatatgcaaaagataaaatcttaaagttttttaatgttctactcagaaaaatgttcaatggagaaaatttggaaaataaaaataaaaagcagaaaacccacacttcgcaagaactacctttagcactttggtattcatttttgtagcctgttgttttcttttttttttttttcctagacggagtcttgctctgtcacccaggctggagtacagtggcgtgatcttggcccactgcaacctccacctcttgggttcaagcaatcctcctgcctcagcctcctaagtagctgggactacaggcaagtgcaaccatgcctggctaatttttgtatttttagtagagatggggtttcaccatgttggtcaggctggtcttgaaccgctgacctcaggtgatccacccgcctcagccttccagaattctggcattacaggcgtgagccactgtgcccagtcgtgttgttttcttttttgatattgtatgtacatttaaacaaccggattacacttagtccttttataatttagaaatctgatatgtttcactgttagcaaatgtttcattggtcacatttttcaggtagaacttcataatacagctcccttgcttaaataaatcttacagaaattttgtcgtagattttaaagttttatttcaagactttacacatagtttctgcaacacagtctttttgcatatttatttattttattttatttttttgagacatggtcttacttttgcccaagctggagtgcagtggtgcaaaacatggctcactgcagccttgacctactgggcttatgcagttctcctgccttagcctcctgagtagctaggactacaggcacataccaccatgcctgggtaattttttattatttgtggagacaagggtcttgccatgttgtccaggctggtcttgaactcctgggctcaagcgatcctcctgccttggcctcccaaagtgataggattacaggtgtgagccaccatgcccagtcactttttacatttttaaaacctgagcacaggccttgaaattataccaaggtttaaattctaggtctgatgtatgacatggccaagttagttattgtgaattttagttttcttatttatgaaatggggattgtaatactgagttggtaggattgtgaggattaaatcagaatatataaaagtgtcttgcataatgtgacacatgaataaatggtcgtttatttttctaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattggtaagtagactttgctttcatcctaagaaacataaagggaaaaggatctcaatagtgtttcaatttttgtaagttaaattataaatttggaagatagcccgcgactttaaataaggttaaagaatcagacatttttaatatacgtatttaaatttgaatttaggaacaaacttatattttgactgctaaaaccgagtattgtagttgatattttgcccctttagaacattgtttttgagaaataagatggaaagcattataaatttgaatacttagttatgtattgttagatagcgtttatgctacttctgaattgaaatggttcatgaacttttgtaatctttggtttaaatttacattctctgtttttaaatggaaaatactttcattgtaatgattaatgtttcatttgttttcccctttaaacaattaagatctctcaggattaacactgcagagtaatggtaggtaatctgtttcttactactttctctttgttttgtcctatcctctctgtttttttgttgacctagaattagtttgtgtgagcggcaggcagtaacattaacaagaaaataacttactgctttggaaatgtagattttgaggttaggggcatttaaaactggatttaaaactggatttaaattggctattgctctttgtatttgaactgcaatttatgaactaaagtactgtaaaaaaatatgatagaggaatgcaccaaaaacaaatataaagaatattttttgagttaagacctatttttgaagaaaatctcacagagccagtttaaatggatgttaaatacccagaatatttggtaatttggaatcacatataacatatcctttaaaaataccagtattctaattttccttcatttcagcctaacatttttatgaatgataatgttgagaatggtttaaaattgcactcttttgtattttttcagtcttgttacattttgagtaaataaatcaaggctactttaaagcatatgcccatcacagcttacctaattgtatttttaaaaagaaaaagtgttttaaggtgagaaaatgaaatgtgaatgggggtgtttttgttttttattgtaatatttgagaatggagttttattaaatctttagctctgttacttagaacttaataaactaaaatttctgtaagaactaattaatttgcagagaaactcttataaagaaccactgtcagccaggcacggtggttcacacctgtaatcccagtactttgggaggcttaagcgggtggatcacctgaggtcaggagtttgacaccagcctggccaacatggtgaaaccctgtctttactaaaaatataaaaaattagccaggcatggtggcgggtgcctgtaatcccagctactcaggaggctgaggcaggagaatcgcttgaacccgggaggtggaggttgcagtgagctgagatcacgccattgcactccagcctgggcaacgagcgaaactgtctcaaaaaaaaaaaaagtggggggaggctgggcacggtggctcactcctgtaatcgcagcactttgggaggccgaggagggcggatcacgaggtcaggagatcgagaccatcctggctaacacagtgaaaccccgtctctactaaaaacatacaaaattagccggacgtggtggtgggtgcctgtagtcccagctacttgggaagctgaggcaggagaatggtgtgaacccgggaggcagaggttgcagtgagccgagatagtggcactgcactccagcctggttgacaaagcgagactctgtctcaaaaaaaaaaaaaaaaggaaccactgtcatcttagaaaggtgtgctcttgttctggagggcagttagtagtagtttagcaccttttttgtttgtagaattttagaggtgggtcagaaatactaggtgaccttaaccaaaatttaggaagagtatgcaattctacttgtttttttttttccacctttctcccatatcactggtaatggaggaagactcactgccttgtggtgcttgttagtgattagtaggtttctgacaagtgtgggtttattattaggagctgttgtggtggtctgggaagggttgctttaagattggtgaaaactctgcttctttgctacgcagacattgatattgtatcacttctttttttttttgaaagtaaacacgtttcatatcttcaccattttccatccatgtttttggagaaaacgtttgtctcagtgggtattaaaggttgggagactgcaatgataagtgtgtctgaatctctctatggggctgtttgtgagggggttcaaattctgagtgctcatcacacacctcccctattctaaaattattgatgcactgttattgatgggattgtacgggttgatagcctttctatagtgactgtagggctgtattcagccttgtagatccccctagtggtggttttgtaaaggctgtcttcagtgtcttatttcctcagaaaacaactggtatttctcacagctccttctagatttggacaaaggaatgatacaagagcaggtaactaaaagttaagaaaatgggacagttccttcatttttgagttaaagtcttgtggtaatcatttccagcctatcttttacctttcatgaaactttctatgaccacgttgacctgtgtattcattttaacaagtatttaataagcatgtattgcctggtactgtgttaggttccagggatgcttagataataaggtatgttttgtctactcaagtgagcttatactctagtggaggagagaaaaagtaaataagagagtgataataccatgagataggtgctgtgtcctggttgctggtgatgataaagaacacagacctaaggtgggcccagtggtttcagcttttttgtcacctatagagaatatattctttgaccctcttagaacattttttttttcttttttgagacggagtttcgctcttgttgcccaggctggagtacaatggtgcgatttcggctcactgcaacctccgcctcccgagttcaagcgattctcctgcctcagcctcctgagtagctgggattacaggtgcccgccaccatgcccagcatttttttttgtttgtatttttagtagagatggggtttcaccatgttggccggctggtctcgaactcctgacctcaggcgatccacccgtctcagcctcccaaagtgctgggattacaggcatgagccactgcacccagccctcttagaacattttataatcactatatatatgtataactactctaaaaatatggttaaataataatagctaacactgggtactcgtgtgtcaggtcagactgagctaaatgatttctgagtattgtgtcatcattctcatgatacttctacatgggaggtgggattatttatactttaacagatgaagggactgctacctggagaggtgaaggaacttgcccaagaataggcaactaggaggagccggagtaatgtgtgcttgctattagatatttaaacaatggaaaaatattacaaaagactgcaaactccatgacagcagggatatttgttttgtttatggatatatcccaagtactagaacagtacctggaacagaagtgctcaagaaatattttttcagtgaatgaatttgttgaatgctagcccataaagagaaatatttaacagtttggtatctgtttttctggactttaaaaaatatatactatatgtttttttaattttatttttttgaataggcaatacatggtccataaatcaaaatactataaaaaggtatacagtgaaaagaagtgctcccacccctgcccccattcccccctacctcaggtaatcactttttttagtttctggtgtttccttccagggtttctatatgcaaaaaatacatacctcctttcttacacaaaacgtatactatgcatactgttctggaccttggttttttacttacagtatatgattttttaaacatgcatatgatcatagtgtacaatagtgctttgtaacttgctttgattctcttggcaaaaatatattgcagacttctatccttgttgatacctttagttttacctgagaaacatttattatggattatctggggttaaagagatctgtagaccagtagaagtttcaaacttacatttgggaagtttagccagcatatttagggcaagaaagatttatgggtcataactgtttaaaagcagaatacagttggtacataaagatgttatgattgctgattaaactgaagagtcatctgaaaagcaaaagcagtgagtaccaagttgaccagttgtatcctcaaatcagctagcaaaaccagtaagttggtaaaaagatcccagtcattataacaacaaaaaaaacctaagatgtccaggaattaattagagatgtcaggatttatatgaagaaaatcattgaactttgttgaagggtgtaatataaggctgaataagtgtagacataccaattttgtgccccaaacaatttttttctttttattatttttataacttggccaatgttgatgagtggttgtgttcagttttttttattgatacataatttgttacgcatccttttgattatctttttgtttccataaaatttctaaagaggaactttggaatgggatttataggtcttcagaatatcatcttcatgacttttgatgcatgaacatacttcttaagaggtttttaagaggttgtacatagaaacttgcacaatggatgattattactgccttaaactagtctcaatttaataaaaagtacccatgtaacttaactgatatttacatgtagtagattttttttcaaaggttgacatagggaaagataagggaaatgatatgctggttcttaatgaaaaagggaatgtctttttgtggtctactaattgactgctttaagaagagaacctactgttagttcagtggattgttaagttctggagtagtgttagtttagaagcaataaaggattggttgctaaaggtaaaaagcaaaccttaaaacaataacctaaaaacaaatgggaaggttctgggcagagaattaacattgttaatgcagttcagtttcagttttctttttgtcatacagcagagctaactatttcctggttggttaatggaaagatgttatgctgtatcagctggaatctagctttgcttatgaaggtgtaatcacataggtgaaagatgttgattactgagttttctcacaccatatattaatcaaatactcttatttgggttgggtttctagagggaaatttcagtttgacttttcatttataatttttccgtttggttctaaacctataggggacattacattcagtacacttcatttttaaagaatatgttgcttaacaataattctagatcctgggattggatatctatcagatcccactcatatctccacagtgtgaaattaacaaaaagatatagttaaatactcagtctctatttagaccgaataattgtttttctcagctggacacattttccagccattcggtttttgcctgccttatgtatttaggtgattattcttctaggtttatcaagaaactgaggagtacctttttaggattgttgctggaggctgttgaaacatagactagcttcaaatttgagagtcagattgattgataaaatatatctcatgctgttaccgctgaataaatgacttttgctggtaaagtagtatgcttttaaaataatatgaaaaaattctgaattaaggttagtaatttacactgtaattgattttaggtgttattatattacttgctaataagatttttttttctgggaatagaagcttataaaaatttaaaatatgtttaattttctatatagctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtgagttctagaatcagatgtagtcagcaagttgagttttcctaatcattgcttatttatgtgtagtcacttggggggaaactccaagtaagtaaacattaaaagtaactgtagtatctttcataggtaaacaggtattaaacaggtatgcacaatcacttggaatttaagtaatggctttgattataatattgatttaaattaatgatctgatttatactttactattacatgtagcagtaagtagcctcttaagctcccagatatattttggagaaatatttaaataattaacaagtagttttgatccaagatgtttatgaaggtctgtgttaatggaattgcaacctttcttttaatgcggtgttcttattttggtttttctgggacaatattaccttatagtagttgtctgattttctcactgtgcaaagggatcttgacaaatttgttatatattgctcaagatagacattaattaagtcaattttgatataagctaacttctatatctctttttaaaatatatgtgtaattaaaaaaaaaaagtgtttcagaaagatccttcttttctgccatgtcataggagggagaggggctgctaggttcaggtttttgggggcatgatcatatgacctggttctgttacttattttcacagtaaccaaaggtttgatagtttgctgcttggcaaatgaagtagcttttttttcattttttttttttcaattaatcatagagcattgtcttggcatgtgtatggtgttagttgcatgcagttgctaaaggaatttatgtaaacccacatcagaatagatttttgacagctctgggctaatactgtgttagttgctaccgaaagtaccattattgtatttgctttactatcagattagattcaacatagaaattttgatctttggaataaatgggggactgatttctgtaattgtgagttttcaagtgaagtataccagaatttcccctttaattcattacaccacttcaaagcaacatgtttttggtttgctatctaagagatgacagtctcactataggcagcatattctaaatgggtcatataggttaagcacttgagaacccagttccttaatcacttggtgcttctattatctgtctactttttatttaccaaattaggaatatggttgacaaacagtgggtagtgatagaaaataaaagaaggtacattatagccacttgaacgtagattagtgctagagcacagctacctacttctgtttatattatctggagattgaatttctgtgcctttgtcaatgcttactaaagtgacttcattttgactgtgttgtttcctgaggttgaatcctattcaaagattagaaaaagtgatagaaatgaaatgcagctaattttatcctggtatttattgggtagattttaataatcgaataccgtaaatactgtaagttttagaacttgtgtcaaaatgttcccttatgtggtggcatgcgcctgtagtcccagctgctccgggggctgaggcaggagaaatggcgtgaacccgggaggcggagcttgcagtgagcagagagcgagtcactgcactccagcctgggcgacacagcgagactccatctccaaaaaaaaaaaaaaaaaaaaaaaagagggttcccttaggtctcaaaaagtatattgatgaaaagaagttgaactaaaatagaagatttgaaaggctattttacgtgagctgatttagtcgtattgtttaactttattttacatacttagaattgtataagggaagtattcagtatggataactacagtgagtcactttacaatttatgttcttttgacacctgaatattttaagaatttccttttaaatacctgtaaattaaaataatttatcctgtgtagttaatgacaatttttgtaagttagctaagagtattgcctgtagaattgttaaaaatatgaacaaaaccataattaacctttaaagataacttgcagaatctgggggatgagtaggaagggaggttgctaaaatgtcatttttacagataaataatttggggagtattgaaatattctctttagcttttggttttgtaattcttagctttaaggaaatgtgatatgtaaagaaaagaaaaatattccttttctttgatactttgagcaatggtgacatgttactctcttccatctgattatactcccatttagaaaagaatgaggtgatgccagttataaataattataactttagtgctttccaaataggattaacagtcgagttaattaatgctctttaagaaaccaaatttccactttaaaaaaaaagccttaaaaatgtaggacagtaagcaatatcataggatggtttttgaatagaatacaagccaagagaagcttgattctcttggtatattacatacagagagggcaattaatttcttgtacatctgggaatatgatggtgttcttgaaaagaaatgattcttggtttataaaagctcttgaaaaaatttgaaagtagactgatagtttttttgtttgtttttaaccagtaaatggtatattgattggacagcagagctagatctttttaacttcctcatcttcactatcacatcctatttaaaataattttctgctctgcttttctctgtcaaaccctagcattctgccattactagtatcagtgctgatagtgattaatttttcagttttcaacattttcttgagcctggatttttggggtcctaatcagaaaggtccagagagagaggtggatggagtggccaggatgaactgacatacctctgaagaagttaatatgataggccagacgtacagtggtgttttgctggcatttgaaatatgtttgtgaagaaataagccactacaattagttagacattacctaaaatggaataattttgagcttcctcaagttaaagtttgcctttatagatgactgtaggttttttacctgataggccatgggtgagttacactttttgcccatctttatagttgtgcattatcagataaaattggtccttcatttagtatatgaaatcataagatgacatctatgaatgtaccatgttaatgtcttcttgttcctctaggtcagcctgccagtatactggggggcagccatagtgaaggactgttgcagatagcatcagggcctcagccaggacagcagcagaatggatttactggtcagccagctacttaccatcatagtatgtacatactttaaaaaatcttttaaatagttgagaaaaaagtaggcagcctttataaaagcaaattaacccatgtgggccttaatttttagacagcactaccacctggactggaagtaggactgcaccatacacacctaatttgcctcaccaccaaaacggccatcttcagcaccacccgcctatgccgccccatcccggacattactgtaagctcttgtttttgttgtaagggctattttttttttttttttggtagggctttgttttctgttttttaaaaatgtttttacatcttttattcatcctgtgattttgtttcattaaatagtgcttttcagtattttttgtaaacagtattatttttcatagttatcctacctttttattttagaggagtgatgtttgctaaatacatttatttctctgttgctaatgtttcattaacatcacattgatttccattcatttgtttgtttgctttgtatatgttcttagatctcatctgtgtcttgtatatccacgcataatggattgaaaccctttgagtgctaagttctcaaggtttccctcagcgtagtattcagtgtactttggataatgttgaatctatagataactctgtgctggcatgattgggaggaataccctacagataacatgtagtttcaggtagaataggagcattgttcatatggcttagtaaaatcgagagtataactcttatatacattaaatccctttcttctcattataatattaatagtaccaaagaaaacttagaaaatatagaaaagtataaataagaaaagcaaaattaccctgaatcctgctactcaaaaacagccacttctaatattttgttattttccttccagtcatataaacaggtatatgtaaattgacaggggctcctactctatgtgtattgtatatatcttgcttcttttcagttatgttactattttttccatttcttaagagaatgtaatttttaatggctgcctaggccgtcatagtgttgaagggtgctgggtttggacctttaacaggctgtgtgaccattgacaagttatttcacctcattaagcctcaagagtaataatagtagtatctacctcaaggggtgttcgtaagaagtaaacgtaataatttatgtgaggtgtttagcacagtgttttaacacattaccagttttcaattatgttagctatgattccattaaataaacatccttaattaacataagcacttgtttttagaatagacctaacagtttattattatacattgcattataaattgtactgtattggacgttacatgaataattcatttatgatctgtattaaatgttggatataaaattatgtgtaaattgtgtaataatagcacttggcagatagcactgaaatgttagttattaaatatccacaaaagtattaatagtttaagactatttgcttattgtaaacttttaagttcttagacattgcataagcttgttttaaacaattcctaacctataatagttatatttaagtaagatttactgaaagttttagcattagacaacttttagtaaataaaaatggaatttttgttgtcttttctttagggcctgttcacaatgagcttgcattccagcctcccatttccaatcatcctggtaagtgtatttcaaaattgatttcctgtatttagattgatttagtggtgattgaaacgcacaaacacaggctttaatggaattatggggtcacttctcagatgagtacaatactcatcatgacatgagttaatcaacagtttgagtagtcaatatagtcacacatagactgtctatattttattcagtttaactgtccccaaaagaaaagaactatcttttcagctaaaatgagaattacagaaatgctgacttcagcattgaatacataaatatgcagcagaataaaactaggtttcaaaatagaacagctgtaaaactatagcttaaaaagccaggaaagaatcttaagtacatgccgaaaagaaaaataattcactctattcaggatctctggttaactggaatttagaaactatttgattaaattgtatgcaaaagagtaaatcgctaagtagctttcttcagttcaaagtttgtgtataatttttgaaactgtagaggtaataaaacagaaaacacttgaaaataaaatactgaaagtcccttgtaacacaaacatagattttgaatttttttctcatcctttcgtatctgtttttcttagcataaaaagatgcaaatatattacttcagctaatcaccttaattttttggaaactataaactcaattttcctcctaattaaaagaaaattatgaagaattatatttttatttttacttgtttatttttgagagagggcctggctctgttgcccaaactggagtgcagtggcatgatctcagattactacagccttgacctcctagtctcaagcgatcctctcacctcagcttctagagtagctgggactataggcaagggccaccatgcctggctaatgtttgtattttagtagataacagggtctcaccatgttgcccaggctggtctcgaactcctgggctaaagcagtcctcctgctaataattttatttatttatttatttatttatttttttccgagatgggatctcgctatgttgtccaggctggtttcgaactcctagcctcaagtgatcctcctgtcttagcctcccaaagtgctgggattatagacgtgagccaccacaccaagcttgaaaaattaaaaaaatatatttttaaatgattttatttttgatctttgtgggtacataggagatgtatatatttatggggcacatgagatgttttgatacaggcatataatgcatgataatcacatcatggaagatggggtatacatcccttcaagcatttatcttttgtgttacaatctatactctgttagttattttaaagtgtacaattaaattattggctacagtcaccctgttgtgctgtaaaatattagaccttattcattctaactactttttgtactattaaccatcctcaccttcccccaatcccccactacctttcccagcctctggtaaccatccttctactctctgtctctatgggttcaattgttttgatttttagatcccacagataagaacatgtgatgtttgtctttctttgcctgggttctttcacttaacataatacctccagttctatccatgttgtctcaagtgactgaatcgcattttttttatggctgaatagtactccactgtgtataagtcaagcataaagaattttaagcataccggaataatacaggaagttcccccattgtactcattcctcagtttcagccattatcaagtaatgaccaatcttgtttcattcatactcactctctttcttcattctatattattttgaagcaaatcctatattagttttatatgtaaatatcttagtatatatttccagtaaaggtttttaaaacataaacacagcgcccataatgattaattcaaagggtcttaaattcttaaataggtctacataattttctttgtgtaaatgttctgttattgattatgttggtttaatttttcttctagctgtttaaaaaaatagaagggaacatctttgtgtttataacttttctcatattttagtttaagaaatttgtagaatttctagatcaaaaggccatattacagtgacaccagagtgtgagaaccagggttactgtgctggctagcagtagatgtcatagtttaataaactttttgctgatttaagaggcaaatacttgttctggttagggaaaaggtgatattagtggggcagaagcattcttttaacgatatatatttattatcttctgtaacggattttctgtgttacattgtgtgttgtgattttaaacatttttgtaggtcaaggggtctagccttttcataaactttctttttttgagaaatgtaatatacagaaaagtatgtaacacaagtaagtatatagtctaacatcactaaaaccaatactcatgtaaccactacacagattgagaactaaaacattatggcatcccagaaaccctcctaccccatgaattttgtctctgtcaaaacctctttccttctccccagaggtagctactgtcctgctttttatggatatcactttttttttgctcttttatttattttttaaatttttatttatttattttgagatgaactcttgttctgtcacccaggctagagtgcagtcatgcaattcggctcactgcaacctccacctccaggttcaagccattctcctgcctcagcctcccgagtagctgggattataggcacccgccaccatgcctggctaatttttgtattgttagtagagatagggtttcaccatgttatccaggctggtcttgaactcttggcctcaagtgatctctgccccatcggctcccaaaatgctgggattacaggcatgagccaccatgcctggcccttttaaagtgatgaatacatccctaaacagtctagtaatctggctttacttgttttttttttttttttttttttttgagacggagtctcgctctgtcacccaggctggagtgcagtggcgcgacttggctcactgcaacctctgcctcccgggttcacaccattctgcctcagcctcccaagtagctgggactataggcgcccgccaccacgcccggctaatttttgtatttttagtagagacggggtttcactatgttggtcaggctggtctcgaactcctgacctcttgatctgcccgcctcggcctcccaaagtgctgggattacaggcgtgatctaccgtgcctggccctcattttctttttacctagctttataaatacttgtttaaaacaatttaacatttggactgattgtgtaaagaccacttttaagtgttgttactgttttttgttgtgttttttttggccaccaaaacattgggtaattgttgtcttagacaatctctgtagttttggtttaaccagtgtacctatcagttgtttgctgaagcttcttgtccatagcataatgtgataccttcacattacattttctatagacaatatatatatatttttttaaatttttgagacggggtctcactctgtggcctgggctggagtgcagtggcactctcatggcccactgcagccctgacctcccagacttaggtgattctcccatctcagcctcccgtgtagctgggactacaggtggacacaaccacgcccagccaatttttctatttttcgtagagacgcggtttcaccatgttgcccaggctggccttgacctcctgggctcaagtgatctgcccatcttggcctcccaaagtgctgggattataggcatgagccaccatgcccggctgaaaataatttcataaatacttcaaaactggctttttaagaagacactcagtgaagacacttagtgtatcactggtttttatgttctaagcataatgaaatatatgtaaacaaatatttatctttgtgacaagttcattagagtgacatggcaaaacatttgagtttttaagtttttgaattatccaatcttcatgtgatctgttttgataactcctcattgcattggaaagtattttattgcttggcagcattttgaaaagtaattagggtacatagcttttacaagttgttttcttttaaaaaaattttaagcatcaatcatacttcattttaggttattttttttttttccgtaagatctgggtttcttttttgtcattctaagtaactttgttgaaagtaagattgttgaaagttttattgcttcaaattctagtttaaagttcataaacagcttattgagatacagataaatctttcttttaaatatgtcgaacctatttccaccctggggtctttgctttcgcttcctctttgaaatctgttcagtcttcacatagataaaaggttattcaggtcccatcttttcagatgggatgtcccctaccatccagtctgaagtgttcttcccaatcatctgctgttccataccctgttttattttcttcacagtgttcattgttatctgagttatttcatttgtttgcttatttgtctgcccctgcacctctgtgagaacagggactgtagctgttttgttttctactgtgtatgcagtgcctagaaagatccctagatactctgtagatatctgttaaatgagttaaaacaggaaagccaaataatttttatgtatttgggcttgatgtaataattgttgtttacaaataaaaattagaaatacttgatcagttgtctttgtaaaccagagtagcacctcttttttcccagtgatttaaaattatatattattgttcaaatgagtacactaaatacatctccaaagttaaaattgtggtagttaacatgacctgacttcactaaaaataccttttgctatggcataggtgggacaaatgaccttctacccaagagacagttgagaatctgtgtgtacaacaactgtgtgattagagtataattaaccttaactcagggatgggatagctgacttgcttatgcactttctctcaattagggaatctataaaaatatgtcatgagtcgatgttattcaaggacagttccctggaatacatcttagggtcagtgtgtttttaaaaaataaaagttgagactacatagagaatatgtgtagtcaaatgaaataccatggtaaaataatttattttagattctgattatttctgttctttaaattctcagttgacctggtcctttgaggtaagaaccaaattccagattttaaaaaatgacttttagaacttgaggataagtggtaattggaaattaaaaaaaaaaattagtgttttaagaacagtgctaagtactgagctagaaaatagaagacatggaaattcctaccttttaatgcattatgttattttaatccagttgttttgggtgcattacatttccatctcccctccctttaccctttcttttaggaaaaactgtgttgtggagtgcaagtgaaagccttatatctttctcatgggaggatgttctttcccatttatttcctatagctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggtattgattgtatagtcagatagttactttaaaaaattgagcatagtacattgtcttttattcaaggttatgttttcccatgtacattatatgtgttcttaaatataaataaaggaataaaggtcatgttgaaaactcagaatttgtaagcactccatcttaattgtcggtgtttttgttgtttaacatataatgataaaagatagccttttttatgttagtaggtttctatgtttcgaatagtaagtataccttttgaaattcagtttgaaaattttattttctgtgatcatacatttctacaaattactgaaaggaagtaatattaaatgagaacatgtttctgaaagttttacttataatgttaaaaaaattggtaataaaagggaaatggttaagtaaattatgataaatttttccttttttatacagtcattaaaatgtttaaaagtttatataatgaggctgggtgcggtggctcacacctataatcccagcactttgggaggcggagtcaggcagatcacttgaggtcaggagttcgagaccagcctggccaacatggtgaaaccctgtctctaccaaaaattagccatatgtggtggtgtccacctgtaatcccagctactcaggaggctgagacaggagaattgcttgaacccaggaggtggaggttgcagtgagctgagatcgtgccactgcaccccagcctgggtgacagagtgagactccatttcaaaaaaaaaaaaaaaaaaagtttatataatgaaatggaaatgcttacagtgaaatattacaggaacattccattttagctactgtatgatctcggcttttaaggatgtgtgtgctaaagaacataatcttggctctatcacttgctgtcatgtgactttggcaaattacctaacctctaagccattctgcctaatagaattttctgtgatgaagaaaatgatttatatttgcactgtccagttcggtagccactagccacatgtaactattgagcacttaaattatagctcacttgattgactaatcggatttctaattagttttaatttaatttaaatagtcacatgtggctagtggctatcaatttggacagtatgccttagtttctttatctaaaaaaattagaataatagtacttgttgagttgtaagggtttaatgagaattcatactacatgctcctgacacatagtaagtgttgtaaatatgtgcatcattattagatatgaacaggaaaagaaaaaaggaaatatacaaaaatgttaatagctatcttttggttttatgtgatctttatttttaatttttcaatattaagcatgctatacaatctgaactaaaatttaatttaaaatacttatcaagataaaatgtaatttcttttttcttcctaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggttagttacaattttatttgaatattttagacttaaagctctatttgttgtcaaaagaattgaaatctgggtggaaggaatggaaaaatgttttatatattaaataataagaaattgtgtttaagtataaaaaacacattttctgagggcatttattgacattatcagtaatctagttttatcgttgccaatttgttacattttgttttttattttatttatttatttatttatttatttttgagacagagtcttgctctcgtcgcccaggctggaatgcagtggcgtgatctcggctcactgcaacctgcgcctcctgggttcaagcaattctcgtgcctcagcatcccaagtagctgggattacaggcacatgttactgtgcctggcaattttttgtatttttagtagagacggggtttcaccatgttggccaggctggtctcgaactcctgacctaaagtgatccgcccaacttggcctcccaaagtgctgggattacaggtgtgaaccactgtgccaggcctgttacatgttttagagtaatacaaaggctcttgaaaatactgagtgaagcctccaaagttgtattcctgtaacttgaaatttgtaagaatcagactctggactttcatcttagccaatcttcaggattttatggaagagaattctaaaattaatagcttttcaaattaagaacctgataagcctgaaatatttttcactagttatatattcaacctgtttgaattttactttataatataacctgtttttgaaagagaaaggcagttgtaattagatagcctaaatatatttttaattgtgtgtcatcctcaacattttcattgtcagtgattgtaaattggtagaattaactgtgtctcataacttattaccaggaagttgcttaggataaaaataatgtagccccatagcatccataaaaatggaattgcctgattacctcacaacagcaaacccagtttctcatttccagttatagttcagttaaagaatgttggaatttttttatatgacacttttaaacatgccaagtatagcgaaaataataaaccacatgtacctatcatccagctgcaacaattatcagcactttaccaatctttaatgtgtttctcccccaacttttttttcctggagtcgttgaaagccaattccaaacagcatagtcactcataaaatatttctgtgtgagtaactcataaaatactcctgtgtaactcacaaatctatacagacttctgaaaaacataatcgcggtgctatttattacacttaataaattagcatcaattccctgttaaaattttcaacaatagagcatcagttatagtctgttagaacaatagaataaagcaataaagtattatatttattgataggatatccatgtgtatagaaaagttagttattaaacaatacataaggcctgatttagtggctcatgcgtgtaatcttagcactttcggaggccaaggttggaggattgcttgagaccaggagttcaagaccaacgtaagccacaaagtgatacccccatctctacaaaaaaattaaaaaattagctgggtgtggtggtgcatgcctgtagttttagctacttgggaggctgagatgggagcattgcttgagcccaggagttcaaggctgcggagagccatgatcatgccactgtgctccagactaggtgatagagtgagaccctttctcaaaaataaataaataaatagacaatacatagactatgatctcatttttgttaaatgatatcatgatatttgttatttgtttatatgtacccataagtctagactggtatgtataatggaattgtctctatgaggtggaaattatttgtattttgcagtttttttccacaagtaatttctgtattggttatttatgctgtattattattatttttgagacagagtcttgctctgtcacccaggctagagtacagtggtgccatcttggctcactgcaacctctgcttccagggtttaagtgattctcatgccttagcctctccggtagctgggattacaggtgtgtgccaccacgcctggctaatttttgtatttagtagagacggggtttcaccgtgttggccaggctggtctggaactcctgacctcaagtgatcagcccaactcagctcccaaagtgcaaggattgcaggtgtgagccactacgcctggccttttgttgttattttttaatggctttggatttccttatatgttttgtagtccattttgtattcgtgggccaagtttgttttgagagaattcactcattttattatttattttttcttcctgtcattgcttcaccctatgtggcaattttgccttaccctggcatctgggattcacatctcagaaccaaatcttataaatttaggaagtagggggactttgtctcctgaggaaattgagttccattctgcaggtatgcttggggcctaattcctgattgcctagatttctctgaaacttttccctgccgtgggcaaatattttattcctaggtgtacttctgaattggctgtattttaccagcacttgatttatgggcaggtgcccacttgtagcccccagagagtttggctgttgtctctctccatattattccaagaagtcaaattcctgttccctgccctttgtttatggtcttggtatacccctagtacctcctatctttagtctctgctctccactgtgggttttatttatcatcagtttggatgtatggattgtttccatatgaatttcatgatcagtttggagaggatgactattttaaatagtttttctgttatttgtatgtggttgaagcagagagagaaggtgattatgtatacccacttaacccatcttgactcagaagtctcttgttttatttatgtaatttaaagtgactggatagagaactatggtgttgaatatatactgtgtgccagatagtatttataaacttaatcagatatggagtagtatttaaaacaattgagcttaaataatgtggaatcgtgcaagtgtaatttcttggatgtcaaatagatacattgtgacttatttatattttggtacagatggcctttgaaaagcccccaaggtgtgagacaagtcatcacttgataaaccactgtcttggacagatcttaatagtgatctcatacttttaccatgaaaagtagataaataccttgttggacaagatatttggaatttaaaaaaatctcatttgtgtatattaactaagattttaaaataattatgtctgtttaccaagtatattactgttctttagaagagtcttactagtcagaaagagacagttacaagtacaaccccatccacaatttcactttccatggcttcaggtatccatggtcaaccacagtccaaaaatattaaatgaaaaattccagaaacaattcataggttttaaaatgtgcgctgttctgagtagatgatgaaatctcactccattctgcttgggatgtaaaaccttttgccagcatatccatgctgtctacattacccacccattagtcactgagtagcgagctcagttttcagattgactgtcatggtctcacagtgcttgtcatccagtaacctttatttagttcataatggccccaaagtgcaagggtaatgatgctgggatattgttaacattgttctgttttattattacctgttgttgttaatctcttactatgcctaatttgtaagttaaacttcattatgaggtatgtatgtataggaaaaaacatagtatatgcacagtactatctaaagtttcatgcatccactggaagtcttggaacatatcccccatagataagggaggaatactgtataccttaaaatttaaccattggcattttcttcattcgtttttttgggtagcagtaactaagggatttgtaagttatcagattttcacaggagatgatattattggggtaaattgtatgtagatagcatgcacccctggaaggagtgcccacactttgagtacacaaatgtgtgcatgcacatacacacacacacacatacacacacacacacacattcccctttttaattaaaatgaggaaaacacacttggagagccataatttcattttataagccaagaagctaggactaaattgtggtttttttcacccttctaagttgactttttttcctgcttctctcatgacatagtagtcattttttacttaacgaaaatctgatgtaatgaaatgacattttacaagctttaaatgaagcaaatgtttgaattctctttaagtggccttgttcttttgctttcaaaagtaaaatatgttttgttttgtgttatttagcactgggcgtttcaagtttttaatagctttattgagattttgagagagaattcacatgacatacaagtcacccatttaaattggacaattcaatgattgttagtatattcacaacattgtgcagtcattactactcaattttggagcattttcatgactgtggaaaaaaactccatatacccttttaactatcacccccaaatctccatttccattagctctagacaaccactattctacgctctttgtagatttgcctattcagggcattttatatagaagagaattatgtaatatagtcttttatgacttacttcttttcactaagcataatgtttcaagcttcatccatgtagcacataccaattcttcactcctttttatggctgaatagtgctccacacacattttgttcatcagtttatccattgatggacttgatttccactttttggctatgttatgaaggatactgctatgaacatttgtgtataagtatttgtgtgttttcatttctcttgggtacatacctaaaagtggaattgctggattgtaagataactctatgtaaactttttgagaaactgatagactgttttacaaaatggctgcaccactttacattctcactagcagggtgtgagggttccaatttctctacattctcatcagtacttgttatctgtcttttttattttagccattgtagtaggtgtgaagtataatcttattgtggtagttttgatttgcaaacttcctgtgttaatattgagttgggtttgtttttgaacacatttattttagaggaaggggcagcagatgcttctaaaccactggtggactaggtcagagggtattatgaacctcatttaaatttattcccaattaacactcattgtgattccctaagtcaagtagaacttagaatgtccttagcacaatcttgtttatgttcaggtgcatttttcattctggattactgtttcctaatgttaatttaagattatatagtattgcatttaagccttgtcaaaggaaaatggcaaaatttgactcctggttgtaaaagacaatatcctaaagatgttgtcagtgatctttatgagacacacatctttgttaagtaacggttttgtaataaattcagaaaacatggttaaataaattaaagcagaaattagctcaggagtggtggtcagaaatattttttggatctgagccaaaaagaatatttaaagcctttgattactttgaattgcctttgtcaacaatttagtcaaattatgaaaggaagacagtagcatttcaataatagctttaatttttatcatccagtgtaacaaatggaatctgttatggtatccgttatcaatggattagttacagtgtgaagtcaggaggcaatgcaggttttagttattagtgaacctaactgaataattttaggtcttctggtttgagtgctataattacgtaaataatctgtggaagggaggtttgctgaggtgcccaatgaatcatttttactgcatctacagatgcaagtcataaagtttaatccgtgtgggtaacctgtaatatgtgctgctgatgttagcatagattcaggctgaaacaatcctaattgcgattatttacaacacattggagagagcctatgtgtgacatattacttggttatttttttaaatgactcgtgggggtgggggagtgttaatgttaaaggcatacttgaatcttggagattataattaagttttattccctactcccagataacattatatatatatatatatatatatatatacacacacacacacacacacacacacacacacacacacacacacaccatacttggttagtgatgattaaaaaaaagtagttgtggagacctaaatgtaaaacacaaaactataaaacttctagaagataatataagagaaaaagtgagaactttttttttgagacggagtcttgctctgttgcccaggctggagtgcagtggtgccatcttggctcactgcaacctccgcctcctgggtttaagggattctcctgtctcagcctcccaagtatctgggatcacaagcttgcaccatcatgcctggctaatttttgcatttttagtagagatggggtctcaccatgttggccaggctggtcaggaactcctgacctcaagtgatcctcctgcctcggcctcccaaagtgctgggattacaggagagagccactgtgcctggccaagagaaaaagcgagaacttttaagatacaacatcaaaggcatgatccataaaggaaagaattgataggcctgacttcattgaaatgaaacacttctgctctgtgaaagacagggtcagagaatgagaagacaagccacagactgggtgaaaatatttgcaaaagacacatctagtaaaggactgttatccaaaattacaaagaactcttaaaactcaacaataaaataatgcaacaataaaataaacaatgggcagaatagactgggcatagtgattgactcctataatcccagcacttcgggaggtcaaggtaggaggattgcttgagcgcaggagtagttcaagatcagcctgggcaacagcaagacctcatctctaccaaaaaaaaaaaaaaaaaaattagccaggcatggtggcatgtgcctgtagtcctggctagttgggaggctgatgtgggaggacccttgagcccaggtgttcaagactagcttgggcaacatagcaagaccccatcttaacaacaacaacaaaaaaggcaaaagacatgaacaaacacctcaccaaagaagatacacatatggcaaacaagcatatgaaaaggtgttcagcatcataaatgtgtacaaacccatagaatgtacaacaccaagagtgaacccttacgtaaactgggttttgggtgataatgatgtgtcagtgtaaattcattgattgtaacaattgtgccactgtagtggggatgttgatagtggcggaaggttgggtgtggggacagggactctgtactttctgcttaattgtgctgtgaacctaaaactgctctaaaaaagtaaagtttattaatttacttctttaaaaaagtggttgtagagctatttaccttttcaaatgtttgagtccctgctttgttctgtactgggtaatgccttccaaatgtcatagcctagaagttctgaaacgaatggactgtgagaaatttgaggaagtagtggtttcacttctgggtgttgtgggctttctgatttctagaacctgactttgtcatgctttcttttaaatttaaatttttttgtggagttggggtcttggctggtcttgaactcctgggctcaagtgatcctcccacctgggcctcccaaagtgctgggattacaggcatctgccaccatgcccctgtcattgctttctttactaaagtattttaggacctaatagtccaggaaatacatatatgtatattggacaaattcatgtctgtttaaagaatagggtagtctgagtgttgtccttcattggtgctaattgggaaaagttttttgaggaaatggacactgagtagagaaataggagtaagtaggagtgcaatttgttatttggagagtgtatgttattgtatgtttttgtggttcatgtaaataccatggttgaagatgatcagaattttttcaagcatctgaaaattatggtttaagttctaaaactattgtttatcatcaactaaaaaattatgcattctcagatttctcttattttcaagattatttatgcttgcttgtattgggccccttatgtacgtaatgggactttaaaaaatattcatgtccttttagatagggagtatagccacatggttcagaaattaaagtgatttaaaaacagtggacattgagcagccttgcttcagaacctgtccttgttctcctttcctgcaaattctttttgtgtaatcttccaatgctttttaaaaatgcaaataaacaaatattttaggaagatttttttttccccagaaaaaaaggtgatgtgatttattatctgtaatttgttgcatattaaaagaacattccagtactttcataaatataagggtagatatggcaaccccttccttactatgccagttcttcacttggttgataaaagtaaaattatttattaacgccttaactcatcctgaaagataaatgactacgggggaggctaaaaacaaaataagtaactgtatactatgccaagtttgcaacaacctcatgaaagtatgtacacttagcattcccattttatagataaaagaaactcagcccatataattagcaggtatcggtgatgggatttaaaactgggccttttttttccttaaaaattatgaacatttacaaacaaagaaatgtagagagaaactaatgaagtcccatatacccatcgcacggattaagtagttacaattttatatttgtttgatctagtctttttgttgttgttgtttcttaagtattttaaaacaagtcctggatattattttgcttctatttgcttaaagtacgcatctctgaaaaatgttgatctctcttatatagcgacagtgccattttgttaaactcctccaaataagcaaaaatgataagacaaaaagttggccaggcgaccaaagctatcaactccagcctaaggaaaattcagcaatttgattatgaaagggggagggggacttcttaattgtacattttacacagatttccacaaggacagtaatagctgacccacttcgaactagataaaagatacagaggcgtgtggcagccaaagccatcatgatgttgacatgatcttcttggtgagctccaagccacctttcctaactagttttagaccaatcacaatgtacataaaagtttacatgttttaattaattcttttcatgtgagaggtataatgaaactgagttttaaataagtcaggcattggtttttaatgtatggaatttttctttatgaactcatagtatgaaatgttttttcttaaaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtaagtatgcttttcattcttttttaaaggtataatagttgatatttttatcttgatttactcagttgattagtttctttgagcagtaatagaaattaaagtttttttttactgggatgatgacatttttgaattggtaaaatctgttcttctgtaatagttgctttttgcctatgaccctgtttgcattctttttgtatcaaaaatggagtatgggatgaaggagaaaggggatgattattatattatactgttctatctcctccttttttgttgatgcttattataattctgcctcaccagccagggtgggttgtaatcactgaagtgcttggctttattctagtaaggaaagcatatttcaatttcagaattggacacttttccaattttttttttaaagtatgctaaacatggagagaaaactaagtgagggtggtattttgataacttgtagacttttttttaattttagggtaaaattgaactgtgtgccaggtttcacactgatggggaattttttactgcagagttaaactcctgactatagacttttatgatggaaacacgtggcacccatcttccacgtctgaaggcataactagtgattcattcaacccctgttcttaacctcttcagtgtggtaagcaaatcacactggctaagaaaactgcagtggccctgcaggtttctctacagtacatgcaaattcctcccattagtttcattgtaatattgatgaatgcagatggactatatgactgtatgttctgactggaaaattagatgcagtctccattgtgacttatgttcaggagtttacaatttagaggtagattaggcatattcattgagagaatttgattttttaaaatttggggtgataccattaatttgctggtttcagtgttataaacatgcttttactgaagaatccagaactattattaagtttcatattctcatcagttgccaccactgagtaatagtgtattactctgttacactttgaaattgagagagagacttcatctcggtcatctaagaggtcttagtggaactaagaatattaactgcttcattattagttatgtcttattctgaactaggctgtttagacagtaaggtttttagaagcaacctgtggacacgcactacctcttaaaaacaagttgtttcttatcccttcacctccacttctaaagaaaaaaataggtgaggtgttggtggattgtggtaatttactttataattggttgtagctagaagacacatgtgaaatgtaaagttccttaaccaaaagtgtgcagcttgttgataaagtttagatctactgttacttcttggcactttagcagagaagttatatgctgaggagaatgaaatacagaaagctggtcacttgattaatttagaatgtagggaggatgggaagagatcaccctgtccctctgatgtcttccaaatcttttctgttaggtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacactcagcttaaagtaatgcatttttttttcccgtaaaggcagaatccatcttgttgcagatagctatctaaataatctcatatcctcttttgcaaagactacagagaataggctatgacaatcttgttcaagcctttccatttttttccctgataactaagtaatttctttgaacataccaagaagtatgtaaaaagtccatggccttattcatccacaaagtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaaa

SEQ ID NO: 100 - DNA, 81519 bp, Homo sapiens
cggggcggcggcgggggccgggggggcccgggcgcgcgggagcgggagcggccgggggagccggagcgcaccatggaggcggcggcaggcggccgcggctgtttccagccgcacccggggctgcagaagacgctggagcagttccacctgagctccatgagctcgctgggcggcccggccgctttctcggcgcgctgggcgcaggaggcctacaagaaggagagcgccaaggaggcgggcgcggccgcggtgccggcgccggtgcccgcagccaccgagccgccgcccgtgctgcacctgcccgccatccagccgccgccgcccgtgctgcccgggcccttcttcatgccgtccgaccgctccaccgagcgctgcgagaccgtactggaaggcgagaccatctcgtgcttcgtggtgggaggcgagaagcgcctgtgtctgccgcagattctcaactcggtgctgcgcgacttctcgctgcagcagatcaacgcggtgtgcgacgagctccacatctactgctcgcgctgcacggccgaccagctggagatcctcaaagtcatgggcatcctgcccttctcggcgccctcgtgcgggctcatcaccaagacggacgccgagcgcctgtgcaacgcgctgctctacggcggcgcctacccgccgccctgcaagaaggagctggccgccagcctggcgctgggcctggagctcagcgagcgcagcgtccgcgtgtaccacgagtgcttcggcaagtgtaaggggctgctggtgcccgagctctacagcagcccgagcgccgcctgcatccagtgcctggactgccgcctcatgtacccgccgcacaagttcgtggtgcactcgcacaaggccctggagaaccggacctgccactggggcttcgactcggccaactggcgggcctacatcctgctgagccaggattacacgggcaaggaggagcaggcgcgcctcggccgctgcctggacgacgtgaaggagaaattcgactatggcaacaagtacaagcggcgggtgccccgggtgagtggccccaggcctgggagctggggaggatgcgcttggggtgggggccccttctggactacaggctctggtctccgaaggctgggacctgtgcttctgccgtgccccatgtctccagtcttcgctttgttttagggaaattcagagtgttccgactggcagggccagagagtttggtaggaaggccctcctgcccgttccccaggacgagcctggagtgcgggctgtggcggtggggtggggggccaggcctggtgtgtggggaaggcccgcaggcccacaggcattgcccagataggaaggcacaggcctcatgctcccgagaaagcggcctgccccaggtcagggaagttaggtccagctgggccacggcccggatgcctcaggcccaggtctttcttggggttggggtgaaggtggctgtcctcgccccgaaggcacccagcctcgaagacggagggctgcctgcctttgggccccaggagacagagcttgggtgaggcgaggcctggttttgttactggctcccgctccctgtttggtgccttgaagttttgggacacagacacaaaatgaagccaggtgtccaggcttcagtggcaggggcccgagacttggcggctccagcactgtgctggttggtctccctgggcctgccagggaccaaatcccagagtccgccgtgtggggtgagggccatttggcacccggctgaggggcctggtcagcaggctcctgggcccgcgtgctggagttactggcggcctgcgatttgctttggactcacccatttccttctctccctctgaaacgcagaggggtgcgccggagagggaggctgctggcctggctttgttgtttgccagttggaggatctatgggatccggcatgggcagctcccaggccacgaggtgccgaaattactcagtggggtcctcaggaactttccgttgcgtacctccccaagtatttgtaacttttcttttaaatatccaggcttattaaattgcacacacagaatgctgcattggctcagctattcttgggaggcctaattaattcagctattgcatcaaactttttttttctaaatctgtgaatagatgctccagcccggttttctctgggcgcccctccagcagagtgtcagatcgtggggaggaggggctgtggatggaagcgagggactgtcgcctctgctcggagggggctgcggagggtgcatgtgtgtgtgcatgtgtgtgtttgtgtgtgcgcgcttctgaccctgccaggccagggctcaggtggcagccgcctgcagacctgtgggctggggaaggatgctcgtggcagagctgcagacagacgtagcaggctggggcccttcgtgtcacacggggagttggttggggtgggcccgatggcgctccctgtgggctggggcctttctttttggggtggccgcaccctcgtcagtgcctgtggctggaggaagccacatgtcgggggggattgtgggctcgtgcaggctgcgtagtgggtcacctgtggccaaggcctgagctgctgggacacgctcacgtcactgtcttcagagctgatggcagaggatctcggttgagcagggtgtgtctgcgtttgtttttgtccgactgtgggtcatgtgtgtgcttgtggtctttctgtcttcctgggctttgctgggggcccattggagtggccagtggggcctcgttgtcacagctgacacagagcagggcccaggccacccggcttctctctccctgtggttgtgagcgccggggtccttgggccgccatagagacaggccagacaggctctggtcatctcagcggatgcctccgagccgcctttcccttttgaagtccccagcactgctctgaaatttcatttaccgattaaaaagcaattcccaggccatactgacgacgtgcacggtgtgagtgactgcgtcctctaggcctgagtggcagccacacagcctggccctggcagtggtgtcctccgcctggctccctgaatgttcaccagctcctgcgggttttcctctcctcatgctcctgggggtggggcacccatcctgcccgtgttgcctcctgctctatgttcttgacgtgggatggcggccagggactctgccctcgctcagtgcctgccctttaggctctgtgactgtgcacttgggagttctgggcttcagggtccccttaagtctcctcaggacagccgtgtgcgtgtctctgtgtgcacaggagcgacacatgagaagggagtgtggtctcagggtgggcgtggacccacagtgcccagaccctacttgtcctagaaggagtggcctgggaggccccgcctccgccctcactggccgccgttggctcctcccactcgtgtcttgacagcttattctcgggatatgttttgatttcttcacttcctttgtagcttattttaatatttttgatctgccgaagatgagggcagaacaaagaatgtactggaactctctttgcagggctgctgctcccagcaggccttcgggctctgcggagccggagggggctgaattgccttccgggtgtttgtggccaggccagggtcgggtctcctgcctgagtgggctgggtcagcgccactctcctacccatggtgggaggtgggagagggcggagatgttcccgggtcccaaaccaagtgggaggcagggctgcagctttctccttggaagcctcctgtgacagcggctgtgcctgagcctctggcctgtcggcagtgcagtggcagcatgaggggcagacagtcttcctccagatgccccctcatgtcacggggttacagaggaagcctccgcttctgtccagtggctgtcgggcccggccagcttcctgctgctgtatcttggaagaccatgtgggctgcatgggtgcttggcgagtctcctcttagggaccctggggctgctatccttgacaggggaccttgtctcacctccccactcggtcccacactggctttgtgaccttggacgagttgcttaacctctctgcctcagtgtaaactggggactactgtttattgatcttggactttatgttttgagtggtacaggtggggcacagatgggtcattgtgctgctgggagcacttagccaagactggagcctctgagccttccccactcccacccctctttcttctttccggtcggctcgcctccttcctcgggttctctgatagctgtaggactccattggactacatttttttgtcagtatagacagctgtcagagacggagacaaaatgtggcagttggagctgccgcttggcctgctgcctgggacgcggccccttgtcccgcagaacgtcagccaagcgctttccgtgcaggctgataacagggtggtgccgtgcttcccttgggccgtggcaggatcctgctccaagggggggtcctgctccgagggggccggggtttctgttccaacagggctggtggggggggtcctgttcccagaggtccgggatcctgttctgagggggccagggtcctgttctgggccgggggtcctgctccgagggggccgggcgtcctgttcctaggggcggtgggctgcctgtgtgagagctgttcttcacctgccacgtgcagtctgggcattctggtgactggagaatttgggttgtgttacagtgttgttgctctgtcctgcagatgcctgaattcccaggggtcttgcaggtccccttgcccttgcgctgtgtgggctggcgtgggtctcagtgggctgtgggttgagggtcgcttggttgggaagctctgcgcgcttcccagtggagggtccgcgacgggggttttctgatccctcatgctggcttttgacccgtgtcactgcaaggctgcccctggccccaggcagcgtttcttcaggcaggtgcccagccaggtggtcgggcttgagacctttgagtctcgaggtctgttctggggaatgactgagcttgtggaggccaggaaggggttgctgggcttggagagcctctggggaggagttgtgttttgctctttgctgttttaagctgaaatgatcacaggaagggacagcatcaagagtttctttctgggacacccctcactcagctcagcggccgtgtgtgggtttggggctgtgctctcccagacaccctcaggtccggggagcacttcgggggctatctgtccctttgtccaccagcttcctttggaaaaagtgtttgctgcaagtgtttttctccagcttttcgtggggttccctgtagtcttgggccatgctctggggtcaggctcccggcaggccctggtccccgtgcagaaggccagggtctgcgggtttgggctggtctgccccccaggtgagggttccggaaagacggccggctgctgagtcttctcaagcaggggaaacagcagctcgagagtggttcttgacctctgcccaccccagctggctgtgcacggactggggagggcatgggcagctgcccccaggtggcttctgcagggagcagagcttagtggtcattttcccggcatggtctgtcatccgtctgtctgggacccctctgggagctgggctgggtccctcgccttctggggcagcagggtcacggtgggggggctagtcctctctttcagcatcttgtttctcagccgtccctgcggctatttgtgcaatgtctgtctgtctgagtctccgggtgagggcagacaggatatggtgcgaggaagtctggggtaagtgtgagccgaaccccgccctggagtctctcggggttgtggggccacagccccagcttaggttaggccttcactgctgctggcagggcctccagagagaaggcggtggttccggggcctgggccctgactgtctggcaggaggtgtccacgccggcggcccggctctctgtggcaataatgtgtctctttctaaggattgcgaaagttgagggaggatttctccactggaagaattatgcaagcttcaactgaaatgtttttaaaaagtttctttgttttgagtcaaaatacagaaggtgaattatttccctaatatctgggagagctggaaaagaaggcccctgtccttattcttcagggctcttcccctcctgagcagtggtcaccaggccagggtgtcatggagggggggctgcctggggaccagctctttacacctggcctccagagcgggtggtagggcggctccttcctgccctgccctggctgtcaccctcgtggtctggagcagggtttttttttgttgttatttttttttttttttgagacagggtctgtttctgttgcccaggctggagtgcagtggtgcgatcttggctcactgcagcctccgtctcctgggttcaagcgattctcctgccccagcctcctggtagctgggattacagatgtgtgccaccacacccaagtaatttttttgtatttttagtagagatggggtttcaccatgttggccagcctggtctcgaactcctgacctcaagttatctgcccaccttggcctcccagagtgctgggattacaggcataagccactgtgcctggcccctggagtgggttctgccacggaaggcatccccggggtctgcgggctggaggggtcgcccccactgtgccacctgttctctcgaggcctggttgccctctgcagaccaggtgccatgccaggtgaccctcaggaagctctggctcaccccgggggctggggggcatgataagcgatagctcttaggtgctgctgctttgtgaatatgagagagttccagaagggccccgcttcccagagcctgcatgttggtttcactgtgtggtacttgatatttttccaggctgccttgctggggtggcctcgatggggggcccagggagcctccagctctggggacatgctgccacatgagcctgcttatttacgaaaatgaagaaccaggacttgagtgtgaattttaaatgagattgtggggacaatagtaaaatccagactaggaccagatggactgagcacctgcgttggccatggcccggaggtggcgtggtggtgcctggcgcctgtggccctcagcatgtgtcctgccggccgcctagtaggccttcgcttgaagtgcttattcctttgagtaatgctcctgtcttttgtttggggggaaacagataaagggggctttgagaggcgtctcggcgtgatcctgggaaacggccgagattctgttcggtgcttggtgttcgtgtcttctctgattttacctttttgactcataaagatggaaggagtgctctgcctcggtgcctctgcagctgcagatgctgaatcggggcgtttaggcctgcctcttgggctggcacacctggcggccttggtcaggccttcttgggctgcctctgctggggtgcttgtctcactggccgtgggggttgttgcctgtgtggttgtgttgctggcttcaggggctagggttagggacgcctggtcacgtctgggtccccagtttgggggccagattcaataactcactgaatgactcagtggaactctgcaggcactggcagtcaaggtttattggcaggtccattctttggctagaaggagaatgctgtttcttttctcactgtttcaccatttttttttttgagatggagtcttgctctgttgcccaggctggagtgcagtggcgtgatctcggctcactgcaacctcagcctcccgggttcaagcaattcccctgcctcagcctcctgagcagctgggactacaggtgcgtgccaccacgcctggctaattttttgtattttagtagagacggggttttaccatgttggccaggatggtctccatctcctgacctcttgatctgcccacctcggcctcccaaagtgttgggattacaggcatgagccattgcgcctggccattgttccacctttggaagaaattggttcaccgtcttctgacctggggggcgcttctaccctggttccatattgagggctgggaagttgctggaatattattacccttggctggtgaggctgagtgctgatgctcctcccagctctcagccctgcctggaccaactgcggcttctgctggaacgtcggcggctgacttagaaagaaacagctcctgttctaggcttcctgcaggtcccacggtgctgcttgtttcagagaaacgcagctcaggctggcggcctcaggtgggcatgggtggcaggggatgccatcacccaaatcagggatctttctctgtcctgagggttccaccccaggacccagggcactaactgggttcttgtgtggcccttcccgaccagacctgacccctgagctgcgtgtgtgaggtgatggtgactccacgacagcttgtgtgccgttatgggggcacctgaggactggctgacctcaccgggaagtgcgtcaggagtgggtgaggggtggtgggagggcagggagcgcccagcaggtgtccagcggtgctggcgctgcctctgtctctctgtccacgccctgtgtgtatctggagtggcttaggtgctccctgcggtgctcctggctgctgtggttcctgaaggctgcggctgtgccggtggtttcctttgatgtcagtcttcttctacaggggaaaccatgttgccaggagagccaggtgtccgctaattacgttgtgttgttctgcccaggagtgaacctgtaagtgatgagaataagaagcggctgtcagcctgcagacccgccctcaccctgtcctggttggggtgctgcctgctgggaacccctggtccagctgttgagaggaggctgactgggggcacagttgttgcagagtctgatgcaggctttctctgccgggaaagtaacatggaaacattgttgcttttactatggagcagatgtatctttgcccagaaacagaaatgctcttggtttctttttttggaaataaggcccataggctgggtccttcttgccctgttgagggaacgtgtctgtccttagcgtggaggccagtctggccgggtgctgagctcgtcctgcagaacacgcgtgaacgcctcatccctgagggccccgggaggctggcgccctctgtgggaggtctgaggttggcccatttgaccctatccaggacgggttacttaaggagtccaacgggccttgagaggctgatcaccctcgtgtggcgggcgtctctccccggtgccctcccgcctggtgctgtcaagggcttctctgtgccaggcgctgggctgtggcagccccaggtccccgcctggtgtggctgcccacggtccaggcagctccagggtgggcatccttggctccctccctcaccagctggccctgggaggtctgtctgagaggagttaggcctcattgtccgtgctcagagaacccgagccttccttaggaagcagtttgtccccgtgcctcccttcaggatcctgtggcctgagaagcctctgcgtggcagtggatggcagctccagctgcccgtggccctctttttttatggtttcccagatgactgggccaagctgggcctctgcatcctaggcatgctgttccctgcgcttccctggaaggtcggcggccctgcgtggacctacacggtacccaggacaggcctgccatggcaccggttgggcctctgggcacagggtgctctgcctccatggccctgacaggctctgatgcctgaggatgggggccgggcactcccagccttgagacttccctctgcagaggtggcacaagcccggggccccagagtgaggggactcttgcctgcctggtgagggtgagcgtggggtctggactctgacccctggtccaggcgggagaggagcacactggacagggcagccgagccaccctctgcggagctgtggacactgcgtgtgtggtgctgaaggtgtacacgtccactgaggccacctgcgccgctgcctgtgtcctgtgggctggcactcaccgagtgagagctgtgtgcagaacctccgctgtcagcgggccaggccacactggggagggaggtattccgtgtgcttgcactgaagcctgccccaggctgccttctgggttagggatacccaggacctccatagctggtgtggcgtctgtgagatctcagctgctgcttccctggacgcccgtgtggacctggaggggggtggggacccggcctggcatggtccctggccacctgcctggtgctccgggttgtgccgttggcagtgccttcgctctgcctcacctgctgcctccgcctttcctggctacaaccctgttgcccaaaccattaaaaaaattatactaccaagttgaatgatatgcaaatgtagtcaattaagcgaggggattttaattagcagtttaagttcatgtgtgaagtgccttgccttaattacttgacagttttgttgtaaatttgctaagtttttttttgcagaactatcaaaactgtgatttttgttaacattcttggatgcggtgagtggcgcccagcttgcctgaccctagtgggttttgtcttaatttataaagctctttaaactgtgaaaacaaggtaaaccccctgggttgcctctgtgtggctcttcgagtcaagccgggctcgatgtcttccttgtcactggctggggtggggacctgcctcgtgcgtggtcttgagctcccgttgggggaacgggagaaccttcatcccatgtgggtgtagccgttggcggcacctttgtacggggacacaccctggacctgaatggagtcaggaagggtttcaacctggatggcccgcgtgccggggacccgcaaggtgtgcagtggcaagggccggtcctggtggcgggctccctggtgatgctggtggatggttgtgcgtgggccttggggttcacagttcagtttgggagaggcgagaacccctcactttgaagtctttcctggccaacgggaggcttctcagagcagctttcacggctccggggctgagtgaggcctgtgtctaggctcatcctgccctccggggcgtcccagtgtgcctgggcagtggcgcagctggctccttccactgggtttaggtgtgcttctgctccccactgctgcttcagctgcgtcctttgcgggtccccgtaacttcagtgcccccacccctgttcggttccctgactgagctcggcgcctctagtgtagatgggtttttaattttcccagctgaacgtcgttatttggattgtgatttctttggtgtttcaatggactgtagatgaaggaggacctgttttctctcaggagtgtctgtggggtctcttgtcctggtttgctcagtgaagtgtggccccaagggctgagggaggtggccaggaccccgcagggtggcccccaccacagaggctgctgtcctccgggttcttctccactttctgggaccttggccgaggaggcctctgggagggtgaaatggccacaggcctggagaagcgacaccggtgggaagccaccggcagagaagtcagggaggagggagtcctgggcctggaggaacgtgggaggggcaggcgcctcctagcagcctcaagaaatgtgggccaggcaggtctggctacgggcaggagtgtgtctgggactctgaactgccagaagcacttggcggcaagccacatgctgtcacaatgttgcctggcccccatgaggaggtcccgtgggtggtggcgggtggtggctggttgtggggcaaggctgcgggactgggaccgctggcttcctggggccatcgaggctcccagaagaagaaatcaagaggattttaagaagcagagttctctttagcccgaagtaaccatacagcattaacaagaaaacttggaattcttcgaagtgaagctctctctacttgttcggaggatggaggacagttctagatccaggagagcggtggcgcagacacggacttcacccttggtgggaggggagaagcacagcatcctgttgttcgtgagtcaggtgagaggcgcgagaaaccacagctcttaggaaaatccgtgctgcccagtgtgggggccgtccacagcccttcggcactgctggggaagtggccctgcgtcgaccccaatcctcctcagctgtgttcagcccctgagatgccctgggctccctggttgagctttggtgggtaactgcaggatgcacacaggagctgcaggcgagggctttgtaggagctctgtggccgccccacatccctggcctctgccattttctgcctaaacgttgacacatggaagagggagcccaggatgctgtgggcccagaaggtggggccctgcgggctccatcacttcactccagggcacagagggcccagggtcccctcacacttgcctgtggggaccagtgggaacaattctcattttactgtcattatgaacttgcggcttaaatatgtctgtggacttcaaagtgccatcctgtgtggaaaatttccagctttcactgaagtagagagattagctcaatgcaccccatgtatcccgttcaccagttatccacagctcactcattttgtttcatccaactccctctcctattttgagggggagggattgtaattttttttttctttgagactgagtcctgctctgtcgcccaggctatagtgcagtgctgcgatctccgctcactgcaagctctgtctcccgggttcacgccattctcctgcctcagcctcccgagtagctgggactacaggtgcccgccaccgtgcccggctaatttttttgtgtttttagtagagacggggttttaccgttttagccaggatggtctcgatctcctgacctcgcgatccgcccgcctcggcctcccaaagtgctaggattacaggtgtgagccactgcgcccggccaggactgtaattttttgaagcaaatcccaggcatcatcttatttcatatttaagtgtttcaatatccacatctaaggaatatggaatcataaaaaacgctcaccatgacccattaccttgcctaacaaagctgagggcaatttccggacaccagcccatgttcaggtccttcctgtctcagaagtgttttcctgctgcttttcgggacccagggacagcactgcgtgcgatggatgggtcttccgtgcatgcctgtctgtgtgtgtgtgtgtgtgtgtgcctgtgtgtgcctgtgtgtacgtgtgtggtgctgtgatgggctgtggggacagtcccgcgtgctgacctgagcctggcagagtcaatatcttgttgggaggcagcaggccaggagagagcggagctggttggaggagggccagcctccccacctagagaccgtcggtgaccttcctcatgtgatgcgtcccttggtgtggcccccagccgctagtggtgaacctctgtaaatgtatgtgaacacttcccgtgcatgtctagtcaggagagtaatcagagaagcaattggtatgtgctcatcaaagaaccccagaacagccgagaagagtgcagagggtaaccccttctctgtctttgttcttggtgggttgggggagaagtacagtgtcctgtttgttcacgtcaggggagaggcaggaatgtaccacatctctgtcgctggaaacgtgggaagccgggatgtggcctaccgtggccccttctggccccgcaggggagtgggtgtccctgccctcactgtaatctctaccacattgatggaaagatttttctttttcttatttttggagacaaggtctcgctctgtcatctgtgttggagtgcagtggtgtgatcccagctcactgcagctttgacatcttgggctcaagagattctcccgcctcagcttcctgagtagccgggactgtaggtgggcatcaccacgcctggcggatattttttttaattttagagatgtgatctccgtttgttacccagactggtctgaaactcctgggctcaagtgatcctcctgcctcagcctcccaaagtgctgtgagccaccactcctggcctgaaagtatttttcgtaattggatttttccatatgtgcactaaggtctgcctttttccctgaatgaggcataacaagtatttctgtggctgtgttctctgtgggaatattattgtgacatgcttgtaagaagtaagtgaaaagcacaccagcacggtattcacatagcacagaaggttataaaaggcaaacgcagacatgggtgagggcagagttgttcttggtttgtcacaagggcgtgtgaacgcggttccccacctgccctgctctgctcagcagctttgggatatgagtgccttgggtgcctggtgcctttttgggccagccctgtggtattttggagtatccgttggtattgagagtctggaacttacttagtgtctggggcatgggccgtgttttggtatcgcaagagatgcttcagggcgcgtgtcagcacaaacacatcacacgggcttcgtgaccatgtgctggctgcacgagatgtcagtgtgctccgcgtaccacctgcttcatccccgccctgccctctcgtgctcctcggcagggggccgccatccttatgccccgcctgccctttctgcagctgtgggtgcaggctggccgttgtgctctgttgcaggagctcctgtcaggctgctggtctgcgcgtgtgctctccgagtgcctgtcactctggctgactcactgtgtcagtgtcaccgtgcagctttgctcgtcctgttcttgtgccttgggacgagtgggcagagtgcttgctgttgggtaggctgtggtgcaccatgtgggcctgggagtgaaacagcttggtcagagggcatgtcggtcacgccaggctgtcttccaaagcgtcccaacactccctgtcatcggtcttgttggctgtaaacgagttctctgctgcatgggatgctaggggtgtggtgagtttcttgtagacgtggcaggtcagaggggaggcacactgtctgccaggcaccctgttatttactgatacacgcacacgcaatacacatctctatagattgcttttgtatgttcactcagctgggatgattctgtgtgtgcttagatctttgttcacgtttctgatcatttccttagtggactctgagattcccctaaaaggtgggattgttttacccaaacttttctttctttctttctttctttttttgacacagagtctcgctctgtcacccaggctggagtgcaatggcatgatctcggctcattgcaagctccgcctcccgggttcatcccattctcctgcctcagtctcctgagtagctgggtctacaggtgcccgccaccacacccggataattttttgtatttttagtagagatggggtttcaccgtgttagccaggatggtctcatctcctgacctcgtgatccgcctgcctcggcctcccaaagtgctgggattacaggcgtgagccactgcacctggcccctcctgacaacttttaagattctgtcatttaggctgggcatggtggctcacacctgtaatcccagcactttgggaggccaaggtgggtggatcacttgaggtcaggttttcaagaccagcctggccaacatggtgacaccatgtttctactagaaaaatacaaaaattacctgggcgtggtggtgtgcacctgtagtcccagctacttgggaggctgaggctggagaatagcttgaacctgggaggtgaaggttgcagtgagctgagatggcgccattgtactacagcctgggtgacagagcgagactctgtctcaaaaaacgaaaagcaaaaacaagattctgtcatttagagtgtctttgttaatttgaaaggtgaaaaatctcatcatttagtttgtatttctttgctttttggtgggttgattgttttgttatttcagtatttttttctgtaacttgtgcatattacattttcttattgtggcaaaataaacataatgttgaccattacatgtagcattcagcagtgttgaacacataggctgacagtgaaggaatggaaaaagacatcccatgccattggtgaccaaaagaaaacaggagtggctccatttgtatcaaacaaaatatacttttcttcagaaactattactagaaacagaaaagtagttacagaacaataaaagggtcgaatcaactggaagatctaacaataatatatacgcacctaacctcagaacagctaaaactgtaaagcaaattcacgctgctgttcacccaccttcccaggctcagcctttgtccccatgagacactcactccccattctgcctcccccagcccccaacacccacccgccgctttctgtttctgtgactttggtgactctaggggcctcctgtgagtggaatcgcacaggatctgtccttttgtgacagcttatttcactcagcaccatgtcctcaaggcgcagccatgcgtagcctgtgtcacagtctccttccttctcaagactgaaccgcaggctgctgtatggatgtattttgtttacccatttctgtcagtggacacacgggtgacttccacagtttagctgtcgtgaatgatgctgctgtgagcacgggtgcacagtgacctctggagaccctgccttcagttctgggtgtagacccagaagtgggattgctggatcattgatcattctatttttattcatttatttttgagacagcatcttgctctgttgcccaggctggagtgcagtggcacgatctcggctcactgcagcctccacctcctcctgggctcaagcgattctcctgtctcagcctcccaagtagctgggactaaaggcatgtgccaccatgcccagctgatttttgtatttttagtggagatggggtttcaccatgttggccaggctaatcttgaattcttgaccttatgtgacctgcccgccttggcctcctaaagtgctgggattacaagcgtcagccactgcacctggccctatttttccttcttttttttttttttttttttttttttgaggcagggtctcactctgttgcccaggccagagtgcggtggcacagtctcggctcactgcaacctccgcctcccaggttcaagtgattctcctgcctcagcctcctgagtagctggggctataggtgtgtgccaccacacctggctaatttttgtttttttagtagagacgggtttcgccacgttggccaggctggtctctgactcctggcctcaagccgtcatcccgcctcggcctcccaaagtgctgggattacaggcgtgagccaccgcattcagcccgtttttctttttaaagaaccgactgtttttcatagtggctgcagcattttccactcccagcaacagcgttcgagcagcactgtctttgcatcctctccagcacttgttctgttttttgacagcggccatcctaatgggtgtgaggtggcatctcattgtggttttggttctcatttccctgatgattagtatgttgggcattttttcgtgtgcttattggccactcctatatcctctttgaggaatgtctgagtccctctttgagtcgagttgtgtgtgggggcctttgctcagttgtacgtctttatctactctggttagtgatcctgttctacttgtaaatttctgtctcctgtttgtctactgcgtgcaccgtggtcggatcctgcctctgttgctggaggctgcctctgtcctctgctgtggtggtcaggaagctggagcgtctcggcgccagattcatgtttgtaagaggagacgctctgtgagcctcggtgtgcagcgctgtctgcaagtcagactccccacccctcctttgtgcgagctgggcgggggctctgccgggactggtggtgttcatggagagggcttctgtgtgatgaagagatgacagtgacctgctggggccgaaggctgtgagtgccattgggggagggagtctcagagagtgcggcagtcgggcctgatggggctgctcttctgtgaaggggcacctaccgtgtgcctggcctgtagcagcagcaaagaggaacctgatggggggggcctcaggaacctccacctcgcccactgtggccaggctgcttctgctttctgggaggcctgtgcaagagccatgggcacaggccgggcacggtggctcacgcctgtaatcccagcactttgggaggctgaggccagcggatcacaaggtcaggagttcaagaccagcctggccaatatggtgaaatctcgtctctactaaaaatacaaaagttagccaggtgtggtggcatgcacctggtcccagctacttgggaggctgaggcaggagaatcacttgaacctgggagtcggagtttgcagtgagccgagattgtgccactgcacttcagcctgggcaacagagcaagactccatcttaaaaaaacaaaaaacaaaaaagggagccgtgggcatgtgtgtgcacaggtgtgcatgggtgtgtgcagctggagagggaagggcctgggtcaggggcgccctcagcctggagccagggaagggcagcgagaggaccccagactcccaaatgaccaagggcctgtttgcagcgtgcttctccctcctttcttctggctctgaagttatatcctgccagatcctggagaaagttcttttagcaaaatgatggcttcgctgaagatgatacttgccacctcacagaagcctgtcacgttcctccctttggaacccattgccaaatgtgggtggtgtggtggacccggggcaaggggccattctctggcagcccctagaaatgcctccctggggttggggtgcagccaccaggcaagaagtatgtacccccttgccctggccacttggggtttctgggacaatctgctggcttggccttgactttttcctgaacctaggagcccagggcctgctcctggcatcaggacttgctcttcctctttcctgggccccacaggtgcccttggggagcacacagctgccccagcccgagtccagtctggctctcgggaaggggccttactgctggctgcacaccttggcctccttcccctggatgcgccattgccaacgcagctgggacagcccttggacgcagcgtgcccgccccttttaccagggcatgtgggctgggaccagtttcagccccatgttgacttgtttggctctgctggtggtgacgggggggcgcggtggcggggggccttggtcgcgtcgtgtctgctcttgtgcaccggtgcctcacggagaggctgtggtgagtgcgcggaaggaccctggtgcttttggggactttctggagcagcccacattccttccccagagccctaggggcctggccagctgcctttccaggccctgaggccaccaggttcttggggggagctcctaggttctgctttggcctggctgggtggtgcccacactgccgcgtcccctctccggggctgcccggactcagcctggctggcagccatttccgttacttggtttccaaaggccccatcttggaatcaggagcaggctgtgggactcagggtgggttctgagcttggtgacccgctctgctcttttgtccggctttgtcctaactgttgaatattaatgaggggcgccgcagggtggctctccagtggagggtcctcactttttgttttgcaaataacgctggggcccctgcgccactggggcaatgcaactgtgacggtgctggttggattcaaaaggaagcctggcagtggcggggcctggacaggcagcctttgacctgaggcggggcggcgctctgcgctggttcagaaaagccgtggggcagcctctctggcaggcactggctgtacctgttggttttcctttgcccacagtgaagtgaaagtcactgcagctgggtttgctgtttaactcactgtctttccttctcacgtcttctctgtgcaaatagtggtcagtgtactttttgattatttcagtcaagtggaagtttctaggagcgtagagaggcagcgtggcttagggtttaggagcatggctgggctaccttcctactctgagtgtgggccacgttacttttctaggcctcagtttcccattggcccctctcctgtttggaagaggcagctgggtcccacaagccatctcaggagccgcgtctgggcgctggcacggggactgtgcccacagccagccagcctggtggtcagctgatggattcccgtaggtacttagcaaaatgcctggagtgtgcgaggctgtcaggccagtggcagatgcggtcgagtgctgttgtttcttggtgctgcctggcactgccaccctgatggtcggctctgagttggaggccagctttcatggcagcgttgttggtgggcgtgcagggtgtgtctgacctgggcctgggcatcaggtcccattgtggttgggtccacagggccccttgcctcattcgtggaggtgctgggggaattctacaggctgaggacgtgtgaggctccagggtccagcgtgcaggccggatgttcctagcgttgccggccacgcagacagccgtgccaccaggaggttccctggcaatgggagacaattgtctgctcagttcagccttcagtgccccagggctgttttgagatcaaggctgagggggaccctttcaagtgtctctgcctttggtggtcccgggtggccggctcctcacccatggtgtggtctgagtgggctgaaaccgaccccaggtgattcttattcggaagagatgtttctggaaatgagagcaaggcagtgagtggagagccagctgagagatgcttgactccccacctgctgctgttggggccaaaagcgtggaggagggaagagccagcacagagggctcacggtgtcccctgctccaaccgactcactggccgcggcctcatggggcctccctgtcctgcctcctgctcaacaggccacaggttttgttggattcgtcaattatgacccaggttgttgaactggaattggagatgtttttacagttggagagtttgttacagtcagaacatttcgggttgttggagttcggtgtcttgctgctgttgcagcttgcatcttttggccacagtttttttttttgatacagtgtcactctgtctcccaggctggagtgcagtggtgtgatcttggctcacagcaacctccgcctcctggattcaagtgattctcctgcctcagcctcccgaatagctgggattacaggcgcccgcccaccacgcccggctaatatttgtatttttagtagagacggggtttcaccatgttggccaagctagtctcgaactcctgacctcaagtgatgcagccgccttggcctcccaaagtgctgggattacaggcatgagccatcgcacctggccatggccacctgttttaaggaaaccactcagtgtcttaaaagttaagggtgctcattgccctgctcaacagagagtcccgtgtggtgctgggtagccctcgtgccgctctctggccgtcccagaacccgctgtccgttcccagcgtgtcctcgagtgtggggtggccactgctgcccaggtatgccactgtccatggctgatggaggagcaggaagtggcccatttgcaagcctgctgcctgtccttggtttgggtctttttattttgagaaatctccaaacctacatacagcgaagttgcaggaagaacgtggtgagtccccattccctgagctcagctgctgctggcactggcctcctctcgccacgactgtttttgcaactttttgccggtcatttgagagaatgtttcagtcagtggggtcctccctgctaagcccttcattctgaatttctaaaagtaaggggatgtggtgtgtgaccgtgacacggtgaccaagtctgggaagctggctcccctggccacgctctgccgtgtctgccacgccctcttcagtagtttacttctgcctgggacctgcctggcggctcagctgactcttctcttgggcctgcctcgttgccctaggcagctggctgcgcgttggcagggcccggacgggcaggtgggtagcggcagccccggggggccggtgccctatcagaggcgtgggaggcatcaggagcaagcggcccccatgcttttctcaggggagcctctcccttggtaattaatgagtaatccgccgaggggaactttggaccccaaaagtcccctgtccccatggactttatccgggtgggccaggatccctggtgagtctgcttgtcttagggatggggacgtggggcactgaccgcactcttggccactgctgctgctggagtctcgcctttctcctcccgcctgccttcttgccgtgtagtagcgctgcggaccgtgttcggaaagagtcacttactgtccgttctagtcacagttttgatgcccaagttgaccttctgttggctgcccacaggtctgggtatctgctgatgttcttttatttatttattttttgtagagatggggtctcactctgtggcccaggctggtcgtgaattcctgggcttgagccatcctcccgcctggtgtcccacagtactgggattacaggtgtgaacccccgctccctccccctgccccagcccctgctgaggtcttatttcagagccggcagggttttcccagctctcaagcgccctcacgtcccaccacagtgacgtatggtgtgttcactcctgtcctggtccccaggtcgtgtggggccatcgaggctcatccccagctgcagccgccctcctttccctgtagagccctcgcctgtgtaacggttactgcctctgtgtgggcagcatctgggggggctggcgccgggcagtgggagacctgctccatgtcactggtggaacccaatgtatgtgataggttcacaggtctcagctgtgaaattgtgtttgtacacggtggctttttctagaaaaatgaaccgcaaagtatttctttcctcgtgaatgtcgaccattttctcgagtctggttgttgttggccagtgacacaaacctgcagcttctccccttcttgcttccctccccgccccttggctccgggcacagcgtggctgaaccggcttatctggcctcgtctctggaggcctccccagctgtcatgtccgttgacatttcactgttcctggcagtggctgtgcccagacgcgccgtggcacgtgggagtgatgctggtctttgccagtgctctgcacacctgtggggaggcctctcggggtttcctgccaggtctctgtgcaccccccggtgagagatctgaggaggaggaggaggaaccgagggcaggtagggcgctcttcagatgtggagggttggaatctccagtttaataacaaactttatcctaccttaagttttcaaaagtcttgtaaagaacgggtccattcatttttagctgctccgtgaaaggtgagaaagctgagtagggggctgtgtcccaagaccagggtttgctgtggcctggctcgattgagaatcccctgggccccaggagggtgctgtggctgctgaggaggctgccccacgttctgatcctggtgcagggctgcactcagcctccccagaagcagcttggtcccgggtcccacctggcactaacctctgcagggcccctttatgtcatggtgttttggcctgtggaaggctttcgtccgtctgagctgctgactgagggtctttatttccacactcgagagaaacctggcggcccagcagtcagtgcccgcggagcaggtacagctcagggaagggagcagccccttgctcacggtcctttctggcacagtctgtggccctctggagtacccggccagcgtcctcacagctgtccccaaacgcgtggtatgggttcctccctcagggccagcaccaggctggtgctcagctcttctggaagagccgtcccatggtcccagcgcatccgtggaagagtgaaatattgaacgttacaagaaggaagtgaggccaggcgcggtatctcgtgcctgtaatcccagcacttttggagttggcgatgggcagatcacttgaggtcaggagtttgagaccagcctggatcaaaatggcaaaactccatctctactgaaaatacaaaaattagccgggcgtggttgcaggtgcctgtaatcccagctacttgggaggctgaggcatgagaagagcttgaatccgggaggcagaggttgcagtgagcccaggtcatgccactgtactgcagcctgggtgatggagtgagaccctgtctgaaaaaaaaaaaaaaaatagagttgctaaattggagtaaatatttcataacgcgattcagttcagttgctttagctgctctgtgagtccagcacccgcctgcagcgcagcctcccctgtggagtctggagcacccaggcctacatcacaggctccagagcacccgggccggtatcacgggctccagagcacccaggttggtatcatgggctccagagcacccaggccggtatcacgggctccagcacagcgggcaaaaggtgggaggctccccagactttaggtgtctggagttatccataaagggggcttcctgagttttggtgtatcccttggtttacaacccagggagaagcctggccacttgtgagtgcaggtcgtccttggacacacacttggaggaatcggaaggaacaggacacgcagccttatgttcctgtcagcccttcctgcacatatgccctgtctcagggggctgctggcctctgccagggcctcctcacttttgttcctgaggacatcttcccagcgcgtgtgcacttactaaatgagccacatgcccccagttctgacagctaggaacggtgcgagcagatggaggatggagctggtgctgctgcccacaggggccctgggagtgaggctgcgggtccctcgtgccctggtgcggccctggcttgaggccttggtttgggggtgttgtgccccccctaccagggctgagagcccacagtgacagcagaggggaggtgtgtgcgggggccgggcatcgatgctggacttgctgagggttgctttctggtggtgtgcacacatcttgggccagagtggtgtccccagagtgcctgctgctggaagagaaggctctgggtccttctggatgcccatcctggctgtgtggaccacggcggcaagggccacgtgcctggtcgtcaggccacggatgcttgtccggagctgcctcatgtggctcttgcacagaaggcaccattctagacattccaggtgggctccagtgaccatgaggggctggggttggcactggcgctgctcctctgaggtgttggacccacgtgggagctgcttgttcccctccagacactgattgtgaagaatctggaaggtccacgctagaggaggccacgacctgctggtgcgcctgcaagagtgctggcccaactggtctccatgcgtggtgcccgttggagggggtgggagggctcggctctgctctccccccgtgggtcttcgtgtcacagggtgcttgggggactctgctgcactgagatctccagcgtgacatgtccccgtcccaaacagccctgaaatggcaatgcctcatcctaggattaccgtcccttcccgaaggcttgaggtcctacttagatgtctactggactgctttttattttaatttacttgatactcagtctgggtgcgttgaagacgcggcctctggctgtcagcctgtccttgtgtgcagtgaccggtctacctgtctggccttgtgcctagacttgtggccgtcaccactatctctggggaggggtgaagtggactgggaggtaggagccgaattggagtcttctctttgttcctgaagttatcacagtcttggccagactgtggtcactgcgtgcgtgtgtgtgtgtgtgtgatgcgcagggcatttgctggtggaatagcacgggccattggcatttgcacctgaggcgtgcagcccccctgctgcacacctatggggtccctgcggtcaggtgagctctggggggtttctgagggtggagacagccacaacaacacttctttcctccaaatgcctgtgctgtgcacttgggtgcaggtggcttttaggggacatggctgggcactgccccacagtgtcacctctgtgtcctgtggtgcgtgctgtggactggcaccacaccccacgtgcttgttaggccagtttctctcaggtgtcggtcaccctaccatgcggcctttcttttgtcttttatctttagctaaggagtccatggcataccaaaagctgaatgatgacagccagtgtccccatcctgtcctccccaactttccacaggcagggacgctccccattcttgctgcatagtcttctgttgaccccatgtacctgagtgacccccacgtacctgagtgtgacaagcactatggtgcttgacctcagtccagctgcttagacctgtacctgccacagccccacgtgctgacaccttgcgtcttgagttttgataaatctatcctttggctgattaatatgactgagtggtgtcttctgaccccatttcttatctggaacactgtgtcctgacttcatttcctgtctggagcacactgtcctgacctcatttcctgtctggaacacactgtgtcctgacctcatttcctgcctggagctctctgtgtcctgacctcatttcctgtctgtgccgctctgtcctgacctcattttctgtctgtgccaccctttgtcctgacctcatttcctgtctggaacatgctgtgtcctaactgcatttcctgtctggagctctctctgtcctgacctcatttcctgtctggatctctctatgtcctgacctcatttcctgtctggaacatgctgtatcctgatatcatttcctgtctgtgccactttgtccggacctcattttctgtctggagcactctgtatcctgacctcatttcctgtttgtgccaccctttgtcctgacctcatttcctgtctggaacatgctgtgtccggattgcatttcctctctggagctctctctgtcctgacctcatttcctgtctggagccagtgacctcatttcctgtctgtgtcactctgtcctgacctcatttcctgtctgtgccactctttgtcctgacctcatttcctgtatgcaacacactgtgcccggactgcatttcctgtctggagctctctctgtcctgatctcatttcctgtcaggagcactctgtgtactgacctcatttcctgtctgtgccactcttgtgtcctgacctcttttccagtctgtgccactctgtgtcctgacctcatttcttatctgtgccactctgtgtcctgacctcatttcctgtctggagcactctgtcctgacctcatttcctgtcttgtgtcctgacctcatttcctgtctggagctctctgtgtccttacctcatttcctgtctgtgctgctttctgtcttggagttgcgtgcctgacctcatttcctctccactgtgtgttcctggagttaggcatcatcttggtttttactcccttgcttggttttctcaggatctctggctgctccgtccttgctccagcgttcttctctgccccctccctctgtggtccagaggccgatggccagctggccctcacctgcccgccctgggtatttctgtgctcttcctggtgagggattctaggggttcccctcctgggttcatccttacctgagtagccacagcacactgtgcagttgggtgcctgggaggcacgtgctttgggtgttgcatggctgacctggtaactgggcacccgtgtatggagggctggaacagaacacttgtcggcgctcctcagcgtcttgcctctggtgtccccatggcgaagtcccctgccatctgctttgggctctgacatgtgacctgactgtgcccttcaggagctttcagaacctcctcttagatctggcattcaaaatgtcttgtcagacacctcgaggcggcttgtgtttggccctgtgttgggcgcctattgggcccttgtcaggtttttgttgccaggaggctcgcgccccgatcttcgggatggtgcccgtggcatcttctgctcggtgctccctagggctggacgttggtcctcctggcactggtgctccggttgctgtggtctccctgctgttcccttgtggctcaggattactctctggaggtctccgccttatcatgagcactttctttgttggctacttttagtttcatgatttcattttcgtttctaagatatctatctctttgtaaaagctcccaccttttgtgacttgtggatgctgtatctttctcctgttgctgcagacattaatgatgtttttcttgacagtttgtcctgctggtttcctctgcattcctttggttggtttcagacctcggctttaaaggggcatttccccacattgccaattcttgaccatctggtcacgtcaaggctgacgtgccaatggctgcaagggggagggcacctgggagcccgcggatggctcttatgcagacgtgcgggccagccccgatcctgcttctgcaaggcctcccctcccatggtggcgctttggtgccagagcgcgtcggcgtggctccctagcgtctgcctctgcagctgcttggcccccagccgcctcctcccagctgcctcctgccctatgtgtgcttgagctcgagacaatgcttccttcatccaagagccgggctctcggcgatttttgagaggagaatggggttgaagcgatgttgctcttccgtcttaaaactggatttctttcctcatgcttttgaattattatatcttcttgacatgtttctctggatttgcaaaagatttttatattttatatatttatttatttacttatttatttatttttgaggtggaactttgctcttgttgcccaggctggagtgcaatggtgtgatctgggctcactgcagcctccgcctcctgagttcaagcaattctcctaccttagcctgctgagtagctgggattacaggcatgtgccaccatgcctggctaattttgtagttttagtagagatggggtttctccatgttggttaggttggtctcgaactcccgacctcaggtgatctgcccgcctcagcctcccaaagtgctgggattacaggcttgatccactgtgcccagcctgcacaacattttaagtaaatgttgacattttaagcattgagcaaggaagagtgtgaagaggtactttataaagggaaatatggcaatactgattatttgcgactttaaccagaagtaatctttggacagccagatgttattgtcttggaatgtggtgttttatctagtgacaatgtgtgtgcatgcacacgtggacacacaggattcctggtccttaaacccgtatgttcggtgtctgcagcatagaatggtctcggctggtatgtgtgggaccagctcagatgcccctattctagatgccgaggccgaatcgccccctagggaggatgggacagtggctgtgctgagcgtgctacggcgtcatggaagaacagcagaggcgtttgagaattgtgttttttaaaaagagttgaaacttgtcagtcaggaaatggagtaacaggtttatcaggagtgtcattttccttttttttttttttttctcccatgagtggcttggtcggggaactcatgtttttttttgtttttgtttttgagtcagagtctaggtctgtcacccaggctggagtgctgtgatgtggtcttggctcactgcaacctctgcctcccaggttcaagggattctcctgcctcagcctcctgagtagctgggattataggcgcctgccaccatgcccggctaattttttaatttttagtagagacggggtttgttggtcaggctgatcttgaactcctgaccttgtgagctacccaccttggcctcccaaagtgctgggattacaggcgtgagccaccgtgcctggcgggagctcatgttttatctgaggtggcccagggccccacctgggagcagggtcagcagtgcctggcccttgagtgtttgcctcggggtgtgttccttttaaatcagatcagctcatcacttggccggttttctagaccagcatattcaaacccaaggtttggaatcttgggctggcttctgaaatgacatgctgtgggctccatccccagaattctgggttcccaggtccgaggtagggactgagaatgtgcatctctagcaagttcccagatgacatggtggctcctccggaacccctgcctccttttgtgggtaaagttttacaggtgcatggccacgccccaccgccctcgccggtgctgtctgtggctgttttgtgccacagcagaaaggctgagtaggtgcgagagagaccatgtggcctacaaacccaaaatatgtgtgatttggtcccttacggaaaacacttgcaggttcctgatctagagaaagaataattgtaacgcagggctacattgtttttgtgaaactctttaggatggaaaagggcatctctgaggtcagcgacagaagccgtggtggtttcatgccaccagtttacctttgtcctgagctgtggaggttgtttaaagctatagatcaaatgaagcctggaatataagggtgcagttaggatgattgctgtgtagttattttttaaaacggctttttgaggcataattaacataagctgcgtatatttaaagatacagttagataacttttgatgtatgcaaacacatataaaacatgtataaaaccctcgctgccgtccagatgatgaacctgtccgtcacccagaagctctctcctacccacacccctttctccccaggctgcagcagtctgcttttgggcctgtagattcgttgccttccttagagctttgtctaaatgaaatcctacaatatgttcttcttttggtctggcttccttccctcagcgtcattattttgggctccttggatgcgtggcgtgtgctgggcagtgttcccctgcgtggatgtcgcgtttgttcctccatttgcccgttggagcgtgtggagtgtttccagttcttgactgtcacaaagaaagcggctgtgaacattcgggtacaagttgttgtcgggatacacggttttatttccctggatagatacctaggtgtggaatggctggatcatatatttgtgcttatgtttaacttttagaaactgccagactatcttccaaggtggctgcaccattcctcgtcctaccagcagtgagtgagagttcctgctgctccacgtcctggccagcgtgtgtggtgggcgggcttaggcgttcagccgtcctgatgggtgtgcggcggcatctccttgaggtttaagttgcgcttccccaatcgttgagaacgtagagtggcttctcttgtgcgtatttgccaccatatgtcttctttggtgaaatgtcccttctgatttttgccagttattttagactgggtttgttgttttactgttgactcgtgagatctttacgtattctggatgcaagtcccttttcacatttgcgccttacgtagactttgtccctgtccatggctttccttttctgaacggtgttttttgaagagtagaactgcaaaatttttatgggatccaatttttcagtttgttctttttctttttttttttttttttttttttgagacagggtgtggttctgttgcccaggctagagcacaatcttgtgatctgggctcactgcagcctttacctcccaggctgaggtgatcctcctgcctcagcctcctggctagctgagactacaggcacatgccaccacacctggctaatttttgtattttttgtagagacggggtttcgctatgttgcccaggctggttgcgaactctagctcaaatgatccgcctgccttggcctcccaaagtgctgagattacaggtgtgagccactacgtccggcctcagtttgttcttttggtttggacttcggtttcctagctgggaactttgtccctaactcaaggtcacagagattatctcctgtattctagaaattttgtagctttaagttgtatatttaggtctgtgatccattttgagttaatttttgtgtgcaatgcaaggtgtggacctgagttcatttctttgcctaaggtgttcagatgtttcagtggagtttgttgtaaagattagttctctactggattgtctttgtgcctttgtcagaaatcagctgtgcagatgtgtattcagttgatccacttgtttatctttttacatcaacgccatgctgttttggattattgtagctttgaaataattgttgaggtcaggtgatattcgcgctctaaccctgcactttttcagagctgttacagctattcgggatcttccacttttccatatgaattttagaatcagtttgtcaatttctgtgaacatttctgggaaattttgattgggattgtattgagtccatagataaattgggaatatcttaacaatcgggagttttccgaccaacggaaagctctctgtttatgggttgttattaatttagtattttgtaatttttagtgcacaggtttttaccatcttttgtcagatttattgatttatctattgaggttttttcttggtcttgtaaataatatattttaaaaattcgattactggatataaacggccactacagttcttatatgttgatcctgcagcctgtaaccttcctaacttgctcatgagtcctagtggcttttattgtagttgccattgggttttctgtgtagatgatcatgtcgtctgcagtaaaagcagtttcacttcttcctttccagtctggatgcttttttatttgtcctgcttaatggcaccggctagggcctccagggcagtttgaataggagtggtgggagtggacgccctcgctcctgatctcctgatctggaaggcgtggaatcagagtttggatgggagtggtgggagtggacgccctcactcctgatctcctggtctggaaggcgtggaatcagagtttgggtgggagtggtgggagtggacgccctcgctcctgatctcctgatctcctggtctggaaggcgtggaatcagagtttgggtgggagtggtgggagtggacgccctcgctcctgatctcctgatctcctgatctggaaggcgtggaatcagagtttgggtgggagtggtgggagtggacaccctcgctcctgatctcctggtctggaaggcgtggaatcagagtttgggtgggagtggtgggagtggacacccttgctcctgatctcttgatctcctagtctggaaggcgtggaatcagagtttggatgggagtggtgggagtggacgccctcgctcctgatctcctggtctggaaggcgtggaatcagagtttggatgggagtggtcggagtggacaccctcgctcctgatctcctgatctggaaggcgtggaatcagagtttgggtgggagtggtgggagtggacaccctcgctcctgatctcctgatctggaaggcgtggagtcagagtttgggtgggagtggtgggagtggacgtcctcgctcctgatctcctgatctggaaggcgtggagtcagagtttgggtgggagtggacgccctcgctcctgatctcctggtctggaaggcgtggaatcagagtttgggtgggagtggtgggcgtggacgcccttgctcctgatctggatttggcaccgtcgagtgtgatggtgcatgttgggttttcgccagtgccctttatgagtccgaggaagtccccagaatacggttcctagtttgatcaggaaggatattgggttttgtcaggtgtttttttttcttaatttattgagattattaatatggtgagtgtctttctatttcaggttactaatgtgatgaattatattgactgattcttgaatgctaaaccaattgttcattcctgggatagccccccttcagtcgtgatgtattattattttagaatattgttgaatttgtttttttttgtttttgtttttgagaccgagtcttgctctgcacccaggctggagtgcaatggcgctatctcggctcactgtaacccccgccttccaggttcaaatgattctcctgcctcagcctcctaagttgctgggataacaggtgtccaccgccacacccagctaattttttgtattttcagtagagacagggtttcaccatgttggtcaggctggtcccgaactcctgacctcaagtgatctgtctgcctcggcctcccaaagtgctgggattacaggcatgtgccactgtgtttggcctcttgagttttatttgctaaaattttgcttagaattttttttttttttttttttggagacggagtcttgctctgtcgcccaggctggagtgcagtgacacgatcttggcttgctggaacctccgcctcctgggttcaagcgattctcctgtctcagccttccaagtagtagggattacaggcgcatgccactgtgcctggctaatttttgtatttttaatagagacggggtttcagcatgttggccaggcagtcttgaacttctgatattaggtgatcctcctgcctcagcctcccaaagtgctgggattacaggcgtgagccactgcgcctgccaagaatttttgcatttatattcatgagggatgttggtgtgtgtttttttttcttcttcttcccgtgtatctttgtctggttttggtgttaacagagtaatgttcttgtagaatgatttgagaggtatttcctcctaagttttctgaagaattttttcttttaaaaatgtttggtggggggactgggcgcggtggctcatgcctgtaatcccagcactttgggaggccaagtcaggagttcgagaccagattggccaatatggtggtgagatggttcacccatctctgtgccactgcacttcagcctgggcgacaaagcaagactccatctcaaaaaaaaaaaaaaaaaagtttcgtggggctaggcatggtggctcacgcctataatcctagcactttgggaggccaaggcaggaggatcccttaagcccaggagttcgagaacagcctgggcaacatagggagacactgtttctattaaaaaaaaaaaagtttcgtggaacttaccattaaaacctactcggacccagagtgttttttgtgggaagatttttagctatatagactattcagtttatctgttcttggttgagagttactggtttgtgttacacaagtaattttctcaattcaactaaaaatgccatttctccctttgtttctgaaaggtatttgcgtaggtatagaattataggttgacttcaaaaagtttcaattttttttgtggtttaatttaatttaatttatttatttgagatggagtcttgctctgtcacccaggctgaagtgcagtggcacgatctcggctcactgcaacctctgcctctgggttcaagtgattctcatgcctcagcctcccgagtagttgggattacaggcacccgccaccacacctggctaattttttgtatttttagtagagacagggtttctccatgttggacaggatggtcttgatctcctgacctcatggatccgcctgcttcaggtttccaaagtgctgggattacaggggtgagccactgcgtccggcctgttttatttttttgtagagatgggatttcaccatgttggtcagcctggtcttgaacttggactcaagcagtctgccctccccagcttcccatagtgctgagattacacaggcatgagccaccgtgcctggccccaattttcagtactttaaagatgttgctgtactgtgttcctgcatgcgtgcttccagagagagatctgctcatcctcttcttgacggacatgcctcttctttttttctttctttcctttgtttttttgagacagaatctcactctgtcacccaggctgaagtgcagtgggacgatctcagctcactgcaacctctgcctccgggttcaagtgattctcatgcctcagcctcccgcgtacctgggattacaggcacccgccaccacgcctggctaattttttgtatttttagtagagacggggtttctccgtgttggccaggctggtctcgaactcctgatctcaggtgatccacctgccttggcctgccaaagtgctgggattacaggagtgagccacggcgcccggctggacatgcctttctttaagattgtctctttgtcactgctttgagccactttgctgtggtttccccgtgccgcatgtgtttggagtacgttgtgtagtttttgtcaggtttggaaggtgtgtctcctgcgtccctcctctgggcacttggtggcccgtgtgtcagtcatgtgaatgttgtcagctcagggtgctcttctcatcttctggattcttttttttcctctatttccctgtgagtagtttctgttactctgtgtccatatcacaaaccttttcttccacaatgtctcctccacggttaatcccatatagcggatgtttcatctctagaagtttgatttgggactatattatatctttcgtgtctttattttactcttttaaatatgtggaatacactgtaataacagttccagtgttctctgtgaatttctatgtctgtgtcaattctggttgtttgcgatggatggatgattttcttcattgtggtccacattttcttgctttctggattctagacgttttgaaatgtgcctgtttgggtgctgaatgtttttgtattcctataaattggctgggcatggtgactcacaccagtaatcctagcactttgggaggctgaggtgggcagattgcttgagtccaggagtttgagaccagcctgggcaacatggagaaaccctgtctctacttaaaaatacaaaaattagccaggcgtggtggtgcacacctgtagtcccagctactcaggaggctgaggtgggaggatcatttgaacccgggaggtggaggttgcagtgagcttcaatcgcgccactgcactccagcctgggtgacagagccagaccctatctcaaggaaaaaaataaaattaaaaaaaaatcttgagctttgtctagactgcgttcagttatttggaggcagcttgatccttttgagtcttgcttttgtgatttttttttaggtgggtctagagctgggctcagggctcattctaggcctgataattcaccactcctgtggcagaatcttctgagagacataggaccccatgaatttgggcaatttcctgtctgtcgggtggagacaggctctctgcctagcctggtgcaagcctcaggcctgttgtctctaaatctttgtgggtgactcttccccagcctcgtggagtttctgcacatacatactgtgatctggggtctgcggaattgccaggggcctctgcagaccccaggccctctgtgtggtgctcccttctctgctgctccgtcctgtgaattccagccgccatgctctccctgaattgtcagctccatctcaacccagtttctgctgggccctgcctgggtcctgcttcctgtaccatggctgggaactctcgggaggcagtgagctggggctgccagagggcttggctccactttgaattttggggaccaccgtcctttgctgcctgacctccagggtccctggggccattgtctcccatctcctgtcttgtctgcgtttttggcctttccagggaggagggtgatgggtctctgtgacttcaccttggctgcaggcgggccctggcatcgcagtccatgagtgacctccagcttctctcatcagccaccccgttcatccactccatttgtaaaatgagatagaaaatgaagatggtgctgtcgtcacagcggccggatatctgtagctcgtgggctcccctctaggctgaggctcttgttgtgggagaaagttgctcagggccaagtttcagatagaaagagcgaaagtaactggaaatgttgagatggccctggaggccctcagggtggcctctgcttcagggaggaaggtgggcaaatcacgctccgtggcagcaggtttaaaaacatcgctgaattgtgctgactggcacatccattgtgagcggatgtgttttccttctgcaataattttggctacattaaattcgttttgttaacatcttcatcaccgccttttcagtttcagcgggaattgattatgaacaaagtgccatgattttgactattcaggcgagcaactgcatcgagccagcactgaactggttttgtaacaagcttggtgtccatatcgctcttaataacatctgcaggcacaggcgacgatagcagttgtgggccagccgtcaggaaaggggggactagcacgtaccactcagaattcagcttgcgcgggctgcggtggagttctggggtttgtttgtgggcatttccaggtagtctgatcctgtgaggagcaaggaaggggtgtgttgacagggccgttcgggccggagcaggtgcgacaggaatgtcccacgtcctctcgtgtgctgtcgggagacaaacctcttcctgcttcaatatcccattcgttccagagcctcctttcagggtggaaggggtggtggatggctttgggattgggccaggcctgagggcactgagggagtggggcattaggggccacgtggtcagcactgcactctgctctcatcggaagctgggcagtggccagaggcctgggaaaggcttgttgtgggggcggggggcgcaccacacttcagggatgcagccggcctttgggcttcaggaaacgcagctgggacatcctgaggtgtgtgaggctgatgcatgggcctttctacttccagactgtcccaggacacgggtccacggtcacacggtctccaaatgagcaggaacaccttgcatgccctgcgagatgtgtttgaaagtcacactttggttccaggtcacagcttgaacctcaggccacctccagtgggaggctggaggtcctgtgtgccacccggggcctgtgtgctgtggtggtcgtggctctgtgggtgccgggcagaggcctcccaggctgggcagccgccacccctctgtggacgctactcacccttagaagcaggttcccacaggccagggcactcccaacagcactgcgtggagctggtgcccacccctgtggtcagatgcatggcgcccgcagccctggcccaggtgccccctgggttgtgcggcggggccctggctctgtgggtgggtggctgtgctgccgctgctgtcgcccatccttgggggccggcgtcgcctccctgctgctcctactgtgtgctttcttgcccctccagtgcctcccagggggctgtgtagccaggtgtctcagagggctcagggctcctggtagggtttgggtgggctgaaccctgcaccctggcccgggtgtggggtcctggtgctctgtggcctgggacacccgtgcttcctgcaggctctgcgtggcgctgatggagggcctcttgttaagggggcacggtagtgagtcaggtgcccgggggctcataagccaccttggggtatgtctgggtgcatggggactcctctggcctccccagcggtgctgagccgtcactgcagggcagccatggcccatttggctggtgctgagacaaggtgaattttcttggctggcttgacaggtccccctttccctcaccatggagtttcacccaattttcagctttgacggagaaatgaggcttggagtctttttctggcctgtgagggctgcagagcagcgtgcccaggggctgtaggtgcagtccagggagaggccatgacaggagtgggtgtggggactggtggggacagcgactgtgccttctggccccacccagagagccccagctgctgtgctgccgtattctgattccttcttccctccctccctcccttctgcctttcccctttatcctttccccccttccatgtccatttcccttttccctccctccctctctttccttctctccttctctccctcttcttttttcgacagggtctggctctggctctgtcacccaggctggagtgcagcagcacagtcttgcggcctcaaccttgttggttcaagtgatcctcccacctcagcctcatgagtagccgagactacaggcacacaccactacatctggctaacgttttatattttttgggtagagatggggtctcgccatgttgtccaggctggtctagaactcctgggctcaagcgatcctcctgcttcagcctcccaaagtgttgggatgacaggtgtgagccaccgtgcctggcccatgtttgattctcgatgcagatccagccctgggaagaaagcaccgctggccatgactgggcagagccagagagtgactaaggggctgttaggacagagacagtgggttttgcagtgatgtgagctttgacggaagtggccacactgcaggcccccacagcgtcactagtaggccaagcggacactgcgggacacgttccccaacgtgggatgtccgtcctcagcagtctgtggccttctgtgaagcaaagccgttttgcaggctgggttcatccccgttccaggcccgcactagtggcgcctggttatcaggtgtggtgaggagctttgctgccctggagcgtcgctttgtgggcagaagccaactttggaatcgcctcatggctggccctggacctctcctccttccttccttgttggttgctgttaagccagccttgggcaccagggacagtggggacgtggctgtgcaccgggcccagggctggcaggaggctgcttcagggctctggaccagagcagtgtgtggctggtggtacctgtggctggcgtgggtctggcgggtctggtggtgcctgtggctggcgtgggtctggcgggtctggtggtgcctgtggctggcgtgggtctggcgggtctcgtggtgcctgtggctggcgtgggtctggcgggtctggtggtgcctgtggctggcgtgggtctggcgggtctcgtggtgcctgtggctggcgtgggtctggcgggtctggtggtgcctgtggctggcgtgggtctggcgggtctggcatgtttggtggtgcctgccatcaggctgccgatggatgagcctgcctgtcccccacggattggagttttgcccaggggtgctgtgccctggtcattgtcccctacagccaggcagtaaagtgtggccagcaccttgctgcaagagagggacagaggtcatctgtctacgagctagagcaagggcaggtgggcccactggctggcgctgcgtctgggttcggtcctggacctgctgcgtgttatcctccctgcgggcctggcatgggagtaggggctgagagatgctggtgacaccactctgacgccacggcctgaggcagccgttggacagtgcccatcttgaatgcagccctggtgacctgaagcccctgcgttggtccctcacaggccagggggtgtggccacagggcctgggctttgtcccgtttacgagaggtcaggcggtcacagggtaatgggaggcctgtggttcctgggctgccatctggcgattgtaaaacgggcagtgtgcagtgttgagggggcgctggggaaacaagctgccggctgaggaggccgcactccccgtgcctcccgggcagacacctcacggcctttctctgggtgtctgaacccaaggtgaaaagttcaggctgtccctgctctccagaggggctggaggtggggcgggagcagagactggacctggccagcccctcccgcttcccttcctctgggcccctggactctgggggcgagggcagggctgtttggctgttggacatccttgctgtccctttgctggactctccagaggaccagcatggaggtgcacaagttcacatttgtccctctcctgccccagggcacctggccctgtcccgggccaccccaggctggaccagctgcccatgtcaccaggccaggcgctttccctgtgaatgagccgatggccgcaagtgcctggcctcaggcctgggctgtggggatgactgaggcccagtgaggagtgggctggggcctggtgtgacctgcacggtctgtgggggttggagggatgcgcgacttgggcccaccccagaacttggggtttcctgatgggtgttggggtgcacacaagcctgggctcctttgtgattggcgaccccagggtcccgggacagtccctgagaagcacagaggcctggacactcccacctcccagtcaggccctgccacatcctccctgatggctccaggggcttttgttcactgaagaacacttgctgtcctcccctcagaagagtctgctcggtgggggagccgcagggggctgctccctgtccaggccagagaaaccaggcagcctctcccgccgggagaggtcccccacaggagcctgttatggagccgcgtggcgcctgggctggtgtcacccctgggagcccccttttaaagaagactcattcaatgtccctctctcagacggcctccagcgtggcgattaagcgctcagatgctggcaggttccgcggagtgcccggctgccctcggcaggggctttgtgttggctgccctgccccgggctgaccccagacgctcgccttttgtgctacgctgctctcgcccctcgggaacctttgtcccattgagccccgccattgcctggggccccttgcctgtccctgcgggcccgccccagggcggggattgtggccctggtcccctgggggggggtagggggcttttggtggcctaaggggaccctctgagcactcatgcaggcctccccccaacctcacgtccaggtctgttgccgaggggccaggagattctgacattgtgcgatggccccagaggttgacatcctggggaggattggctggtgatgcttccagaaagtggtttttgaagatgcatctggtcctggcccgtggatggctggcgggactgggagagacactccgggccactggctgctttctcgcagctgttctcctctgggaggacttgcccctgtgggcaggtgcaggggcactgagcggaggggcttgggggcccctgcccgccccaggccaccttgctctctctccaggcctgcgtcctgcaaagaggccgggtcaaaaggtcactgccccgatttttattgctgtctcttacgttctcacgacctcttgccctctgcacagatgggcggggctggagcttccacgagggccggcctttccggggattaaaaacccactgaaaggtctgagcctagctaccaagcttaaatgtcttagtagcttaaaaatggtgttaaaaattaagcaaaacacacatagacttccaggtttagcataaatagaaaccagaggtgttgagaccgtgctgccccctcaaaccagcgcagtggaaagaggggcagagccctccacaggagccctccgctggggggttggggagacggccctggcccagcgtctgcagctcccagcggcactgaatggcagtggccgtccctgtggtctgggggcctccttcccccacaggctacacaagccctggtcctgccaaggctcggggaagccctttgtgactttagaaaaataataatggagggtgaactggttcctatttttgcattgtaattgattgccaagaacccctgaaattaaatacaaccatgtattttaaatggtgtccttaatgtagaatgtttttatcaaaaccaaaactccctgttgaggccttagtgttctgtcaatagcgtgttggagtctggttcccgtctcccctgccccggcctatgtgtgctgaccctgggaccggtgaggcagttctcaccacgccccgagcctccccctcccacgccccgagcctcgccctcccacgcccctcctgcccccgaggctcgctggcgtctgtgcttcttccaggcggagggggaggtggtaggcaccttgggtcttaaatcagagaaactgtcccagcagtagtaaaagtcatcagctggccccaaagagcccctggaaacacaggctgtaccccgcctccatggagacatttggtgccacctgcgttcagtgcagatgccacacggctcttcctgagatggcttccgaggccatttggcccttcatctcgggaacagaccaagggggtgttttcggccgtctgagacccacctgggggtgtctgggccttggccatgctgccttctccaagccccatgcttctcccggcccctcctccttcccactggcgccggagacctttggtagtgggtgtggaaagacagcagctgtggggtccctgtcctggccggccactcctccttcccgccagtgccggagaccctcggaagtgtatgtggaaggacagcagctgtggggtccctatcctggtcagagggtggcattcctcccacagtcctgggagccacagggctgagatgggacttctcagcttggcatggggagggcaggacggggtggctgccatgcctcattctgtctgtgatggaaacgggagggcctggccctgcctctgttactgagcttgagccagggacacccgtgaccctgcctggggcggtcctccccagccttgtgagccagggcagaggtgcaggttgggtggctgacctggtggggggtaagaacatccacggagaagtgtgacgagtgtgcgaccagagtgtggacccagccaggaggcctgaccgtgactgcagcctcccccagcattgcaccaaagtgtgctcgtgcaggacctcgaagatgccccgtgggcagcgttcgggctgaggctgcagggggccttgggagcacggtggccctcctgtctgttctgtggaccgggtgcggatgggccgtgcaggcagacgtgctcttgggtggttgtggtggggatgcctctccgcccaccaccctctcactcactgccctggctggaaggtgacggcatctccctgaccggcagcgccaggatggcagccccacaacagtgtcctggtcgccccagaggcatgctgagcgcccatgcgtgtgcgcaggtcctacgggccgtgtccagacccagccccggggtcaggtgacacctgtagttgggtgagcgctcacacaggcacctccaggtaagggggattgaggaaggtagcgctttgtcaatggcactggttttgctccgaggctggactccttttccctttgaggagctctgctcatgtgctttgcctgctttcccatggcaggctttttattggttaaataaagacacaaacttttcatcagtctttgcaaatacttggttccggcaagttcttggcccttcccaggcttggggctgccggctcacggttcttctctctgcatttcagccaggcccccatatgctgggtttgcaggtcacgaccacccatgacggctgtgctgcgtggggtgcagttccccgtgggcgccgagggtggtgtggggctgcctctcgctcgctccaccagccacccgagggcccgtgtcctggtcgtggccgcgtgtgctctgctgtgtgggtggtcagtcctccccaggggccacctggatggtgtccactcctgccccatggcaggaagtcccagcggcacctggccacgtccctctaacatgtttctggaagtgggattctaggctggagcctcatagcgggcagatactgccccctggccatgagccatgacagttggttgatgggacttgaaggggcctctggacagtgtggctgcagccctggaccctaggagaatagcagccgtgatggggggcagggaccccactttctgggtgggagtgaggagggccggctgctgccccttgctgcagtcatcttcagtcactttcccggccgccacggccccctcctggcttcttgctctcagcagaggggacaagacccttgtgagggtgggcacaggcactccaattgtttggggccttcgctgtcccttgctgtctgtgctggtctttccaggcatccccaggccgtgtgtgtcagcaggtggaggctgggcacctctcacccacccaagctgaagcggcctcacagggggtggcaccaggtgtttctccagctgaacaagctcgccctggaacccccaccctgaaagggctactgcccccatgagaggagcttctagagatggtggccagccttgggggcccggtggagatgtgttcgcggggtcctggtctgattctgtcttggaaggaacatcgggcccctgagaggtcagagcagtggccggcccacggctccgctcaggcgccacggcggctcctttctgtttcttgtagtcactgagttcgaggttcccacagggaggaggcttcctgtggctccgccgtcagggagcagtggggctgccccagcctctgggggctttttaggtgctctgaggcgatctgggtgtggcctggccggtgtgggcagctttgcccttcgtctgagaccccgagccctggggcaggatgaggggtgtggggagagtttgctttttccagagacgtttatctgttttttttttagacggagtctcgctctgtcgcccaggctggagtgcagtggcgcgatctcggctcactgcaagctccgctcccgggttcacgccattctcctgcctcagcctcccaagtagctgggactacaggcgtgtgccatcacactcggctaattttttgtatttttagtagagacggggtttcaccgtgttagccaggatgctctcgatctcctgaccttgtgatccacccacctcggcctcccaaggtgctgggattacaggctgagccaccgcactggccagcgtttatctttaaatgtgccttggacctggcccctggctctttgggagggagagtccttggcaggccccgttgcctccaccccaccagtgcaccttggctcctggtcactgcccaccctccctgcccgggcaggaattcttacaggccctacactcctgaagggaaatcaggctggtcctggggcaggcagcctctcagagctgttgagaattgagcaatctccttgtgctctttcaagctgttcttttctttggttcacactgagcaagggctggttgctccgatagggagaagacgtgaggagtggcatttactgtgattgagcacagggcctgtggactctcccattcacgcagccacatttcccaaaaagaagtggtcctgctccccaccccccgacccccactgcagcgccacctgcctttatctgtacttggagggacagcgcagcaggctgtggctggctaccccaggtggctccacccagctctcagaagttcacctgctgcactcagaggccgtttacttgaggtttgatatttatctccaaaggaagggctgccccgactggcctggaccctccagggagttcagcaagccggaaatgcgtgtctgctgctctcctggcccctgggccacctgcttctgtggccctgggattggggagccagggctgagggcctgtagggccccctgtctgtgcctctagaggccctgagccacctcctgcagtgttttagatcccataagcaagagacagaattgtgcatggatggtgagaaaacatgaagctttttatttgtaaacagaaaatggcagggctcactgtgtggggctggggacagcgctaggcctgctttaggccgtgcaccccaacctggggtgttccaccaagaggggtacagtggcctccactgtgagtatgtggccatcctctggctcctgattgctgagttcctgattgctgtctttgcgtaacttaggaaccccgatgaagagcccgtgctcatagctccgttcctgacatgttcaggaacgcctctgttgaggtttttctctttggttctggaattcctgggtccctttgacccctgatgcgtttgttttgggtgttgatgagcactggagctgcttccccacagggatggggcattggggagattccgacacagcagggccctcacccaggaggctgctgtgggtgctggagcggttgcttccatggagctgggattcctctcatttggggctgtaggaaggggtctttcctctctgtgctaacagttgtttgtttaaaaagaaaggctgtttaaacctttcaaacttaaaacttctttttttctttggagatggagtctcaccctgtctcctcccaggttcaagtgattgtcatgcctcagcctcctgaatagctgagattacaggcacatgctaccatgcccagctaatttttgtagttttagtagagacggtgatatggtttggctgtgtccccacccaaatctcaacttgaattgtatctccaagaatttccatgtgttgtgggagggacccaggggaggcaattgaatcatcgggctggtcttttctgtgctattctcgtgatagtgagtaagtctcatgcgatctgataggtttattaggggtttctgcttttgcttcctcctcattttttctcttgccgctgccatgtaaaaagtgcctttcaccacccgccatgattctgaggcttccccagccatgtggaactgtaagtccaattaaacctctttttgttcccagtttcgggtatatcttcttcagcagcgtgaaaatggagtgcacacacacgtcagcactgtgggcgcacacacctgcactcacacattcatcaggacccatgggcacacgtgcacacacacgtcagtcctgtgggtgcacacacctgcactcacacattcatcaggacccatgggcacacgtgcacacacgtcagcaccgtgagcgcacacacctgcactcacgcacacacctgcactcacgcactcaggaccgacggacatacgtgcacacacacatcagcaccgtgggcgcacacacctgcactcaacgcactcgtcaggacccacgggcagatgtacacacatgcaccagcacccgtggacacgtgcacgcacacatcagcacccatgggcatacatggatgcacacatcagtaccatgggcacacacacatgcacccactcccgatggcttcggcttgctgggtgcctgcttcgccctcgggtgagcaagtctggaggcaggcacttggggtggggccacagtatggttcttaggagcccagtgtcccctggacccacttgctcccagccttgggtcccaaagtgctgctcccactggtctctgtgccccacccatcatgggcagggctgtctgaacagggcagagtcacgagtgatgcaagggtggggtgtggaggccttgcctagaggcagcagccagctctggcttggctgggccttaccttcactgtcctgctgtgagacgcaggagccctgggggaggacggcagtctgtatcagggcagtggtgaaactgcagattcctaaatgtgatctggagacgactcttgctggagaaatctacccaggtcccttgggtctgtccctcccttcaccctccacagtcagggacaggctgcgtggtgtgcctccccatctgtgcgtggcctcagcgcagcaggcctgtcctgcccattgctaaaggtagagcccggcagattcattgtgtggtgagggcttccccagacccaccaactcctgtgtcttcccatggtgagaagggtggggtctctctggggcctttttttttttaggaagtcactgatgccactcaggtgggtgcccagctccccacctgatctctggagtggccccttctgctggaggctgccccaggctggatgccgtggcctgcagaccccccttcttgcagtccctgggcaggcagcacccatgcgcacacgtgcacacaggccgtgagcactgccctgtgagccaggtggtggtggggggtgttggggctaaggtttggttagggcccgagtgcttgcgcacccccccatccaatttcccatggtgctgggatgctgccgcctcctggaccctggcgttgaagtgccaccttcatctccctccccagacagtaagctccagacaagggcaggctgtggccgtcactctggccagctgctcgggggcttggtggctgctgggtggtcgcctggactctgccctcctgtctcctggtgtcccggaggggccttgctgggctgggccctccaccgccccattgggcgcctgactctcagggcgcagtcagttctttggggatggccctgatctctgagcgggactgcctctggcctttcttctgcatcccctacggaacagcagcctgctagacgccctgaggaggcaggctgaggggtggaaggggcgtggccgtgcccagcagagaccaccctctgatgacggtgggcgtcctttccagcccctctcggggcatcgcttcatcccttcccccatttccttcctggccctgctctccaagtcttgtgtgtgtggtggggcctggcttccctcccggcctctcgcctgttcccgcccatccctctctggttctctcaggcctcctctgggcttgccaggaatgtaggggaattagggggagggggacacaggaaatgcctcccctcctctgacaacagctccagctgcagggggaggggggaggggagagcagagtgggtgagacgagggagggctgaaggggggagtcggcttggggggagagtgttctcctgcccacccaggcactgggcgtggcccagccccacagacagaacagttctttcttccttattttattttttattagagacagggtctcactctgtcgcccaggctggagtgcagtcgtgtgattggcctcaagcgattctcccacctcagccttccaaagcactgggattacagcagtgagccagtgtgcccagcctcttcctaagtttacaccagtgtgggcatccagtgaggggaactggcctgtgatgcggtggtccttgtgacatgtcaggcagttttagagtagggtttgttaaaacatgggttaaattgggccccacccccagccctccactcctcagccattcaggagaagcgcgaggcatgggtgcgcgaaaattctgagtctgccttccacctgaaccccctctggaaggtctgaccacgggctgggtgtggtggctcatgcctgtaatcccagcacttttgggaggccgaggcgggtggctaatgaggtcaggagttaaagattagcctggctgatatggtgaaaccacgtatctactaaaaaaaaaaaaatacaaaaattagccggcattgtggcaggtgcctgtagtccccagctacttgggagggcgaggcaggagaatcgcttgaccccgggaggcggaggttgcagtgagctgagatggcaccactgcactccagcctgagtgacagagcaagcgtctgtctcaaaaaaaaaaaaagtctgaccacagccccttctcacaagggggctgccccttctaccctcgttggggaaggcctggtctgctgtaagtgcagtgaccggacattaaaataccccggaatggtcttggaaagagccacttctgggagtcttcccttacccgccacacaccttttaaagagaaacctgaagacacctgagaagacaggcggcggcggcgatcttcagagagaagatgcccgagaagacaggcggcggcggcgatcttcagagagaggacacccgagaagacaggcggcggcggcgatcttcagagagaggacgcccgagaagacaggcggcggcggcgatcttcagagagagagatgcccgagaagacaggcggtggcggagatcttcagagagaggacgcccgagaagacaggcggtggcggagatcttcagagagaggacgcccgagaagacaggcggcggcggcgatcttcagagagaggacgcccgagaagacaggcggcggcggcgatcttcagagagaggacgcccgagaagacaggcggcggcggcgatcttcagagagaggacgcccgagaagacaggcggcggcggcgatcttcagagagaggacgcccgagaagacaggcggcggcggcgatcttcagagagaggacgcccgagaagacaggcggcggcggcgatcttcagagagcggacgcccgagaagacaggcggcggcggagatcttcagagagaggatgcccgagaagacaggcggtggcggagatcttcagagagaggacgcccgagaggacaggcggtggcggagatcttcatagagaggacgcccgagaagacaggcggtggcggagatcttcagagagagagatgcccgagaagacaggcggtggcggagatcttcagagagaggacgcccgagaagacaggcggtggcggagatcttcagagagagagatgcccgagaagacaggcggtggcggagatcttcagagagaggacgcccgagaagacaggcggtggcggagatcttcagagagaggatgcccgagaagacaggcggtggcggagatcttcagagagaggacgcccgagaggacaggcggtggtggagatcttcagagagaggacgcccgagaggacaggcggtggtggagatcttcatagagaggacgcccgagaggacaggcggtggcggagatcttcagagagaggacgcccgagaagacaggcggtggcggagatcttcagagagaggatgcccgagaagacaggcggtggcggagatcttcagagagaggacgcccgagaggacaggcggtggtggagatcttcagagagaggacgcccgagaagacaggcggtggcggagatcttcagagagaggacgcccgagaagacaggcggtggcggagatcttcagagagaggacgcccgagaggacaggcggtggtggagatcttcagagagaggacgcccgagaagacaggcggtggcggagatcttcagagagaggacgcccgagaggacaggcggtggcggagatcttcagagagaggacgcctgagaagacaggcggtggcggagatcttcagagagaggacgcccgagaagacaggcggtggcggagatcttcagagagaggacgcccgagaagacaggcggtggcggagatcttcagagagaggacgcccgagaagacaggcggtggcggagatcttcagagagagagatgcccgagaagacaggcggtggcggagatcttcagagagaggacgcccgagaagacaggcggtggcggagatcttcagagagaggacgcctgagaagacaggcggtggcggagatcttcagagagaggacgcccgagaagacaggcggtggcggagatcttcagagagaggacgcctgagaagacaggcggtggcggagatcttcagagagaggacgcccgagaagacaggcggtggcggagatcttcagagagaggacgcccgagaagacaggcggtggcggagatcttcagagagaggatgcccgagaagacaggcggtggcggagatcttcagagagaggacgcctgagaagacaggcggtggtggagatcttcagagagaggacgcctgagaagacaggcagtggcggagatcttcagaaagaaagcccagagttccatagtgggcgggtgggcagtatttcggcttgtgtggcaccagggcagggcctccgaacccatggaaagccttgcttcccccaagcccgctggctcccagccctccaccctcatgatagggcctgggtaggggctgctggtcaccctttacccccacccaggaaaaggtcaggaggctgggctccccgtcaaggagcggtttccagggacaccggctctcgggggcgccagtcctgtccttggcgcccagcacatgctactagtgacattcgcaagggtgggtctggttctcagcctccgacctgtcaccccggtgtgggcccagtgacctcagtgagctcctcctgtgccctaagctgagccactgtgtacactgaagaggaggctggggtcctgtgtgcacctggcccgcttcccttgccggtgctgggagacgggagccagtctcggaccctcatctgccagcagctcctgtggctgtgggggcgcaggcatcttggctgactagggaggatcccgtgggaatgaccccacgccatggccagggaggcgcccccacccggcccaaccgcctttgtcggggatcctgagaggctttgtgcggaggctgggtcccaggctgggttccgagggtgccggtgcgcccctcctatgggtgaggctgtctgcttacagttgaacacttctccccacttctgcgccaggcctcactcagtctccccagcacggagctcttgttgctggcccagggcctgtccaggtcctttgacagggcaaggactcagagcctcaggggggggagggcagggcctcctgaggagtatgtctctgtgaaaatgggggtgaggaggtggcaagcatcgccttttgaggacagagtcttggagaggtgttggctttctagggagggccctgtgattctcctgcaaccatgtgggccggggccaggaccaaagccatcgtgctgtcgctgtggatttggtggccgcttcccctgctcagatgttgtactgcaggcctgggccttggcttggggtctctgtgtctccatgttcaggacaggcttgtggctttgggtaccacgaggggccatccagcccagggggcttcagggagctgcccctcaagtgcatgtggggtgctggggtgcagccctgctgcccatggcccggaagtccaggcagcactgctctggttcgaagctgccccaagggtacgggaggcccgtccactagaactgaggcctggcaccatgttgtgtcggttttcatggcgagaaaacatcgtgggcgtctgctggggctggaggaggcgggaggccgaggcagcaaagctgacccgctggcgggtgggggccactgtggcgtccccttcctgcaggaggcggggaggtgcttgtttccctccagagctgctgtctgcccgcagctagtgccctgttagcaggtgcagtgcccgtgccatcttctccccagacccagaccctccccaactcatggagaccctgtcctccgggccatcccccgtccatgaatgcccggggcttggggtccatctcctgtccacatggacctcccctcttgggtgtcacagctgcatcagaggccccagaggccggccctggggggctctggccccaacacagcgtcctccccgttccactggccggggctccctcaggttgctgccctgcctctagatccctgatccctggacccatgctgccgagacgtcctggtagggttgagttccctcctctcccaccccgaggcggcctgagaagagcctcttggaggttcaggtgacctggcctgggtcagcacagtagaggcggagctgccctcagacctcttttgtaacagttatctcatggaaacctaaaacctaattgggcaacggcagctccgtgtgaagtagagattgtctggaagagatttgtccctgttctgtggagcagggcagatgcagctgaggtgcctgggggggcagggacccttccccagtgggctcaccccagtggtgtgggggtggtagaattcaagctcacaccggcccagagggcccgctgtccgtgtggacctcctgtgactgcatgggcctcttgcggcggctccctcccgccccacaccggcctatgagccctccctggcccctgggtggctgggagggctccaggcagggaagagtcagggaggggtggatggccggcgtggctgtaagaatgacaggtggacacgggggcccaccttggcctgtgctgggggccccggtggctggagagtgagagtgggtgctctcactgagggtctgaccctgctccgcagtgcagtgtggaggtggttttggtgccacacacagcacaggtgcaccatgcgggcctttctgatgatcagaattcataagtggttttattttgtaaattaacaggacagaaaagcctttttgttcttgctaaagttttatgatttcgtgtttgggccaccagggtatctggaggctgggggcagtcgtggccagggtcagagtctgggttggagataggtgtcatgcggcagttggtgtggccgtgtggacttgtccccatctgtctagtaaatttccatctgccctgacgtcagctgcctttttgacatgcatttggaaggtgttaacaaatggacttagattcttccaggccggtcgcagtggctcacacctggaatcccagcactttgggaggccgaggcggctggatcacctgaggtcaggagttcaagaccagcatggccaacatggtgaaacccaatctctactgaaaatacaaaaaaattagctgagcgtggtggcgggtgcctgtaatcccagctactagggaggctgaggcaggagaattgcttgaacctgggaggcggaggttgcagtgagctgagatcgtgccactgcactccagcctgggtgacaaaagcaaaagtctgtctcaaaaacaaacaataaacaaacaactcttcctttgaaagttttgttttgttgtttttgttttttttttgagacggaatcttgctctgtcacccaggctggagtgcagtggcgtgatctcagctcactacaacctccgcctcccgggttcaggcagttctctgcctcagcctccctagtagctgggattacaggtgcccgccaccatgcccagccaatttttgtatttgtagcagagatgggggtttttaccatgttggccaggatggtctcgaacacctgacctcacatgatctgctcatctggacctcctaaagtgctgggattacaggcgtgagccaccgcaccagccagaaggtttttttttttttttttttttgaaacggagtctcgcactgttgcccaggctggagcacagtggcacgatctcggctcactgcaagctctgcctccccggttcacgccattctcctgcctcagcctcccgagtagctgggactacaggcacgcactgccacacccggctaatttttgtatttttagtagagatggggtttcaccacattggccaggctagtcttgaactcctgacctcgtcgtccacccaccttggcctcccaaagtgctgggattacaggcatgggccaccacgcccagcctactgttcatctttaccttgtgtaatgccagtttaagacgcaaatgcaggtcgggtgcagtggctcactcctgtcattccagtgctttggaaggacaaggtgggcagatcacttgagcccaggagaccagcctgggcaacatggagaaaccccatctctacaaaaatacaaaaattagctgggtgtggtagtgtgcctgtaggcccagctactctagaggctgagaggggaggatcacttgagcagcctgggaggcagagattgcagtgaactatgatgatgctaccgcactcagcctgggtgacagagtgagaccttgtctctttaaaaaatcataaaatgcaaatgtaagagtgtttaacttgtggaatcatcaaaattgcacagttcttgatttgaaccccaaatataataattaaagtgcgtgtgcattttattcttaccacatcagggcaaacgctgcccaaaatgaacctggctgttggagttcgcttaactcacccatgtggccacgcagctctcgctctgagtgaggacagactgcgtgtgggggctgtgggcgcctgtctccctccctcccaaggctccggtcgtgggctagtgggagaaagtgactgggtgggaccaacgcgacctcctccactggacgctctttacacgggctgggaatggcagtgggcttgcatgtggcgtgtgccacctctgctcatgcatgctctgtggtcacggagaactttgcttataaaagaacatcttatcaaaggtgaaactgttcagaatgccaatgatggggacagagcgttaagcccaggacatggctgcgtgcccacaaagccagctctggatggaaaagtaacgagtggagggcgttttcttcccagacccggtggtccagccgtgagtgtccagctgcaggccccacagcagccagctctgggcgaaaatctagagggcccctgcgcaccctcccgcccggggtgccctggcccagggtgcacctgtgctctggaccctgggccgtgcggggctccagggcgcctggagactgccattttgtgtgggaaggtggaggcgacttgggaatgcgtttctttagattttaaagatgagagagtgttggccttggacaggaaaaattccaatttggtgagaaatggaaatatccaattttttttttttttttgagactgagtctggctctgtcgcccaggctggagggcagtggcgcgatctcggctcactgcaagctccgcctcccgggttcacgccattctcctgcctcagcctcccgagtagctgggactacaggtgcccgccaccacgcccagctaattttttgtatttttagtagagacggggtttcactgtgttagccaggatggataatgtccaaatgttttatccaagtccaaatagcagtgttggtggtaggtgtgctctgcctgtgggtgggggtggtctctgtctcaaggtgggctacgagggtctgccgcagggggggtgtggacgggtcttgcatgcgtcaccttccctgtgtggggcgtgggggtggtctccccctagaaggacagggcttgtggcagccgtgagatggatggattcccagggatctcccctcaccttgggggatgagcccaggctcctttctggggtctccagtgtgtccccgatggaccagcttcctgcatggcaccgccctccggccccaccccgagccctgagccccgccttgagccctgggcgctcctggccctggcctggcactcaagggctgctttcagggctgtttctcgtctgtcttttttcttttctttcttttttttttttcttccttgagacggagtttcactcttgttgcccaggctggactgcaatggcacgatctcggctcaccccaacctccacctcccgggttcaagtgattctcctgcctcagcctcccaagtagctgggatcacaggcgtgtgccaccacgcctggctaatttttgtatttagtagagatggggtttctccacatgggccaggctggtctcgaacttctgacctcaggtgatccacccgcctcagcctcccaaatagctgggattacaggtgtgcaccaccattcccagctaatttttgtatttttagtagagacagggtttctccacatgggccaggctggtctctaactcctaacctcaggtgatctacctgacttggtctcccaaagtgctgagattacaggcatgagccactgtgcccagcagggctgtttacttaaaggtacatgttccgatccctgaattcggttttattttgaggttaggagtgagaacacgattggttgtcgtcgtttcctgtgggagtggctcttttcagaggcagacagttgtctttgctcgtgcgtgcacatttgtttgcatgcgcgtgagacccccaggtggttttgctctgggagtcgtgggatgtgttctctgctcccttcccttgtcctgagtggccttggttggccacagagtcagctggcagtggctgtctgtgggtcacctccacacatggatgaaactagcctgaggtgggctgttgttggcctgctggcatttttggggtcatggcagtgccctcaggctggtgatagtgggggtggggaccttgtctcaggtaccaagttcgtcttcatcctttgatcccctcttccaaaaactaccccctccccccgccacgtgtgtgaggcctgcagtggtgtgcacagaagccacccttgggcctgctgggtgacaggtcccctccaggtgacgggagctgcctcgctcttcctgcaggtccccggtgccgcctggttttcccgaatcgcatgcacctgtcactgagctgtcagtgtggtcagcttgctgcacccacccgggaagtggagctgggggaaggtcatgttctgcaggagacctggtggctcaggccctcaggacccagctgcccctccccgaggagcagtggttggtgagaaagcacacagaaggcagaggctagagatgcagctcctctgttatgttgagcctctctaggcagggagctcagagacccggaggtggccctcctgcctcctctctgtcaggacttgacacctgtctcagtggccatggctgtttgtcttcatccctcttcggtgagggtggcaggcggccagatgcccattacaggccacctctcctgccagccagtcttcgagggctggtcaccacgtggccactttgtgaggcccctcctctaagatcaaatgtggcactgcagagctacaccaaccccgagccccgcgcagggcagggcaggagaaccaagatcgtgggggtgggggggtgcagggcagggcaggagaaccaagatcggggtgggggtgcagggcagggcaggagaaccaagatcgtgggggtgggggggtgcagggcagggcaggagaaccaagatcgtgggggtgggggtgcagcacaggtcgtgctcccggggctggctgtagcggctctcccctcccccgagcccaccgtgtgcttcttgtccagccttttgagatgaccacagctctcagtttggccccacagcagcatctgggttgacgtccctgatgaggtttggaaacagcagagaaggggttgtcctcttccaccaagagcctggctggcctggcctccctctgggcagcacctggctgggctgactgggcagagggaaggggtggcctggccagggtgagcatggggtgcttgccactccacagagggggtgcaggaggcgcctccaggccacgttgctccaggacatgccacctccacagccccctccttggagtctttcctcaaggtcttaggatggctgtttgtgccctagcacagagacccttgccctcttgtgtggcgccgggggtccctgttggtcagggatgttcctagagtggggagggagtcggtaaggcaagggtgatgttggttgtaaggggtggagtccttggtcttaagagatcaggcagggcagccctgggctgcccccggcagagcctttgccccaggcaagtcccggggctcctgggaagaggctacttctcagcctcttgagagggcctccagggcacaggcagggagcagctgtgagggtgtggctgtgatggggactcttgactgcagtgtggatgtgagctgattgggggtaggccagccttctgtgcgggacacttgggaactgaggggacacagccgccaccctgcactgctcagcctgagcacctctctggctgtttggtgctgcacgtgtttctgggcatctgagatgaggccccagggcctttgcttccagacaccaggggagagagaccagccccagaacaacagttggcgggtgggctggggtcgtcagagcttctgacctcatcaggggctcccccagagttttctgtgcgctgccgtgtgtctgggccagcgctgggggcaagcgatgccttctgtggtttgaggtcttgtaggcaggaggaggaggaggaagagggcacctgctgagatacttcactggtctgagggccccttctgccccagctagcgcttgggtgagggttgggcttgcggagccgtcctgtaaagccggggatggcaggacgcattgtcaccccctcctgccgctcttacgaaacactcttaattgagtccgattcttggtgaatcagccttccaagaaccgcgaccgcagcatcctgtgccgcttctgtgttccgcatttttctctttctgcagcgtttcctctcattctggatggaaaggcctgtttgtctccctcaatctttggcgagggtggcaggcagccaggcggccattacgggccgcgcctcccaccagccagtcgctggcaggagcgtccggggagggagcagaccccgttcaccctcaccccagaactgaagcagcgaggggacccagacgagctgcgaatgcaggcgctggggatgctcatgccagcttgctgttcttgggagtctgtttattcttttaagctatttcagcatttaccttcagtagcatcggaggaaaagaacgatacattcgccccagtgtgtcccctgggggacctctggctaattttcggattccgaaagtgaggttttgcagggctgtgtggccactcctttgtggtcggccccagtgtcatcaggctggtttcaaatctggggtctgtggttcgaggctgagtgcagggctcaggctggatggggagggtgagaagagtggggccagacttcccggggtcagcacacacatctagggtcgtcatggagcccatggcagcactgcctggccattggcccctggtggacgcctcagaccgaggtcccaggagaaccccagcaaggttggggctgcagagggagccctccccgggacagcagctggaccagaacagaagctgggccctcccccaccccctcagtctctgcagcccccaccctccttccagcaccttcccccctggatggatgggtctttgtgttttgatgccccttggctctggcattgtgggggggccccctggggcatgaggaagagggccagtgccaaggccccgagggagcgctactaattgctactcagtttccttagaaagatttggctttttgtcatcaacagcgctaaagtaacagcaaagatgacctacttaagcgaaagaaaaatccgagtgaacctttaaagctggtattctcacttcattttggggcttggggttgtcttgcagattcaatctgtttcctctgtgccacaataatcagaaaataggttaatttaagcccaatatgaaaagtgaattatcatgtgtgaaatattaatggcacttacaaaaatagctttataatttcttgaaccgtgaaatcttcagagaaggcccatagctcacgtgagccgattcttgagtgagggtatttgggggtgcacctggaggagacagcgatggtctcagcagggtttgtctctagagtgcctcagcgcgagcttctgccagtccccggagaggagtccccacgcctccttgccctgctcagggctgcacgggagttgccacgtaggagagcacagcccaccttgggcttttggggttcgggcttttggagtttgtccaggctttggggtggggctttgcctgtagaagctctgagctgtgctgcatggtagggtgaccgcagtgggctgccctgggtgccccatgaaggactgagcagtggggtgacccttcatctagcagacgttcatcagggacctgctgtgggccaggctggggtcacactcagaactgactgcagccaggtggagaccccacctcgagagctcctccttcctagctgtgtagcccacaccccctggggagccgtagcagtgtgggggcagctctgatggaggggtgtgtacctggccacagctgtctctgggctgtggtcatcacccacaggtccttttcagatgcggtgcccacctgggtgtgtggacatgacccttgcctaagggagggagagaggaaggcctggtaccaggcagtgtcctctgcctgtgcccctgctggggaggacgtgagggcctgtggcttttaggaaccttgaggaggtgggggtggtcttctgacgccggcggggctcctgaaggtgcaggaaggcacagtttgtgcagagtccccttcggaggaagcaacgcctgtccctggcggggccgctgagccaaaggccgtgtctcagtggcaccctctcccagccgaggatgtcggcaccatttgggcccgtggacttcctccagtctctgggtggtggtgagtggggcctgctgttgtctagcagccactgttctgtggggcttcactcctgggcagggtgcacgggagagcaggggttggcaggaacccggcaaatttgtcaataaacctgaacctgaagtcccacaaggacggaggctcagtagggctcgggcctgagcggggcaggccagtgtgagctgggggttggggcaggccactgtgcggagcggggttctggccaccacagggcttttgttctgttgctttggttggcgatcgggactcaccatgttagacctgaggttcgtggtgggatccaccggcgtggccctgggtggctgccctgtgtgctcagggagcagtcacgggccctgagtggtgttgcccgtgggcctggaaggtccagccgagggttggggcctgcggatgtcgcttctctgaagatgagaagccagggcgaggcccccccccaacatctggaaggttctcctgcgtcgccctctccttccaggcacatttggccgtccccttttctgcgtgtctgtccccaccatcgtgccctcttcttctctggactgcgtttggatgatttctttgaacggtttttattctggaaagttctgctcgagcatctggtatctccctggtgtttgggatgtctccttctcattcccccgtgtcttgctttaagctgcgtgtcctcgtgtttccgctgcccctgttcttgggcactgcgttgtgttctgtctgggatccccgtgcaaggcccctgggtctggtggctgctgcccggcctctgggaccgtctacctgtcccagcccccgtttccccgcttcttcagctggcaccttgaaactccgtgccaggtgagcaggcctgtggctgcaggttcccggaatctgtcgtgggttctgggttgtcccttccagtgcaggcggtggtcaccgcgccaccatgggggtccaggcagcaggatggtcatgtgatgggggccactctgggcttttcattctcctttcatctgtggcctcggaggctccccatgttttctgaggtgcacagaacatggaggggtgctcatctcatgtcagatattggaaggatgtcgtgcaggaaggttcgagggtctcggggtggtcctgagaagccgatgtgataggtgcggcagcttcctcttcccctgagcgggggcttccagagcctccctcccactggtgcccatggggtttgagcctgatagctccgcaggattcagctgctgtgagtcacagccaggatggagaggtctaaggcaggcctgatgccgggcagggcgacatttctagaaaaggtttcatctggtgatctgctaaatggcatgaaaatcacaaaattggcactcagtgaccatcaggctggctgtgtgtggctgctctcctcaacaagcaaatggctgcccccatccagagccccgactcccgctggcctcccccgtgcggggatgtggggaccagggcaggccccagagaccacctgacctctctggcaggaagaagaccacgtcgtgccgtttcctcctcccttgagcccgttagctgtctcggggaaccggtaagcccagggccaccttgtcacgtcctccactgaacgtgggtccacgtagatgccagccccttggtcttgcccagaagttgtgggaggtgctggttgccagggatggctatgcatgtttgtccccatggcagggaggcctctgggggcctggccctccccccgctagctgcttctcacatttttgtctccccgagagccacctgctctcccagggccctcaggcccccgtctgccagtctcctggcacctgggctggggtctgcgccaggcaactcccacagcagggcaggatccaccctccacgttatcattactgccatcccctgtgcctgggttggaggccacgcccacccagtggggcccctctggaaaggagacttgacctcagggtggtggcagggctctgtgggatgcccctggtgacagggaccagaatgttccctaaagtggatgtcaggcccctggctcagatggagctttctgttcttgatgggctttagaaggtgaaaaactaggcttccagaggtgaagttgcactgtgggctttgtggcaggtgagcgctgcctgaccctgaacagctgctaaagactcagacctggagccttcctggtgtcctgtgtgtccacgcaggtgtgccagtgtggcagccctgcgccaggagctgcccctgcatgtcatggcagcatccatgccagccgagcgcccctctggctcccaggcatctcatcctgtctggctctgagggccgtgctgcagtgaaaaccattcaccttgacagtttggctttcgaccaagaattcactgtcatatttttgatttttaaaattaagactgtattcagatataatttgcgtaccataaaattcttccttccacagaatatggtttaatggtttttcagtatatgcagccatcatcatctaagttgagaacatttttgtcacccccaacaagaagccccatgcacatggtccgtcactccccaggccccaaatcccagccagcactgatcttggccattggcctgtcctggtcattccatagaagtagagccacgtgactgtgtgtgtgtctgggccacgcgtggctgtgtgtatgagagccatgcgtgactgtgtccgggtcacacgtgactgtgtgtccgggccacgtgtggctatgtgtccaggccacgtgtgactgtgtgtgtccggcctcagcacagtattttcaaggctccttccttccttttcatgactgaatcatactccattgtctgcacagaccacaatctatcccgtcatttgtctctggatgcttgggtggctgcactttgctgctgtgagcacttgtgcacaagctgtcgtgtggatgtgtgttttcagtaacctgcgtgtacgccgaggactggaattgctgggcgatgtaactgtgttaagcttccgaggacctgccagactgttttccacagcagctaaataattgtacgttcctcttagcaatgcataggggttcctgtgtctccatgtcatcaccaacacttgtccaaactaaaaaattctaggccaggcgctcatgcctgtagtcccagcaatttgggaggccaaggtgggcagattgcatgagttcaggagttcaggaccagccagggcaacaaagtgaaaccttgtctctaggaaaaaaaacaaaaaaaaaaaaacaaaaaattagctgggcatggtggcacatgcttgtagtcccagctactcaggaggctgaggtaggaggattgcttgagccctgggtggttgaggctgcagtgagctgagatcgtgccactacactccagcctgggtgacagagcaagactccgtctcaaaaacaaacaaacccagttctagccatcgttgtgggcgtgagttgacgtctccctgcggtgtgattgcgtttccacagtgaatgatgtcaggcagctttgcatgcggttactggatgttagtatcctgtttggagaaatggctactcgaattctctcccatttggaaattgggttgtgttttgtgttttccttgctgacttgcagagttcttcatgtgttctgaatctggtcccttaccagctaccgggtttgcacgttttcccttgcatcctgtgggctgtcttttccctttctcgatggtgtcctttgaagcacaaagacgtcgtgattgttttctgggaagccttgttgttgtgttttctctctgttccttgtgctttggtgtcatggaagcacttctgcgggggcgggagtctggactgaggccgccacgttcctgctgtgaaaaccttcacgtgcgctcgcagcctcggctctacagacggttcagtccgggaaatggtttaaggaggccgtgcacagaaacagtctttgcagccagggacatgagagcataccgtgctgttcccacaaggcccgtggcctctgcaggtgagaattggtggcctcccttgaaaatactgaatggaggtgccaggcacccgcacaggctcttggtgtgggcataggccgtcttccacttgaagaatgtggcaagatggtctgaaaaccacaaagtttgtgtttggagacacggtctcagtgtgttgctcaggctggagtgtagtggtgggatcatacctcactgcagcctcgaccttttgaggtccagtgatcctcccacctcagcctcccaaggagctggcattacaggcataagccaccacgccgggcccacggctgaagtttgggttgtatccttttaaggaatagcagacgggttttcagccacaccgaagagaacctcagcgtagcagagtgttgctgggccatgtgcttcaggagcagggccacaggcaggacctcgagtgcccagcccgctcaccacgctgtgggcggcctcttgggaatgtcagaacaccagcacaggcgatctcctcggaacccagattgtgggcgatcctgccgctccacctgctgtggccccagggttgcaccaccatgtggactgtggctggcagcttctggaggcttcttggtgcctacaacatctgcgccactccacagcgttgcctattggtggcagccatcccctccataagcccgtggcccctgtacagagacgaattggcgctcacggactcaccctgcgaggcagcatctgcgtctgcaggacttcccggcccttggccgcacatttccctccagttcccatcatggcagctgtgcctggttgcggatgctgcatgctgaggagaggaggcgtgggcccgcccggtgtgcatgggcaggtctgagactggccactcccatggcgcatgcattcccctggagggtccccttgccccgtggctgcagcctggcaggagaagacgctgaggggacgcacgggaggggttgcagggtgggctgtgctgtgtggcaggccttggggtgtagccgcaagctgtgggtccatccccccgcaccagagtgcagttttgacaccgggtggtcatgggccgagcatccatgcaggtgtggagacggaagcctgacccacagagcttggtggtggcccctggactgacctgtgggctgctcaaccgctctgccactgtgcgttgttcacatgtgaagccggcgtcacaaaggcctcaatgtctgtttcagctggatacatgcgcgccctcgtgggggcttgagggcacactggccgctggacactggggtcccggggtgactgaggctggtgccctcctgacaggttgctgggctgcaagttgaacagaaaactggttttcttcactctgcgaagttccctgtggttgtccctggggttggagggagttgtgttgacatcatcatggctgctgctgtgcgcctctcccttggagcaggtgtggtccccggctcctggattggctgcccatgctcaggatggtctggggtgtggccgtggcctgtccccgggccggatggctttctcagcagctccctgaggcagcatgagcagaggcgggaccctgcccgggtcctgtttcccccttgtatcctttggccctaatacggggtcccgtttaccaatgagggcaaagagaccagtctaaggggaggctgaaaactcacaggcaggcctgtctggccttggggtctgggtgctgcttccaggcagaccacatcccaggtgaggtgcagacattcagagacagacgtggccgatcctggctgctgtatcaacgcgcccaccaaatggggccttctttgatcatcagtcaaaagcaagaatgtgcctgtggtgggcgggcgcgtgtgccagcttccaggccgtgggctccttggtgcccagagctcaccctgtggtgcttgcccactactcactcccgcctccccggagtcttgccctggggggtcctggtgtgggagctgccttctctagttgggtggagccttgcctgctggtgcctgtgagccctgggtgggtggatgccgggtggtcgtggaggttcacagcaggctctatgtggttgttttgtgtggatttggggtgtgaattctctcagcaaaggctgactcagaccccagtgttcagaaggttcaaggaagcgaccgtcagcgccgagtggccagcagggcggggatgcggcgttgagccccgtcattcagcttcagtgtggagaaggcccggagctgtgggcatcagctcggggacccgagtgactgtccctgcctcggggagggggggggccacacgggcaggcggggcagcagcttgtgcccatgtcctcctcacggactctggaagtgagaggcgctgaggccacagtgggggaagtggcccagctgacgacccgggctctcggtgccctgggaggagctgttgttaggacatgtgcagactgggttcagcctgtctggagtggctcaggtgcctggggacagaggccagctgtaaccgctgctgcactcggttctggattcagtgccctccgcctctgcggcgtctccctcggcagctgtccaggactccagcctccctgccagggtaggggacatggagcgtctccttgctctggggggttgaggtcttctgtgtttggaccctgtgggatctggcaggagaagcagcccccactcatgttgtgccaggggcctggggaagggagatggcagttctgtgacctccagactccctttccttattgcaggggatgggccagcgtttcgccctgagcatctgcacgtgtcaggcaggaaagggtccccaaggccttctcaatggctcttctctgttcctggcaccttacaggcctgaaacgcagggcccccaagggtggggtgtgcatttttggagagcgtcttttctgagactcccccatggggagctggtggcttgcttgtggcagtgtactgtggctgcccagtcctcggcaggcatccactgctggctcacctgtttgggccaccgcctctgcataggtcctgtgggctttgctcaggaactgttccgtcagagggcctagggtgtccacagtcttgggcccgctattcctcagcccagccctgccctgccctggcaggggggcacctgtccttgggtgcaagctcacacgcgttgcccgggtgcctgctggccaggtagcttgcctggtcatcctcggggtgtggggaaggaccccaggaggggaagtggccgcggggcagcgcggtgtgtcgtctggcctccgctgtgtaagctgacagtggcctgaagggctttgggatggggcagccccttgcaggcctatccaggcccagccccattgctttggtgtgtcaggtccagagccgtgctcctgcctcgtggcctgtgggctccaagggcgggttttgaagccccaggaagggtcacaccagaggcaagcggtcgtagctgctcttcccagagtaagactcagccgtctgtcactgggtgtggttttgtccctgaccgacagctgacactggggcccccaggggccttggtagggcgggtggcatcccaggcctgaagacggctgtctgcttcctggggctttgagaaaccaatactgctcaggtgacagtccctctgagagtgtcacttcctccgcccacaggggcgcagacaccttctattttacacgtttctctccgtttctctgatgctgcagagagcccgccctgagagccgggagtcgcctgatgaggggtcggcaggggtcttaacggagtcatgtctccgaaggctcgtcctggctccctgaagaccaggagcgtccctggccccaaggatggccctgagcccatctgcctcaaccctccagatctgcagggtcctcggccaccccccactgagcggattgggctcggggccccgggcctacggtcctcccgccacctccacggggcggctgttggggccccaccaggcagagccgtgttctcaggcgttggctctcatggaggtggcctgaggcatctgactctttcccctcaaggagtctctgagtctcccggagtcagcgccggctgttgtggcttttccccgggtgataactgagccgaatttccgcgcccgcttcagtggctgcttagacaggaagctccacccagccgggcgtcctcggccttctgtgcctctcgggagggtccgcatgattccggaaggggctctgctgcagctaggatggcacccgcccctgccaggcataggcacagcaccctgcggtcagggcctccgccagacgtcatcaacactcacttcccctcgaaagccgccacatagagggggtattttcagtgtcttttttcctgaacagctattttagtgtctctgaaaaaaaccatccacagccgtgagccttcaggggctgcctgccctgcgtccccggccctgtgcgcccgagcacttatctttctcccttgggcccaggtcagagccaggcacctgcccctcccctggccccaccctgcttgttccctgagggctgcagggtgggtgcacgtgctgcaggggaggccacgggctttggccagatcttcccccagggccctccatccccataattggagcaccttgatggacagcctgccctgcgccccatcttccccctagggaagcagggtccctgctgcctccaggaggctggttcctgatgcagcgtcttctcctagagtcctggaggtgggaagagcccccggccctgagtgtgctctgtccaccaaggcttcctggctgagggcaagggcggagcccccaccgcccgactttgctgcctcctcttgaggttggcctcggcagagtgagtgggacctcacccctgtgaagggccccttgccctgtgtggcctgttctgcattggcctgtggtgtagacctggtgccagctgccctggagactctgtgctgtcctgtggggtctttggcagtagaggaatggcccattttacggagactgccctgtgattttgcttgggaagagaccttgggtctcagttgtgccttgcgggcagcaccgtctcaggggtttccagccgcagggctgtgggagttcacgtttgcctgaggctggatgtaccggctcaggcccccagcacacaacccacatcactcactggctcttgggggatgtgcctcagcacctgacacacaacacctggttctgagtgggctgggtccaggcaccttcgctaagcttcctccaccagcgggacctggttctgggtgggctgggtctgggcaccttcgctaagcttcctccagcaccggggctggcaaggagcgaggcaaaggtgtgtgtggtgccatcctgtaggagccaggctccttggggatggtgtccttcattttgaaaatgtttccttcccatggggagggggcagccagaatgcccactctttaatgcacctgtgccagtggcccacagggacacggtgtcccctccccgcgaccacccctgtgccgcagctgcccttcccagacgcatccgtcgtgagtggctctcgccgtgctgtggctggttgagctgagtgcccagcgctgggcaccctctgaggacacactcgggttctaggaaaggggtttggcaggagaaggacgagggactcctggccaggctgagccgctgtggaaggggagagtgggtcttggtgctccatcccaaacctgctgcagccgtgggtgaggtcacccggaatggcaggacaaggtccactctgttctctcggagatgacttgtccctcagcacagcctccacgtgcctgttgcgcgtggcctaagggcctttatgcaaagtgaacttggtctcctggggggtgccctggaatctgccttctgcgccactcagggtcgtttgtggccggagtgcatggggctctgactgccatgtgccagccacggggctggtggagggaccctgccctgggaaccacaggtgccaacaaaacctttcattgatcgcaggtctcctctgagcctccggcctccataagacccaaaacagatgacacctcttcccagtcccccgcgccttccgaaaaggacaagccgtccagctggctgcggaccttggccggctcttccaataaggtgctgtggggcctgtcggggtccttggggtggtgggtactgggcccttctccttgggcagacccagcggctggcagctccacctgcccgctactgagggctggcacccggcgcagcctcagggacatgaagtggcttgtttttctcctggtcactcacacagacaactctttctcgacagagcctgggctgtgttcaccctcgccagcgcctctctgctttccgaccctggtcccccgcagtgtcagcgagtgagaaagagctctccccacacctcccggccctcatccgagacaggtgagtgggcgccattcacaggtgtttctgatcacgggggaggctccacgagggctgtgcatgcggacgcgcccatgtttctgcaggctgggtgcccagacctgccgccttttggtcagggcagtctcggtgttggttcctttggctggcatcagggagagcacacctagagcgttccctgtgttctgggtggagtcgtgggtggagccctgtctgctgggcgcagcttcttgatgtgttggcctgtgtctggccttcgcaagagacccagcaagcagaaaacgcttacgggttcttagggaactgtaagcttgacttgaagattcggagctgggaaagtctttcctgtttaacaccttcagagggggtgtgcgccaggatgtgtctgggtggtgcttggggacagaggcaccttcccgacacccgcctgcccctccagcttctactcctacaagagctttgagacagccgtggcgcccaacgtggccctcgcaccgccggcccagcagaaggttgtgagcagccctccgtgtgccgccgccgtctcccgggcccccgagcctctcgccacttgcacccagcctcggaagcggaagctgactgtggacaccccaggagccccagagacgctggcgcccgtggctgccccagaggaggacaaggactcggaggcggaggtggaagttgaaagcagggaggaatgtacgtgtgagtcgctttctgtgcctcctccctgtgggctgtgggggtggcactggctgaggggggctggtcgccgggggtgcgttggtggccccatgtttcgcaggttcctccgggagcggcgcgtctccctggtgtggagctgccgggcacttccatgactttgtttctgtctctgcttcctcctcagtcacctcctccttgtcctcgctctcttccccgtcctttacctcatccagctccgccaaggacctgggctccccgggtgcgcgtgccctgccctcggccgtccctgatgctgcggcccctgccgacgcccccagtgggctggaggcggagctggagcacctgcggcaggcactggagggcggcctggacaccaaggaagccaaagagaagttcctgcatgaggtggtcaagatgcgcgtgaagcaggaggagaagctcagcgcagccctgcaggccaagcgcagcctccaccaggtgagcggggcgagtggtgctgggaggtccagggcacgggcagtgagcacagcctgcaccaggtgaacgggcacaggtggtgcctcctcccttcctggctgccccatgcgctcctctctgcctccacctcagtgggcctgcctgggaccttgggggtccgtctcccaaaagctgcagccctgggtatggtgagcccctcagtgtccccaggctgatggacatcccaggaggccactacatttggcttgaccacagctttccccatcaggatcacacaccctgcgtggtggccccactgaggaagtagccatgtttctctggtataagggaggccgggctatttttagtggcagaaagagttgggagcagctgcatggagacagttccttgctctgtgtgctccaggagtgggtgttcacgcgctccgccagcaagacctggcgtctgcaaaacacaggcgtgaggggcgtgcttactaatgcctggtgttccagaaggcggctcccgccaggcctcccgagtaggaaggagagggctcggcccgcacagacacacacacacccacctgcacacgctgcttctctgggctctgcctcacggttctcacgctgcagctccggtctcgcgcctccttttacgttgtttaggtttctttctgacatgactgagggaagtgcggttcacaggcagagctgcctggggagagaggtgtgcaggcggcccgttgttcaccgggccccggcctcgctaaattcacacctcggcggcgtctggcagcttccgcggcgtgggctttagcacaacacaaccccgtcggccctcagagctgcagggttgccgacgtgccctcctgcgcgtgccagtccctcgccccagcacgtcccccgccactgttgtccttgattctggttggaggtgtgatttcccacatacatattcatgtggtgtgtttgcagcgtggggtgtgagtcacacggatattttaatggggagagtgggggggcttgcggaggcgccgggcggatggacgtgtccatctggctgcgtggggagacccggggccctcagatggtgcgatgtctgaggctgccctcctcacattgatgggagccagggcctacttggcttgctgcccccaaggggaacgtggccctagataccgggggaggccccgccgcagcctcaagtgactgactcaggcccccaggtttagcacagctgccacaggcctggcggaaactccggatgggggtctgaaaagcctttgtggggtcggggcaccacacgggttgggctgatggcgcgctgggggcggggctccagggcacattgtcagatagatgaccccacggggtgggctgaggactgctggtcatggtgaggggtgtgctgggaccggctgggcagtgaccccgagccgcctccggcccccaggagctggagttcctacgcgtggccaagaaggagaagctgcgggaggccacggaggccaagcgtaacctgcggaaggagatcgagcgtctccgcgccgagaacgagaagaagatgaaagaggccaacgagtcacggctgcgcctgaagcgggagctggagcaggcgcggcaggcccgggtgtgcgacaagggctgcgaggcgggccgcctgcgcgccaagtactcggcccaggtatgcgggtggggagactgaggcacgcagcacggtgggcgtggagccgccgtgggccccggtggccagtcctgcccagccggaaaggccttggagcagaagccaggcccgggaccacgttccgtgcgtgcccccccgacgggcacagggtgggtggttgctgggccctgcgtctcgtgagcctgtgtcctagcaggtggaggaggggccggcacgcggcactggggagggacagggagcggcgcaggagcctcgggtgggggaagcagcgtcgggccggggcagggcagcgagcaggcgccgctgaccactcggctccctttcagatcgaagacctgcaggtgaagctgcagcacgcggaggcggaccgggagcagctgcgggccgacctgctgcgggagcgcgaggcccgggagcacctggagaaggtggtgaaggagctgcaggaacagctgtggccgcgggcccgccccgaggctgcgggcagcgagggcgctgcggagctggagccgtagattccgtgcctgccgccgcagcgccgccgacaacgcgggtgcaggggggcgcggctgggcggtgcagctccgcccggctccgcccctgcagcccacacagcacaacgtcttaccgtgcctattaccaagcgagtgtttgtaaccatgtagttttggaacccactgcaaaattttctactggccaagttcaagtgagtaagccgcgtcccccaactacagctggagacggggccagctcggcggcctgctggtcctctgcttgctggaacattctaacatttacacttttgttataagctatttaaaaccagtaaggagacttgaaattcagaaaatcaacacatttttaaatgactaacttctaaaagccccaacacatgacgccatctgaagacccgcaacggagtgggggtggcggccgccccaccctccccacccggggaagccatcacagctcatctgcccgcggctgcgtgaggacagcaggggtttttcttcagagtctattttttcagcgacaaggacccaggtcttcctgctgctgccagggagagcagggacagtgccgcgtgcgagatgagctcgaacactgcccgccttactgccgcctaccccgcccgccacgccgccgtcgatgccagcgctgtccccacgggtaccaggaagtgcagagccgcacaggagctgccccggagctgaggggacggtcttcggctcctctgcaccccgtgattctgcccacgctcctccaccacgaggcactgacctgcgtcgggtggtgaccgtggctggcggtcacgccctcagcccctccgggcacacgtgccgcctgaccgggcgacccttttcagttcggcaaacgtcgctcccttcattttgggactgaggctgcagcattggaacaaaagagcattatttcaatttttctttctttttttttgttcgttcatttaaacgtatatttagaactgcactttgtccacaaccttcccttctctttctattccccagtgaactgaggtttttaccgatttatagagcagtcaaatccgaagtgctcgagtgcttagaaaccccctctggtgcttggttgaacaagggaatcacaagaaaacgaaaatgcaaaaactgaacttcgggggtcgttctgtgccttccagcatcttgtacagcaaatcctgactcgtgtctttttacccccaagatatctgtcttcagtagcgactgaatctgccactctcagaataagttccttgcatttattccaaataatctcgtttactctcacctgtttatgcaaattgtataaggtttcttatgcccaagcttgaaaaatgatttcccagtagacaagaggcggctacctatcctacagttacggtatttatttacataagaagatcttacaggagttctttgcttgaatccgttctaacacccgcggcagctgcacgcgctcacagaaggtggaggttacttgcccaggtacagacgacctcggggcagtgacgagcaaagaccagagactgctgagccctcgcatctgggtggcggaattgcctgcggggttttgcccttggtttactgaggggggtcttggttgctgctgaagccccccaccccttctaaagtgcaatgcaaaagggacatcatgtatatgcagcgtttgtttggaattttctttgcttttgttttctttgcggttgttctgtgtgcatggattccacacctctgccgtaggtagatccgtcagcgggcattattaccgtgtcttgtaaagggtcggttttgttatgcaacatgcagaatgctgtttttagccttgttttaccagagttgttttttttttcagttatttcttcaagggaaactaaatgatttagttggagcaaagctttaagtgtgttggcgtgcttctgtgtggctgtcctgtgtcgccaggtcgaagatcacagtgaggtagaggccctgccccatccccagggccgccaggcttgctccgtttgctttgagtttttagaccccagagggagatgagcttttccaagctgtgtctgggccagagcctctccttgcccttgctccatcccgacggtcaccgttgggtccacgcctccaccgccccatcttgccccaaacggaaagcgctgtatctgcagtggcagcccttccccacttcggctctgggagggtccagccagtgtcacctgggcccaccctttcctgcagctgccaggcccgtgcggtcagtgggacccggacgtgggcaggcgagctcgggaccctcccaggcagttcccacagctcttgcctcggctcaccagggtcacttccactgtcaggggcctgagggggcagctgtggctgcagggctgctctggactgaggggtcccaggccccgaggggtgcacgcctggctccccttggcacaggtgcgagtccgtttcttttcagcagaagggggaagaggtgtccgctgtgtgggctgctgactcctctgtgtgtgaggcccttcatctaagtgattgtgtattcagtttaattctcattatatttctatactgaaagaagatttttaacgaagggaaaaacaacagcaataacattcatatctctggagcagctaactcatacacgtaatgtctgcttttcgtacagaactagccaatgtaaaaacagttcacctgtaaatactttttcctttttcaccgttgtattatacatgtatatgctgggtcctttttcagaaactcttttcttacctgagagttgtcttgttttctgggctgtttttaactgaggaaaaaaaaaatgctttcctgccggggggcaggggagacggagaaacccatgtgcgtttcccatgtgaccccctcctccctgtgggtctgagccccggccccccccacctcctcctccctgtgggtccgaaccccggcccccccaccccctcctccctgtgggtccgaaccccggcccccccaccccctcctccctgtgggtccgatccccggccccccccaccccctcctccctgtgggtccgaaccccggccccccccccaccccctcctccctgtgggtccgaaccccggcccccccacccctccctcagcccaccagggtccagggagatgttcgttctcgctttaagtcaggagtcacaaatgacttttttttttcaattaaggaaaaagctccatctctacctttaacatcacccagacccccgcccctgcccgtgccccacgctgctgctaacgacagtatgatgcttactctgctactcggaaactatttttatgtaattaatgtatgctttcttgtttataaatgcctgatttaaaaagaaaagagcttggcatatttatctatttcgctgtgtacctgttagtccttccccgaccccgaaacagatgacattgtacaataaaggactttgagagga

SEQ ID NO: 101 - DNA, 39165 bp, Homo sapiens
gatgtgtgtggggttcggagccgcgccggcacagccgaagggagcgggcgagcggcgacggcggcggcggcgggcacaggtgcggctccggcttacggcggcgacgcggcggaggcggcgggaggccagaggcgctcaccctcctaggagcccgacggcggcgacaggggcggtggggaattcacaaagctcgtcgagcttacccgggcaccgaggcccgagtagggggtttggatgcgcgggtcccgggtggggtcggggccagagggggtcgctaggcgggtgttccacggctgatcacgcttcgttggccccaggcggtgggcgccggcagggcagggcgctgtagttgacgggagccgcggggaccccggagacccggacgcccgtcaccgcccccctcccccagtccagcagcgctccgcggggatgccctggtctcgacccggtccgtcagcccccggcggcgcagggatccgcgcccggcgcctaaactgccctggtgtcctcttcgttctggcccggggctggcgcggggaggtgcagcattaggggcgctgaggtgacacccgagaacttcccagggagagggtgcgcgggggggtggatttccacagtccttcccgcggcccccgcgggggggcggtgttgggagggcacttggggttatcccaggctcgccggtgggggtggggggactcctccctttacttccctccacccccttgcacacccacccccaggcttcccgtgtcccttgttctccctctctccgggttagagataggtgggtggctttgagtgggcggaggacttcagggttttaggggctcccccattctaggtcatgcctcttgctctcttccttggcctgtgttgagtaaggtgtgttcctgtggtggacgaaagtctgtacgatggttggtggcattggtccttaatcctttgggtctgttttaaggtaaagtgctgagagtttgggaagcaaaaatttctatttattggatttcttttggcttttctctcaagaaggaagtggaaaaagagtcttttctttttccctcttcctccatttgcattctttgtgaggtttgtctgccttgtgctttttgtcccggattagtcttgttgaaggatggagattcccaggcgtggagtctatagcttttggcttccattaagtaaaatcgctaacctttttttaagagaaagttaatttttgcctgcagtcattccagaaaaatagtgtacacggactagctgaattaatccacttaaaattgtaacttagttacatatggtagatatgttaactcctatctgatttttttggatgaaactgttgttttgtttttaaataggagatgaagtaatggatttttttccctcccttaaaatggcatagctgagaaagccccggtactactaattgagatgatctgcttaagagtcttcatattctgaactcgaaaggccttttatgttatattattgctcgctttacgcaactccaaattgctttcctatttaaatgaatgttcttctagtaaactggtgttagatttaaagaaatcactcaagcttcaccttggtaaactgaactcagtttaagattaagaaactgatttcggccgggtgcggtggctcacgcctgtaattccagcactttgggaggcccgggcgggcggatcacctgaggtcaggagttcaagaccagcctgactaatatggtgaaaccccgtttctactaaaaatacaaaaaaattagccgggtgtcgtggcttgtgcctgtagtcccagctactccggagtctgagacaggaaaattgcttgaacccgggaggcggaggttgcagtatgccgagatcgctgcacttcagcctgggcgacagagcgagactccgtaaaaaaaagaaaaaaaaaaaaataaaagaaactggtttcaaattggccctttggcctctggagcaaattcaaatgtaactcttccccaaccccccttctcttcttccagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtggtaaagattaaatttggttgcatcattttgacttgtgtttgagtctagattttatggcacaaggaatggcataaacttttcatgtgttttggttaaaacaaaccagaccattgcattgaccctggacatctttaattgagaaattggtaactttattttaatatgtatatctgaagaattcaagaaaacaaaggcatcctcagaggtgtgcctcttttctttattattagaggcaaaacgaacaattttataggatttgtagtgaaattataccagattataaggagaaccaaaactaagtcgcaaaatttattaatttaaggggctctcgctttgaaagtttgagagtaagttacgataggcatttgtatccattcattactttcctcttttcaaataagcaactaaatagaaatgctaatctcagacttaattatttaacagaagagtgtaccatggaaaacctccagacaaatttctccttggttcagggctcaactaaaaaactgaatgggatgggagatgatggcagccccccagcgaaaaaaatgataacggacattcatgcaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaaggcaagttttttatatcaatttttaataatggtaatggtttactttgaaatgaaaattctatgtttagtgtgtaacttaacctgtatgttgaacattgctcatgcaacaacaacaaaataccgattgatatatttgtattgcagtttttaggccataaagtgctttgcagtatgtttcctcatttgactttccaaacatcctgtgagagaagtaagactattattccgttttacagataaagtgaatgaagctcagagagataaaatgactttcccaaaattatgtagccagggagtggaggagttagggcttcttttttttttttttttgtgcttttagtagaggccaggtttcagcatgttggccaggctggtcttgaactcctgaccgcgtgatccgcccaccttggcctcccaaagggctgggattacatccttgagcccctgtgtccagccagggcttctttttcttatcctctttggcacacatcttgcttcttgaccactacatctgttgtttttctaggactcgataatttgcgctttggtgttatctccatttgcaaatggtacaatggccacaattcccgtgggctcaaaacagcatttttcagagatacacctatgatttctgatgtttctatgtttggatattcaggcttgctcaatatttgaaacaaatggaaaagacatgtatctgaagaatttgtgatttgaaaggaataacaaaaaaaatgacagctagagtaaggaaaagttattttaaactaataaaatattaatataaaaacctgccgggctcagtggctcacacctgtaatcccaacactttggggggctgaagtaggtggatcacctgaggtcaggagtttgagaccagcctggccaacatggtgaaatcccatctctactaaaaatacaaaaattagacggatgtggtgtcgcacacttgtaatcccagctactcaggagctgaggcaggagaatcgcttgaaccccggaggcggaggttgtagtgagccgagattgtgccattgcgctccagcgtaggcgtcgagggaaactccatcaaaaaacaaaacaaaacaaacaaacaacctatcaacaggtgggagcaatgaatggctcacaatcccagcactttgggaggcccaggtgggcagatcacttcaggtcaggagtttgagaccagcctggccaacatggtaaaaccccatctctactaaaaatacaaaaattagccaggcatggtggtgtgtgtttgtagtcccagctacttgggaggctgagccaggagaatcgcttgaacctgggaagcggaggttgcagtaagccgagatcacgccaccacagtccatcctgggcgtcagagtaagactccatttcaaaaaaaaaaaacacaaccacctatcagccaaggtatcataattttatttttcctgctgcattatctagtaggctaaactattattttcattccaaggttttgaatgccgaggtaatggacaagattgggattattaaatatttagtttcttgatcgggttgttttatattttttcctatttgactaaaattaatgtgtaataacagttcctaacactaagtgtttaaaatgtggcaaacattattcttgagcagttttacatatataattttatttaattcttaacaagaggttggctgtgtttcatttaggaactttgaatttttccactattagttttgattccttgaaatatccttgcccatttctattttacagaagaaatgaataaagcatattaaatgactgactgaaggtttattcacagcaaagttagagcttggactagtccttaagacttgggatcctgagctttattctggtgcctttaaggttttgagggaaatttagttaacagtgtagtttaagacattggttaagcctaatgaagataataattttagactcatttatggtagtttgctgcttgctgcttccagaagaccagcactttgaaatttcttgccagtggctgctagataagtttatattcttcaggtgtagttattaactgatttttttttttttgagacagagtttcgctcctgttgcccaggctagagctcagtggcgcgatcttggcagattgcagcctccgcctcctgggttcaagtgattctcctgcctcagcctcctgagtcactgggattacaggcatcagccaccacaccctttaatttttgttatttttagcagagactggtttcgccatgttagctaggctggtctcaaactcctgacctcgggtgatccacccgccttggcttctcaaagtgctgggattacaggtgtgagccactgctctcggcctattaactaattttaaatcaggattgacttcaagccagtgctcagtgtagaacttgcttacagttggacttgtcccgtgctgaagtttgtgctcagagattatatttcaaaatgtggaatgccccttttgatatttgtgatatcttgcccccaagctaattaggtgctgtacttttttttttgtagagacaagtcttgctctgtcgccgaggctggagtgcagtggcacgatctcggctcactgcaacctctgcctcctgggttcaagcaattctcctgcctcagtcttccgagtagctgggacttcaggcgcccaccgccatgcccagctaatttcttttgtattttagtagagagggggtttcaccatgttgcccaggctggcctcgaactcctgagctcaggcaatgcgcctgtctctgcctcccaaaatgctaggattacaggcgtgagccaccatgcccagtggtggtctactcttacatgtctgttggaggccacatttgccagatattgttgctcccgtctttttttttttttttttttttttttttttgagacagagtttcgctcttattgcccaggctggagtacaatggcgcgatctcagttcactgcaatctccacctcccagattcaagtgattctcctgtctcagcctcccaagtagccggggttacaggtgcccaccaccatgcctagcttgttttttgtatttttagtagagatgggattttacagcctagccggctggtcttaactcctgacctgaggtgatccgacctcctcgtcctctcaattgctgggattacaggcatgagccatggcgcctggcccgccccagtctaattattagtctgacataagtgtattttggataaactacttttcctaatattcttgctctgtgtttatgtgaaaaacatctgagaaccatgataaaggtttaaaaaaaaaaagatgatggattaatttacttaactgaaacaatgtgctgaggtttggttaacactgaaaccatccttcgtctgggatgtaatccctttttgtcccagaattcactgatttgaatacattttcgattttaggaaggtgtgagtttctttctgatctttttgctgtgttatattttgcagtatttgaattagtgtttgtggtgtattttgatattgcttgtaattttatgtgaatttgagaaatttaaaggaatttaagaaaatttcaaacacccatactttaagaaagattcttttctttggttcatatttaatacgtacttgagtggttgttttattatgcttaccacttcacgttttaaaaacgtactcagaacattgtgaagtacacttattttttagggtctgtgaggaaggtgaatgacaatatttccacctcttagatgagtcacatgctcctggttgtataaccagaatcaggagttgaatacagggcttctaactcgaagtttagtaatttttcactatttgcccctgaagcacatgttagtagcagaaactgaattttgagaaacattaacttttcttatcaatttaccttagtacaggttgagcatcccaaatccaaaatctgaaatgctctaaaggccaaaactttttgaatgctgacatggcactcacaggaaatgctcattggagtatttcagattttgatttttggatttgggatgctcaactgccatatcgtgcacatattccagaatctgaaaaaatcagaaattcaaaatacttttggtcccaagcatttctgataagggatattcagcctctatgatggttctcaaactctgttttaacctgcatataaatttaaatactaaggtatttaactgagaatgagatagtccttgactgaggaacagtttttattttcttctgtgagtcattgagttggttgccaaacaagccaaattgacccagagggagctcattttaaaaagtcaaactaggctttttttttttttttttttttgagatggagtttcgctcttgcgcccaggctggagtgcaatggcgcgatcttggctcactgcaacctccgcctcctggattcaagcgattctcctgcctcagcctcccaagtagctgcaattacaggcgtctgccaccatacccagctaatttttttatttttagtccagacggggtttcaccatgctggccaggctgatcttgaactcctgacctcagatgatccacctgcctcggcctcccaaagtgctgggattacaggcatgagccattgcgcctggccttttttttttttttttttaagactgtactaaatatattaacgtgttatgtaaaggacctgatgtttggtgtgaatactgacatgatttgacatgcgtatatagtttatgtaatcaaagtattgcttttggattaaaaaaagtcctgaaactcagtaagttgttcgaaatgaaacaacttaattattttacaattataaaatatgtaatatattaatacattttaatgttaataagttgtagtatcttgtaaattataaataatttgaaatgagacaacttaattaaatatagctaataactctttcttactcaagtcgccataagaaatatacttgattttaggccaggcgcggtggctcatgcctgtaatcccagcactttgggaggctgagttgggtggatcacctgaggtcaggggttcgggaccagcctggccaatatggtgaaacgccatctctactgaaaatacaaaagttagcaggggatggtgacacacgcctgtaatcccagctacttgggaggctgaggcaggcttgaacccaggaggtggaggtttcagtgagccgagttcacactgcccttcatcctgggtgacagagtgaaactctgtctcaaaacacacacacacacacacacacagacacacacacacacacacatacttgattttagatctgcctatgttgttctacagaatgttgtcaagttacttacctgatacgagctttttgtgttttttattggaataatcattattttactttaaactgtataaatacatgcaaacatcacattcctgattctttttcacatcttcagtggatattcagcaaaatcagaagtagatcaaatatatgtaaacaaaaatagaaaattaaaataaatttgatctaattctaattttgttgaatattacgtttgtatgaaaaaaagatcaacaggcaaattaatcatttgtaaataaaatttgaagagtaatgtttacttaagattattttcaaacatattggaagtggtcatttgttgtaggtgattcttcactttttttgtttgtttgtttgttttttttgagacgagagtctcgctctgttgaccaggctggagtgcagtggcgcgatgtcagctcactgcaaactccacctcccaggttcacgccattctcctgcctcagccccctgagtagctgggactacaggtacccatcaccacgcctggctaattttttctatttttttagtagagacggggtttcaccgtgttagccaggatggtctcgatctcctgacgtcgtcatcctcccaaagtgctaggattacaggcgtgagccactgcgcctggccgattcttccctattgtagcatgtggctgacagtctccactttactaagttaagaactatatataccctttttttttttttttaaattgagatggagtttcgcccttgttgcccaggctggagtgcaatggcgcaatcttggctcactgcaacttccgcctcccaggttcaagcaattctcctgcctcagtgtccctagtagctgggattacaggtgcctgccaccacacccagctaattttttgtatttttagtagagatgggggtttcactatgttggccaggctggtctcgaactcctgatctcaggcaatccaccagcctcagtctcccaaagtgctgggattacaggcgtgagccaccgtgcctggctaaaatttaaacttttaacatttagactggactactcttaggtaagtaaaatattttagtttttaatctacttaggggggaaaaatctctatagattacttatgatacaaacagatgacctaaagatagcaacttaaaaaattttttttccctgaaagcgtattagccgtttgagagtttaattttgcattttcgtttcacttcttcatttctgtagagatcattggagtaataatagtacaaaatatttctcccctcttgcaagcttttaattatacttgtattaggcagcgtatttgtcagtataaacctaattgagataaggaacagtagaatgggcaactacaaagagttgtgttgggacagaatgtgatctagtaataattgtggtggatttgatggtgatttgctaccccagtgatacagattatattttgcaattagcaaaatttttgatcaagtggggataagttgagagtcagatgaagtatttgtgctcatatgagggaccattatgaatacttttgtctaactttctaaaattagtaactgttcccactagtttacagagtattttttctatttttttggaaccgagttcaaagcctggcatgtcaaaggcactcaattaaatttttctttttttaactgaatagatttttgaaaaataacactaaactatattttagaatatttggattttcttttaaagatggcttaacctttaaacagatacaatttgcacataaactgttaatataattcatcaaacaagagaatgagcattttggaagttaagagcctttactgcagaaatgtaggatggtatttcaaactactattgaaatattatgtatttgaggagtcctcctttcctcattttcttatctagaattatatttctgagacaaacaagataactgaatgttgggttcaaatgtatctcatttatagttttttttacacagtaattacagtagttggatatttgcttactaaaatgaagtgtgcaagaagaaagtgtgaaacagtttttttattatagaagcattttctgaattatttcattattttcgacttgttacccaaaaagatacattgattggagatagtgcccattccatttattcggttgataccacattggggttttgaatgatggagaccaatacagacctgcttagattggataaggttttgtttagtgcctttctcattttttacaaaacgacttttataataacttcagagtaatcaagtttttggagctcattctgttaataacaggatatgtggaccctccctatccctggcattttttttttttttttttttttttgaaatctgtagagtggctttgcaaatagtgccccctgtggtttaggaaatagagcctctttatttttattattaaaaaatagaattgttagcatatgatttttgaaagttagaaatttatcctttttgtttgagaaatgggaaaaaacttagaaactttaaagaagaaaaacaaaaaagagatggccgtgttttcagagtaggcctggatcatcatagtcagccagtagttttctcgtagcagtgcatatgttatcaattatgccactgggaaaccaaagaagtaatcaagaattgggctaattttttttttgataaggagttttgctcttgtagctcaggctggagtgcaataaggcaatctcggctcactgcaacctccgcctcctgggttcaagtgattctcatgcctcagcctccctagtagctggaattacagtcatgtgccaccatagctggctaatttttgtattttttgtagagatgtggtttcaccatattggtcaggctgatctcgaactccgtacctcaggtgatctgcctgtctcagcctcccaaagtgctgggattacaggcgtgagccaccgcacccagcgaattgggctaattttaatccctttagaattctgggagtggaaagtgattgtcgagctagaattcagtttgttcctagtaaaggggtagaacttgtttgagaatagctttggtaatagcttgaatctgtattttgttcacatatagaattttattctactgggattcatattacataaaataaggattttattagactctagaaagcaaaagaatatataaacaatgcatcttgttgtaagatgtgatttgcttccggctgcgcgcggtggctcacgcctgtagtcccagcacttttgggaggctgagacgggcggatcatgaggtcaggagatcgagaccatcctggctaacatggtgaaaccccgtctctactaaaaatacaaaaaattagccgggcgcggtggcaggcgcctgtagtcccagctactcgggaggctgaggcaggagaatggcgtaaacccgggaggcggagcttgcagtgagccgagatcgcgccactgcactccagcctgggagacagagtgagactccgtctcaaaaaaataaaataaaataaaatgtggtttgcttcaatcactaactcattatattaggcagaaagaatgaataggaaagatataaaattagtttgagtccttttgatttcatgacttctagacttaagagtggatcatagaaatatgtaatatttctatatatacatatatatgtatatatacagagagagagagagagagccccccccccccccccgagcaggagttcatcttatagtcttacagtcttcttatatcttacagtcttcgaatctagaatgtggtagatgcctaataaaggtttggataacagtgaagtctaagtggccctataaagttaccagtgattctcgaagagggaaacaggtttagttttaaaacaaaccagcatttcgtttttatttgtgatgttgaatttattctgagatttcaaatggcattaaaagtacatattttgcattttttatgggaacaaggaattaaaaagcttaagaaacttactaaaagtttgggtaacatagtttgaccctgtctttacaaaagattgaaaaaaacaattagctgggcttggtggggcatgcctgtagtcccaactacttgtggggctgagatgggagtatcgcttgagttggggaggttgagaccgcagtgagctgtgatggcacctctgcactccaagcttgggcaacagagcaagaccctgtttttctcaaaaaaaacaagacaaaacaaaacttaataaaaatgatttaagacttctatgctttttatagtctatgttaaatttttttgtgtgattatgaaaacaatataggcccattgtagtaaatactaaaaaagtacaaagaagaaaacacaatttcctcataattgcaccatgtgataactgcctctggaatttattcatttgcgtatgtaattgtaactgtgtttgtgcaaaagcatttctagagtgcataagtattaataaaggagtagtaggcctggtgcggtggctaacgcctgtaatcccagcactttgggaggccaaggcagacagatgatttgaggtcaggagttcgagaccagcctggccaacatggtgaaaccccatctctactaaaaataataataaaaaaaatagctgggcatggtggcacacgcctgtaattagagctacttgggaggctgaggcaggagaattgcttgaatccaggaatcggaggttgcaatgagcggagatcgtgctactgcactccagcctgggcaacagagtgagactctgtctcaaaaaaagaaaaagaaaaacaaaaggagtagttactggaataatacttttggaccaattttaagacagttcatttagagcagtgtttttctaactgcaatttgtcattcatgtagccatctcaagcagggttccataaggggagatttaagcactacagaaaatgaattgagtgctggttttgtcatttctcccagtgatcgtactggtaccattctaaatgcactggagagaaggtaattcattacatacaatggatgccttggggcattttaaattctcctgagaacctcaattgaaaaccgccaggagggtcatgaaatcaatttagtgggtcaccagcattaaaaaacataaaaacctgaagtagaataaaatggaaaatagaggacattgcacataggaagattaatcaatctctgttttgaaattgccagtttacattatttgaaggccagaataatccaggactgtaaattgttaagcatatatgctaaaatgagatagaaaagtaaagccttagaattatacagattaaaatttttgacaaatagtggaaaataatgtgtatgacactgagatttccatgtagttgcagtattaagtttattgggcatcacagaccttcagtataaaatgtcacaggattaacaggatttttatcagtgtatttttcttcaagttctaaaggggatgttatattaccaactttacatggctttgtttccattaaggactcaaaataatagttgcaaaatattacaagaactcgagcctttgcattttctgtgagcatttttaagtatctcaaacctaaaattggctttgtgaggtaggtggtatgatctttcagcctgtggaaacagctgccattgctgtgactcctgacgatctgtttttgatcagttagtgcagatgcttagatcatactgtcccagttttgcattaatttgatcaattctattgattacagagaagtgaggcccaagactaagccttgaaatctctaagtagctatttgctaccttgtaacactgttctgtttcatttattgaaacactaactcacaacatgttggaaatattaaggaaacctgatagtgtactgagggattctgtttcttttggtaagagttgttggcagctatctggtagggtgtctttatacttctgaaatcatttattgaccacttgaatgtcttagtattatacacagcaaaaagaccctgatgagatatattcacttcctgtgtatccagtcatatgtttagtaaggttgctaatgatttattttgggtcagaacaaagtaatgtgcatttcatatgcattatattttatttcttgtgtaaataggccattagggagatagactattaaatttaccaacctacactactgcttctgtcttatgaacacaaatttaaaaattaatctttatcacttatagcactttaaaaattctgtttttagaaataattttcaatttttttttttttttttgagacggagtctcactctgtcgcccaggctggagttcagtggcgtgatctcggctcacagcaacctcgacaacctccacatcccaggttcaagcgattctcttgttgcagccccctcggtagctgggactacaggcgtgcaccaccaggcccggctaatttttttatttatttttattttttagatagtcttgctatgtcgcccaggctggagtacagtggtgtgatctcggctcactacaccctccacctcctgggttcaagcgattcttctgcctcagcctcctaagtagctgggattacaggcatgagccaccgtgcccagcctttatgcctggctaattttatatttttagtagagacagggtttcaccatgttggccgggctggtcttgaactcctgacctcaggtgatcctccgccttggcctcccaaagtgctgggattacaggtgtgagtcactgtgcctggccttccggctcatatatttgtaaaaaggcttaattctgatttttgttggaattttggaattcccactagtgttttgaggcattatcttggtttctttagttcattaatgtttgtcattaggacttaattaaagatcaaaatagtaatctgatgctgtaattaaaaattagagtgccacctaaaagcaagatttagtatttgaaaataagttccagcttgggcaacatagtgcaacccctgtctctacaaaaaaaattaaaaaaaaattagtcaggcttggtggcatgggccaatagtcctgactactctggaggctgaggcacgaggatcccttgagcccaggagttggaggatgcagtgagctataattataccactgttccccagagcaagaccctgtctcaagggaaaaaaaaaatgtctaagaattttaaagggttttttttggtacaaattcgaatacttgtatgaataatgctgagcaggtggaatagcttttgtatttagaaaggagtgacaagaagttttttgtaaatgaaatcaagctctctaaattatttttcattatgagactgattagcatcgtatcactaaaatagagtggttcttcattaggaaatctgattatcaaagggtcacgtatacagaataagcataggaaggtgcagaaatttagagaaactttcataaaatgtttcttagtttttacttattttatatttttttactgtatattttggaattgtttaaattgtacattcatagacatttggagttttatgacctaagaggaaagaacctttggaatgaaatttttgtgtctgaaattttgcttatgtgtttgaaatgaggatgctatctgttcattttggggtaaataatgatggggaaattgggtgataagagcattttgaaatgttaaggctctaacttaagctactaaatgatccacttctttggcaagttatataatgtattgtattttaaaatttaaatacacataaaaataaatgattcctatgttgaaaggtaagataccaggcagtagatactcataatttggtatctaatttttattcctgattagtagcattactgctgaaccatttaattatattgttctttttttgaaaacctaatttgtatgttgacacaaatgcagaatagatgagaaaatctggcatgcctctgaatgttttgttgtatcataaacattgtgcttttcttaattgtttttaacatacagttaggataatttgttataaatgtgtttatggcttaccacagcatattaggtaaaattagcttgcaacattttatcatggttagtgttgtgcgtgtccccatcatttgtattgtttaatttatatctctgaaaaatgcagccttagaaactgttgggcttccttggtgcttcatggagtagagggatatcaaacgtgaaagagaccaagagttttgtggtagcagaataaccttgtaaaaggctaccttgggaattaatgagctgcactgtcattcagaattcattcaacaaataatagatatttgatagatgagtccctactacatgctaggcatatagtgctaggtattaaaaatacaaaggtaaggctggttcttgacctcaagctgctgtttaagcagaggctgcgtagccacttaacagggattttaaatagggaattcagacattggctaggggactatgctaggtgatctttaagattccttagaagctctagtctgactcttactgggttggtcaagactaggaaataaaataaagaataggagctaagagggatgactgtttaaaaataaaggaatgtgctagcagttatttaaggtggcacctgaagtttagagacacagaaataaatagatgctaggtttggctcatgagtaaagataaaacttactcttataaatcaaactgtagggttttgaaatgaacttgatcaaaattgagtcagatttcaagtcaaggtctttgagcaaatttagaatttgcttgatattctgaagatttgagattccagtattcattataggaaaaactttgaaatatataaatcaattttagtaattttatatttttttctttttcttttttcgagacaagccccacactgttgcctaggctgcagtgcagtggcaggatcatagctcacagcaacctcaaacctgccagcttcaactgattctcccacctcagtcccctgagtagctgagactacaggcatgcgtcaccacggctggccaattaaaaacaattttttttgtagagatgggggtctctctatgttgtccaggctggtttcgaactgctggactcaagcagtccttgtgccttggcctcctaaaattccggggctataggtgtgagccactgggtagggccaattttagtagttttaatttaaaaaatctggaaacaattgatttcttgggcagtacatctagaattctttcagatataacacttatttaaagaggagctttctttgttttttaacaaatgatgtctagaaaagaaattctcatttaattcaagctgattttcctttttttttttttttttttttttgagacggagtttcactgtcttgcccaggctggagcgcagtggcgcaatctcagctcactgcaacctccacctcctgggttcaagtgattctcctgcctcagcctcccgagtagctgggattacagggatgcaccaccatgcccagctaattttttttttcttattagagatggggtttcaccatttggtcaggctggtttcgaactccggacctcaaatgatccacccacctcggcctcccagagtgctgggattacaggtgtgagccactgttcctgccctcaaactgatcttaaattttactgatttgttagaatgaacttatcctcgttcattgacacctctttggtcatgtagagctggggtgcaaaatgttctacccgttaagctactttttaaaagcattgtgtttttttaaaaaactgttttcatgaattgtaaaatgtctgaaaaagttttgaatctaagtggtatacagaacataatttagctatgtcacgttgactcaagagtttttatttttttaacgagacagggtctggctctgtcacccaggctggagtgccatggagcaatctcagctcactgcaacctctgtttcctgggctcaagtgatcctcctgccttagcctcccaagtagctgggactacaggcacacatcaccttgcctggctaatttttgtattattattagagatggggttttgccttgttgcccaggccagtctcaaactcctgagctgaagcagtctgcccactttggcctcccaaagtgctaggtaatatcacagatgtgagccgttgcgcctggccaactcaagattcttaaacattaattaccatactttgttgaattggggtaggggacaattgagatatattaaattatttgccccggtctatgctaaagcctttactcagattgtcttgctttttgaagcagtttttgtgtttgcatcttgtaattttcctctctccttaggctgtcagctgtcacttagcatctatcatttagtatttctgttgccagaagtcagttccctttcttactgctataactaagctataggctgaggaactatgtaaataagtgatcagtttgttttataaataagcagtggaatttgcccagattctgaatattagttcaaaatgtgatgtttcgttttctgttttcctttttttttttgagatggagttgcactttgttgcccaggctggagtgcagtggagcgatctcagctcactgcaacctctgttcccctgtttcggttgattctcctgtcctcctaaagtgctgggattataggcatgagccactgtgcccaggcctttttttttttttttaattccacatttacatatcatgtagagaccttcactgaatattcaactcttaaatcttttaaaaatattaatttttttcttataattttgaggtcttattagtatttcaaattcattgctcaataattcttttttttttttttttttttttttgagacagagtctcactctgtcacccaggctggagtgcagtggcacgatctcggctcactgcaacctccgccctctgagttcaagcgattctcctgcctcagcctcctgagtagctgggattacaggcgcctgctgccgcacccgactaattttttttttttgtatttttagtagagacggggtttcaccatcttggccaggctggtcttgaactcctgatctcgtgatccacccgccttggcctcccaaagtgctgggattacaggtgtgagccactgtgcctggcctaattcttaacaaaaataaagatctcccacatacatatttttttctttttttatttttgagacagagtcttgctctgtcacccaggctggagtgcaatggcgccgtctcggctcactgcaatctccacctcccaggttcaagcgattctcctgcctcagcctcctgagtagctaggattacaggtgcgtaccaccacacctggctaatttttgtatttttagtaagacagggtttcactatattggccaggctggccttgaactcctgacctcgtgatttgcctgccttggcctcccaaagtgctgggattacaggcgtgagccactgtgccctgcctatttttgtcctttagttggccctaagtcatctcctgactgatcagattttaagatacatattctaagagcggtttcctttctgttttcagcctgttttgttgagggcagtgggttacttgtcagatctctcccaggtttcttcattctcattgatttcctccattagtaggatctcagtaatcaaaccagagtttggatagtttagagttgattttgttttaatcactactgcttaacatccagagatctgtttgcagtccttagtttcttggttccaaactggaatattgggacatcaggcaaaacagctttgctactttcctaatttgttgaattgggaattggactctctctctctctctttttttttttttttggagacaaagtcttgctctgtcacccaggttggagtgcagtggcgcgaactcagctcactgcaacctctgcctcccggattcaagtgattctcctgcctcggccacccaagtaggtgggattacaggcactcaccaccatgtccagctaatttttgtagaaacggcgtttctccatgttggccaggctggtctcaaactcctgacttcaggtgatccacctccctcagcctcccaaagttacaggcatgagctgctgcacccgaccagaattggagcttcttttatttatttatttatttatttatttatttattttttttatcttgagatggattctggctcagttgcccaggctggagtgcggtggtgcaatctcggcttactgcagcctccgcctcctgggttcaagtgagtctcctgcctcagcctcccgagtagctgggattacaagtgcgtaccaccatgcccagctaatttttgtatttttagtagagactgggtttcgctgtgttggccaggctggtcttgctcctgacctcaggtgatccacccttctcgtaccaccacgcccagctaatttttgtatttttagtagagactgggtttcgctatgttggccaggctggtcttgctcctgacctcaggtgatccacccttctcggcctcccaaaatgctaggattacaggcatgagccactgcgcctggccatggaacctcttaaaggtagggtttagagaaatatccagctctcttttttgttttttcccttgtttaactcgttcctaatcgcattctccctcagtttcctgggtttgtctgttaacttcctatttttgttggtcaccttaaccatgccacatttcagctctcctttccttctttcccctttcccttaccagtgagtcttgcccccccttttaagtatccttttcccacaaaagcaaggtaatttcgtataataggaaatatgtaggggatgaagggaggacaaagtgtaaataaagtaaaccaaaataagggagaagttagtaaccacagatcatttattctttttttctcttcaatttctttttttgttttgttttgttttttgagacgattcttgctctgttgcccaggctggagtgcagtggcatgatcttggctcactgcaccctccatctcctgggttcaagtgattctcctgtctcagcctcccgagtagctgggattacaggagcgcaccaccatgcctcgttaagttttgcgtttttaatagagatggggttttgccacgttggccatgctggtctcgaactcctgacctcaggtgatccacccacctcggcctcccacagtgctggaattacaggtgtgagccactgaaccgagcccctcttcaatttctgaacgtcagttgttttctcatctgtaaaatggtaatgatacctatttaatgggggatatttgttagaattaagaatgatgtataaagttctcagcccgtagatgttcattaagttaccagttacctttctccttatttttctttatttttagttatagctcatctttaagtattaaaaaatcctttttatatttattaggaaatatagtttaatgacaagtgttagcaaactatgtggttttggatttaatttggcaaagtattgctgtagaatggtatctagctaatatgctaacaaatactgtagggatagggtatagtctagccgattgtagtacaggaataagaatcaattttccagtgctatacctttatagagttctattatttaaaatggatttctggccaggctcagtggctcatgcctgtaatccctgcactttgggaggctgaggagcagggatcacctgaggtcaggagtttgagatcagcctggccaacatggcaaaacccaatctctactaagaatacaaaaaattagctgggtgtggtggtgggtgcctgtaatcccagctactcaggatactgaagcagagaatcgcttgaacccgggaggtggaggttgcagtgagccaagatcgcgccactgcactccagcctgggtgacagagcgagactccatctcaaaaaaaaaaaaaaaataaataaataaaatagatttcgtaagtatgaaatttgatgcagtcatttctggtactccatgttagcatgcatactgaaactgttcttgtgatgggatagttcatgtgggtgtctctgagtttcaggtgataatcaggcttcttcaagggaagactgccttattggaagatgactcttgagacagggtctcactcttgcccaggatagagtgcagtggtgcaatcatggttcaatcatggttcactgcaagcctcaacttcctgggctcaagggattctcccacctcagtctcccaagtagctgggaccacagatgtacaccactgcaactggctaatttttttttttttttttttaaagagactgggtcttcctatgttgcccaggctgactccacggcttaaggaatcttccccactctgcctcccaaagtgctgggaatacaggtgtgaaccactgtgcgtggcatgatgactcttaaataatgttagttgtctttacccagtggcccagtcaggttgacacataaaattaaccttcacagttttacttcaataaatgtttcccttccatgtttttctgcagacagatgcaccatcaggaatggaattacagtcatggtatcctgttataaagcaggaaggtgaccatgtttctcagacacattcatttttacaccccaggtgagttggtatttatttgttcgtttgttcattcatttcttcattcaacaactatatgccatgcactattctaggacatgggaatttaattatttatttattttttttggtggcagagtcttgctctgttacccaggctggagtgcagtggcgcgatctcgtctcattgcaacctccgcctcacgggttcaagcgattctcctgcctcagcctcccgagtagcggggactacaggctcacaccaccacgccctcctaatttttttagttttagtatagatggggtttcacagtgttggccaggctggtctcgaactcctgacctcaagtgatctgcctgcctcagcctcccaaagtgctgggattacaggtgtgagccactgtgcctgaccacgaatttatttctttattttcaggctttcttgttaatcatagattatctttgaaaattcaaaattaggctgggcgcggtggctcatgcctgtaatcccagcactttgggaggccgaggtgggtggatcatgaggtcaggagatcgagaccatcctggctaacacagtgaaaccctgtctctactaaaaatgcaaaaaaattagccgggcctggtggcgggcacctgtagtcccagctactcgggaggctgaggcaggagaattgcttgaacctgggaggcagagcttgcagtgagccgagatcgcgtcattgcactccagcctaggcgacagagcaaaactgtctcaaaaaaaaagaaaaaaagaaaattcaaaattatttttaaataagtacattggtatttaatgtattttttgtttctatttatcattatagggaaatggtaggtgaattgtattgttactcttattagaaaaaatttcaaagaaagaatctgaaatgaaatgaattgtaaattgcactgaatatttgaaataacctttactatgtgtttctatgtgttttctagaaataggtcattttctttttgccctcaagtaaaaaatggaagttctcctttaatttcttacttttcttcaagaggtaaacaaactcttcaagaatttggtgtgcaactttgatttttttttttttttttttgagacaaagtctcactgtgttacccagactggagtgcagtggcaggatcttggctcactgcaacctctgcctcccaggttcaagcagttctcttgtcatggcatcctgtagctgagcctgagcgccagctgtcactcctggctaatttttttgtatttttagtagagatggggtttcaccatgttggccaggctggttttgaacctcaggtgatctgccagccttggcctcccaaagtgctgctaggattacaggtgtgagccaccgccccgagccgcaacttcaattttttttttttttttttgagatggagtctcgctctgttgcccaggctggagtgcaatggtatgatctcggctcactgcaacctccgcctcccgggttcaagcatttctcctgcctcagcctcctgagtagctgggattacaggcatccgctgctacgcccagctaatttttgtatttttagaagagacgaggtttcaccatgttggccaggctggtctcgaactcctgacctcaagtgacccacctgccatcagcctcccaaagtgctgggattacaggtatgagtcactgcacccggcctgcaactttgatattttaaaaagaaattcttttgaaactaagagctttcttaataaccgtacttctcaaaatcagagttttactgtttcaataaatgttcaccctagattgtaagttttttgttgttgagccctagatttttttctactagtgtaaatctgtattccctccaagtatggtgataaggggactgagtcttatttacatttgtacaatcactactttacctgttgtatttgcagtaagtcttttgagccctattaaacctgtcaattttcttgtcctgtcagaaaactgagattttggctcaaaaatggatgttattaacaaaggggaacaatatagatgtcttagtacaaagaaaatgaaatgtaagaggagattgtctggagttcaggggatagagtgtcaagtcttaaatggttacatctttttgctaagtgttactcagaatatagttacaaatatggtacttaaatatctagctgaaatttgtttgtcccatgagcttctcacatgagtctactgggcaattttatgtgagttttggtcaaaattggtaatctcttttatcttagttttgcataatttattgttgccattttatcaaatgagtaggaagtagtgaagtatttcaagaagattgctcagtggggtttgatacaagaactgcccagtagctgggcgacattcagagctctctctctgaggtatataagaagagccctgggagctcctcactgagcctcctgtgagtcaggacatagccttgcagtctgccactgaagcagcctcaccaaagcaaagattccctgctttggaagggtggtgggcaagataaagtcctccaaagtagttatagattattctttttctggagtaaaacttacctgctcagagttgttacacagctgtataaagtccttaatgcttttaattctcaggtggttttgagggaaggagaagagcctgtgattttccttctgtgtatctttttagtgcttagaaattacttgccaaaaaaaaaaaaaaacacgaaattacttgcaagctggttatggttgcttatgcctgtaatcctagtgctttgggagttggaggtgggagggtatcacttgagcccaggagttcaagaccaacttggcagcatagcaagaccctatctctaaaaaaaaatgggtatgtgtggtcccagctacctgggatgctgaggcaggaagattgcttgaacccaggagttagaggttacagtgagccatgatcataccactacgctccagcctgggttacttgcaaactaacaaaaaatcccttataattttgtttgtaatgcctaaagtgttgatttttttcctaagaattctttactgtgacctttattttctgagttgtaatattgtctgttttggttagaaaaaaaaaagtttaaccacagaaatgcatgttacatatttgatttttacttaattgtaatatgtaatatatgtcttgttttgcttttacttgttttcagctactacttatacatgtgtgataaagtggttgccccaaatgtgtcacttacttctgctgtatcccagtctaaagagctcacaaagacagaggcaagtaagtccatatcaagacagtcagagaaggctcacagtagtggtaaacttcaaaaaacagtgtcttatccagatgtctcacttgaggaacaggagaaaatggatttaaaaacaagtagagaattatgtagccgtttaggtaagtattcagagattatctttctaaaattaaatatctaatgaacacatttattgagcattttcaaacaggctttttgtttgagctaaattttcagataattggagcttttacctttaaaaatgctacccttcaaaactctgggtgatttattttaatctcagttgctatacttttctagcgtggtgatagctcaggagactgagatagatacaggctacctggcctcagactgcaagttatttttgtccgaatttttttcctttcctaccttttatttgctgtcagtcttcaggagatccttgtttttctttcctcctttttttttctttttttgtgacagagtctttatcgcctaggctgaagtgcagtggtgagattgcggtcactgcagcctcaacctttgggctcaagtgatcctcccacctcaccctccctagtagctgggaccagaggcgcacaccactgtgcctggctaattaaaaaaaaaaatttttttttttttttttgtagagatggtcttggtatgttgctcaagctggtctcgaactcctgggctcaagtgatcctcctgccttggcctctcaaagtgttgggattacagttgtgagccaccgcacccaacctttatttttctttctgatttgccatgaactgagacaccatttaataataagaagtattatgtaagtaagagtagttaggtatagaactcaaggaagcttagttatggaataaagcaaggattgaaagctctgggggccaggcatatagcataaatgtggaatattgactggtcatttaaaagaaaaatagctggttacttaccgtgccttttaaaatactgtggattaaatgagacatgtctgcagatattgcctgtgttaccatccatatagcagcacagctttgcttagtgattaggcagtgtgacagttactttagctgcattggaacagttggagggtcctctatttatttaagtttttatagagaattgagattcttgggggttttcttttctttctttctttcttttttttcttttttttttttgaggagtttcactcttgttgcccaggctggagtaaaatggtgagatctcagctcaccgcaacctccacctcccagattctcctgcctcagcctcctgagtagctgagattacaggcatgcaccaccacaccccgctaattttgtatttttagtagagacgggttttctccatgttggtcaggctggtcttgaactcctgacctcaggtgatccgcctgcctcggcctcccaaccaaagtgctgggattccaggcgtgagccaccacgcctggctgattcttgggtgggggttttctggtttttttgtttgtttgtttgtttgtttggagacagagtttcgtatttgttgcccaggctagagtgcaacggtgtgatctcggctcactgcaatctccgcctcccaggttcaagtgattctcctgcctcagcctcctgagcagctgggattataggcatgcaccaccacgcccggctaattttgtatttttagtagacacggggtttttccatgttggtcagtctggtctcgaactcctgacctcaggtgatccgcctgcctcggcctcccaaagtgctgggattacaggcgtgagccatcgcgcccggccaggggttttctatacatttattttgagggttttttgtttcgtttttcttttttagagacagagtctcactctgttgctctaggctggtggagtacagtgatgcattcatagctcaccgcagcttcaaattgctgggctcatagtccttgcacctcagcctccctagtagctaggactacaggcatgtgccactgcgcctgcctcattttttcattttttttgtagagacagggtctcactgtattgcccaggctggcattaagctcttagcctcaagtgatcctcctgccttggcctcctaaagcattgggattacagatgtgagccaccatgcctggccaattttgagatttttaaaactcagttttcttcagatttaaatatggtaaacaaaaattagtaatgactattatgccatatttacattgtattttatttcttaaattaattctaatgacttctaaaaaattattgagataatttatataccataaaatttacccttttaaagcctacaattcagtggtttttaatacattcacaaagttgtgcaaccatcacagctaatttagttccataatgttttcttttctttctttttttttaagatggagtttcactcttgtcgcccaggctagagtgcagtggggtgatttcggctcactgcaagctctgcctcccgggttcaagcgattctcctgcctcagcctcctgagtagctgggattacaggcgtgtgtcaccacgcctggctaatttttttgtattattagtaagagacagggttttcgccatgttagtcaggctgatcttgaactcctgaccttaggtgatccacccgcctcggcccataatgttttcatcactccaaaaattaaccctataatccattaggagtcactccctgattctccctttctcgaagcctctggcaaccactaatctattttctatctttatggatttgcttattctggacatttcatataaaaggaattgtacaatatgtggcttttcatgtctggtcaagaagcttatgcttctttcatgaaagataatgttttcacagtccatgttgttgcatgtaccagtacttctttttatggcctgataagattccattatgtgaatataccacattttttttattccttcgtcagtcggacatttgcattgggtctactttttggcaattaagaataatgctgctataggccgggcgcggtggctcacgcctgtaatcccagcactttgggaggccgaggcgggcggatcacgaggtcaggagatcgagaccatcccggctaaaacggtgaaaccccgtctctactaaaaaaaaaaaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagaataatgctgctataaatacttgtgtagaagtttaagtgtagaactatattttcagtttttttttggtatgtatttaggagtgaaattgctaggtcatgtggtaattatgtttaatgttttgaggaactgccaaacttttcaaaagcagttgcaccattttacattcctgtggtagcttgggagtttcaaattttgcatatctttgtcaacacttgttattgtttgtcttttgaatatagccatcctagtggttgtgaagtggtatttcatggttttaatttgcaatttctcagtgaatgatgatattgagtatcttttcatgtttttcttggacattgcatatctttggagaaatgtctattcaggtcttttggctattttaatgctaggttgttttactattgagttgtaagagttctttatatattctggatactggatccttatcagatatttgatttaccatactgttttctttttactttcttgttagtgttcttttttttttcctgagacaaagtctggctgtatcaccccagcttggctcactgcaacctctacctcctgggcttaatccatcctttcacctcagcctcccaagtagctgggactacagggatgtaccaccatgctcggctaatttttgtatttttggtggagttggggttttgccatgttgaggctggtctcaaactcgtgagcttaagcaatccacctgcctcagcctcccaaagtgttgggattactggtgtgagccaccgcgcttggccgtgttagtgttctttgaagcacaaaagttttaaatgtttattacatccaatttatctatttttttcttgttttaggtatcatatctaagaaactattgcctaatcccaattccaagaaatatttatttatgtatttatttatttatttatttatttttgagacagagtctcactctgttgcccaggctggagtacagtggtgccatctcagctcactgcaacctccacctcccgggttcaaccaatttttctgtctcagcctcctgagtagctgggattacaggtgcgcgccaccatgcctggctaattttttttgtatttttagtagagacagagttttaccatgttggtcaggctggtggtgaactcctgacctcaggtaatccacctgcctcggcctcccaaagtgctgggattataggcgtgagccaccacatccagccaagaaatttatgtttaagggttgtagctcttacatttaggtctttgatcagtttagagttaatttttgtatacagcataaggtccaaccttattcttttgcatgtggatatagttgtccgtatgttgaaaagattattctttcctttttttttttttttgagacggagtcttgctctgttgcccaggctggagtgcagtggcgctatctcggctcactgcaagctccgcctcccaggttcacgccattcttctgcctcagcctcccgagtagctgggactacaggcgcccgccaccaagcctggcaaattttttgtattttttagtagagacagggtttcaccatgttagccaggatggtctcaatctcctgacgtcgtgatccgcccttctcggcctcccaaagtgctgggattacaggcgtgagccaccgcgcctggccagaaaagattattctttcctgactgaattgctttggcacctttgtcaacaacaattgccttataaagtatgagttttttaaatttctggactctgaattctgttctactgatctgtatgtctatctttaaatcatgtcacacagtcttgatttctgtagctttgtagtaagctttgaaattgggaattgtgagtctttcaacttcgttattctttttcaagattattttgcctattttgggtttgttgcatttccatatggattttagaaactgcttttcaatttctgcaaaaaatccagtggggattttgatagggattgcactgataagtagatcaatttggagactattactgtcttaacaatattaagtcttccaatccatgaatttgggatgtctttccatgtatttaggtcttaaatttcttttagtgatgttttgtagttttcattgtacttgcactgcttttgttaaatttattcctattttatttgttttggtctaatttataaatgaaatgttttaaaaattacatttatggattgttctagtgatttttttaatggagtgatattcatactttgttacttgatttttttctctccaagatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggtaaaattgttatctaaatgatagtccattatgaaaagatacttttgtatattgctctgtcgcccaggctggagtgcagtggcgcagtctcagctcactgaaacctccacctcacaggttcaagcaattcttctgccttagccttccgagtagctagcattacaggcacgtgccaccatgcctggctaaattttgtattcttagtagagatggggtttctccatgctggccaggctcgaacttttgaccttgtgatccaccagccttggcctcccaaagtgctgggattacaggtgtgagccactgcgcccagcccccctgtatattcttagtaagaaaagtcaaaacgagatgctacaaatgtacttaagattattgttttacactgaaaagcaattttaatatattttaaaattttttgagaaaatagttttttaaaataattacctctatatagaactgataatgatagctgaattttaggtattttctgtgctatgttttccagaactgaaaattttaacatggtgaaaataaagtaaaacttgtattgtgattctttacattacaggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacaggtaagaattactgtttgtataatggtgccctttcagcatggaaatggaaactgttacttctctcttttttttttttgagacagagactgctctgtcgcccaggctggagtgcagtggcacaatctcagctccccacaacctctgcctcccgggttcaagcaattttcctgcctcagcctcctgattgtagctgggattacaggcgtgcgacactatgcccagctaaattttgtattttttagtagagacggggtttcaccatgttggtcagtctggtcttgaactcctgacctcatgatctgcccacctcagcctcccaaaatgctgggattacaagcatgagccactgcacccggccaccgttacttctctaataaaggaattactttttgtcaagctcagtttactaagctagatttcaaaatagataattctgttaaacatagctttatgctgtattgtccaagatgattattttgatgtttgttgcttttattagtttaaatttttatcgggttactgcagtttagttacctaaattgctaatctctagccctctgaatattatatgttatattattttaatgtagtatatgagctttcaaatctacaaattaacaaacaggaactgttgcctgttatgttcaaaagcactggagcaaaaataagcaattctcttttgttaatagaatctcacaatttaaggaacatgaacaaataactaacatgagcaggctgtgatgagcggtatagtaaagtatagggcataatgaacatgaacatgctggatgtgttccttcctcttgttcctttgctttttcttaaatttagtgtcctgtcagatgtcagattaatagtattagatgcttaatggatttagtatacatgaaatagttcgttttgtaaaaagtaatttgaaaatagatattttctatgatatgaggattaaatggaaaaacaaaacaattaaaattgatagcgccttttaaatcacatagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggtaattgaattctgaagaatttatctgcatgacgataactaggcattctatccatttgtagatcagagaaagtgaagagattatatattagtacttaaatttttacattttccaaatgaatgaaaatgtatgtttctttgtacttttttaaaaaaatcagcttagtaacaatactatatggtttcaactagtaggtaatctgcttatatttctaatgcaaacttaacaattgtgtactttttaaaagctgcaatatgtgttggaaaatagctgtggtcaattttgttatccatatttcagactcaattttagatacaatggtggctttatattttaagtatatagagctactcaaggagttgaatctccccttttctcattaacacaatttttctaagttgatatggtgtactcattaacatacaccaaatttacttttactttgttcagattgtggaatgaatttccaccagttctcttctttttaatgtgtaccctaggaggaattttactgaggttatagcataccccatgagcacagtggggaagaagaatgtgttgttatgtgctgctgctaaacagaagcagcagttgtaatttgtttttcagtttaaatgtggttatagttagatttttttttaagcagcaacttttcaaaaataaaatgtgataatttctgaacttttgtttgtgttgttaatagtggtgtgaaaatattaacgttcttgagaaaaactgataccactgttgtgtatcagtttctatacaatccataatcctcctgtacagtttttacatgtagttatgagtcttactaaaatttatataatggacttgttttcctttaagttgtaaaatgttaaacaccttgaaggttattttggacttctgtatgtttaaatgttgtcttaccaaaatttgcacgaatggaccattttcatttactacttaatatcaaaatcaggaatttacagtcaactgatagtacatgataggtgcatataggacagtttagttacctgctactaaaagatttttagataagttttagaagataaaggaattccatagtttcaggagggacaacatcttctgcactttttttttgcacagaaaagtctgtcattctctaatggcaaatttcatatttgttaattcttggctcaaaatatattaggtaaaattcttagatctgtttttaaagggagtttcctgaaactatcattaattgacattattaccccatggattttatgggataataaatgtttttcatgttctcttataagatactatgtatgaaattacttcagagagctatatttattttaaaataaattagctagggttaaggttatattctatttccagcatagaaggtagataatctaatggtgtagaaagaatcactaggttgtcatttaaccagttattttcatattttgcttaatagtacatatccaaaaagaattttgtacttccccaaatgtaatttatttactaaattgagtataacctaaatgtgtgttttctattttccatttaaattttgctatattaagactaatttaattcgttgagtcttggaatcttctcaaggaggaacaaatattaaaatgacatgtagaaacaaatttttttttttttttttttttttttttttttgagacagagtctcgctgtctcccaggctggagttcagtggtgcaatctcggctcactgcaagctctgcctcctgggttcaagccattctcctgcctcagcctcccgagtagctgggactacaggcacccaccaccactcccggctaatttttagaaacaaatatttaaaatgacatattctcccaatacaatctatttagatctggagaaggaaaaatcagatatttatgatatagttttattttaattttgaattatttgtgtcacagctcagctttttggaagacaaactcaaacacctataatttcatttatatttctaattcacttggaacctttctgctttatgttacctagaaaatgataatttgtttaacccaaaacttctaaaataaattgcttaatccttgaaatatgttattggaaaattttaagcagtgcttaaacaccattaaattattatgaacttgtaattcagaattgagtaaagaaatattttttctagtccttcatatattgaaaacttgccacatgacattgtatcgtcttcattttccagaagatgcgttggtgtgccataggtttctaacttccttgaaaatagttttttaagtcaattgtaaatatacgtattattgttaaaagtaactttaaactgcaacacatagcttcaaaacaatatagagattttgtaataccttataagtggagttggctaaaataccttatccatataaaacttattctattctttgcatgcttattttgtgtgttggttgctagcttaaagtttgatttgttgttactctttgtgtgccaaattcactaggcaagcggatttttcctcagacttcaaaaaataattcttttaagaaaaaatgtaaaaatgtttattctaaaaagctgcattaaagggacaacctataaaaagttttgctagctcatctttagaaggaagaaagaatattagcttgggtgatgtttaatttgggtggcgatagtttctgtaggctaaactttatgagaaaagtgtacctactctataaaggtaataaatgtaaaacctcttgctgttattgaggaagctcttcaactaccctaaatttcacaaatgtaacttataacactatgaaaagatttgaccaacaatttacgtttgctgtgtgctttagtttttgtttaagcatattcttttgcttgaatttctgtgttcatgagagttagggtgttttatgcttcttgaactaattttataacatatttaatatattaccagttaagatataaaatcatttgtacatagcgaattgtaaagcagctattaaagtaggtgaaataaagtatatatttgccggttatccatatcttttagaagtcctgacagaacaaccagtttatttgcacataggtagcttctgtttgaaggaaggtaaagttataaggaaactcaaatactataagatgtgtcaaggtatttctccagaattaattgcaaagctagtgctgaaggattttaatcagcttctaaaattttcttctcaataaggcatatgttttgattacttagggaagattcctcatttttatttgccctttatgcatttaatccacatgataggacattaaaaattaatataaagaaaaatcgtgctcatactgtacatctgtttctgtgcttggaactacttgttaatagtttttatcgaagctgtcagcaataagggacataaaactgctgtattatacattgtggaattgaataaacagcctaattttttttttctagtatagggtacttaagcatttccacttttggaagaaaagtgtattagtattttatattgcatttcatttaaaaggacagttttttttttttttttgtaaatccattcattgaaatggtttctaaactgtataatgtaatttggagcctatttagtaatagaattaaatgtcctatgtagtgctacaatttttgaattagaaagtgatcaaatgtaagaaaaaaatttaaaaattcagcccagaaaacaaaatagtgtattaaattagtttaatgtaaaaggaatttataagatttttttcctcaatatagatacctcacttgaaaagaaagcacagcatacttaaagtagttctagtaaacatgtcctagaaaacagttgctaaatgtaggacatcttttgaggaattagtttatgagaaataaaattttacttgtttttactatcctgttagaagtatttgtttatcctgataattttaagccaacatagtagtcttaaattacttttgaatttctaatctgtgaaggcagtaaatgaaatatctgttctgcaactgttgaaacaaataattggctacattgaccataattaaagttaaaattttgccaatgatgtacagttttatggttaaagttgctgtggttggttgcattacatgacacagaaaactgtcctctacctcacgtgaaataaatattttatatggttttactaaaaataagactcatgtatctggtcacctagtttacaaattttgaattatatttattgaaacatgacatactgtgctctgagcttatacctcaattgtattttgtgctgttttccattttcatgccttgtaaataacttgtatagattgtggatcaaatactaaataaaaacttttaatgccaattaaatttgattcaagtta

SEQ ID NO: 102 - DNA, 7007 bp, Homo sapiens
cttttgaagttaacaaaaattgagtccctggctgggaggtcccccgagtgttccgctgtgggctggaggtggcgtttctgtcgtgatttatgtggagtggttcaaaacagaagttaatcactcgggaagcggacgggaggggcggcgctactgcgcatgcccgggagccgcctggagtttggaactccacattctttcagacccggcccgctgcggggcgttcctggggggtagcctcaaggccagcggggttccttcggctgcgtttctgtgggaggccctgaaacgcgcggagcttccctctgcctccaggctttcccagcgagagtgaaattaaacttgaaactcggatcaactggcagtcgttgttggtagaacgccctaaggacccctccccgcgggacggagggaggactcgggacagggaattggccctgggagaaaacgcgcggggggcgtccgagacgccccgtgaaagccgtgccgacccttgggaggactgacaggtctagagacacgcgctgtctgttgtggtgggcctcccgggaataagtgaggggctctgtgtttcgaggatggttctagcgcagagccgggtgtctgccggggtgggctccccgcattgttcgggctccggcgggggcggctctgattcctttccatggcccgcctcccaccccgggaatccccagtgctccttttccacggcttttctggcgtccccccgactctcccgcggcactttggcctaccttcccccagcgccgtggtcctccctggcgaccccctctgcgctcctggggtcctcctgcgccccccctcctccaccggcgcgctgcccacagccgcgtgccctctccccggagctggggaccaaggctgggccccgccggccgcatcggtgggaacttccgcggtccccatcccagggcgcacagggtccagctcctcggcgccgactcctggaaacaatgaaaggtgacgggctgaaggggaaactttgcgactggttcagggctctttgggggagccgaggctgccgaggttacccgggtttctttccccttttaggtttccctggcgagtcgtctggggtgggcaggcctctgagaaggtgggattcacggcctcatttctagtttcttgggtcctggagttcctttgcttgtgctaactcgtgcagtgtgcgggccggcctgtttcacttgaggccgaggaactctcaagaacaaaagctacttgcttttcctccttgggcccctccctctccccgtgctcctccgccgtcctcctctaaaactacctgggaggggggagccttccccgtcggctctggaaagactcctgaggaagtcgggccctccttactgtcttgtcttataaaagtctgcaaatcttttcaagttttcttaaaacaagtgcactttcagctccattcctgagcccggggtaagcttggtttgtgataatagtgtgtcctcccagaaagctgagagtgacgccaaaagatctcctaaaatgacttaaaaacaatgagaaggatcgataaggaaaatccactaagtctttttgctcccagtttttaactgttgaattcctgctttgggattgctctttggctggggtagccaaccataccttggatttggtggcttgagtgttcaatgcctgttgcttctcccaaggagatactgattttttttttcttttgttcctggagaccgggtctggctatgttgcccaggctggtctcgaactcctgggctcaagaaatcctctcgccttggcctcccaaagttctgggattacaggcaagagacattgctcccagctcaaaggagaacttctggtcaggaaacttgttgagttaaatttgctttttcctaattgtgcatctcgacttttcccatcaatcttatttctagagtctcttcacaaccggtgtctccctgcctccctgtctcatgatgttaccgagctattcagaaaagaaagtgcagggctgggcgcggtggttcacgcctgtaatcccagcactttgggaggcctaggcgagcagatcatctgaggtcgggagttcgagaccagcctgaccaacatggagaaaccccgtctctcctaaaaacacaaaattagccgggcgtggtggcttttgcctgtaatcccagctattcgggaggctgaggcaagagaatcgcttgaaccctggaggcggaggctgcggtgagccgaggttgcggcattgcactccagcctgggtgacaagagcgaaactctgtctcaaaaaaaaaaaaaaaaaaaaaagaacgtgcaggaacaaggtcgctgcttagggcggtgggatcctcaggccatgttgtggctttctccacaacatttccttgtatgtggatagcgtgaaagaagcttgtgatcctgcccccaccctccccaccgccacattttttaaagtgtaagcaaagcaagacgtttggaaacaagtcttaaccgggaaacttttcaaaagcgctgttacaataggaaatgagtaaggaggaaaaaagtctttgtttttccaagctgagccacaactaggagggagagttttaatgaaaacagtcctgacagcagcaaacgtggttttactgcagtgaaatatcagctggcgtagccaaggcactgaagtcttaacttcctgttacttcagcttttgtgcacatattggaaatatttgttaagagttccagaggtctggcattcatttatttaaatgaactgagaacagagtaaagtcgcgctgcagtttggtgttgcttaactgaaacctgcttttgtgtgtcactaacctattctgaaagatcaggcttcttgtcaaactaggcaagcagatcaaagggcagccttcaggggctttttttgtttcaaactctttgtgattaccaacttacagttgggaattcactgttcaatgagcaaattttcacactttttctagattaaaaaaaggaaggagataatagccttgagaagaatgtctggcttttcagacgttggagagtttaaacaaattgctttattcaaatttgctttagtcatttaattaacttaacactttttttaaaagttcgatttctttaattattaaagccaatgtgagacaggaactcagctataatttctttaagctattttattaatagttcttcacccaaatttcaatataggttttgaaagtctcatcttgccaatagtgaaagtagtttcagttttaaatgggcacttttaaaaacctttttaaaaacttaaatcatcaggggaggggaatttcaaatacatggcagttaaaacttaggattcttgtgcagtttatttgtagctgtttgttaagctgtgagctaaagtgaatttgcaagatcatccacctctttgttagaactttactttgtctttggagagttctgccttttgtaggaataccctgcagcaccttctgccccctgcagtccaaaactaaaaatgtgtcaccaagtcagagtcattaaaagggtgggaaaaattcctttaaaaaacacggtgtttagcttaagaggaatattccgtgtttatttcctgtcaaggggaactggctcaattaaggtcaagtcatattttcaaccaaaattacatactacagaggaaagaaagcatacaaagctaaaaatgcttacctttacatttttgttattttaattacttcccctaatatagaagtactgatttttttcaagcatgccattgtttgtaattcatttctgtttttaagattctagattgtctacaagcaaaagaatgtatttctttagtcattcggagtagcctgctgtagtttttgaaaggtggaattaatagcgtttgttatttaattttttttaagttcagaatgatgtttaaatatctgtaaaggccagttctggagctttattgaaccccgtccatctgtgatttaaatattctctatggcttgtgaattcttaaaatttctggcaggattaaagtacttacagccaaaagagcttcctctggggcttgcatattcagtttcctttgtcatgtaatcatttaagactgaactctgcttattgatatgtagtattctattctaggttgagctcaaactggtagctgaaatttaggagacatttttaattcatttagtattaggcatcttttgaccttactaaagtaccagtagtagaaaaatatttttgtgtgatgaaactgaaaacatcagtggtcgtatttaataaaaggtgactagtactgcccatttaaagtaggtgtctaactttgaataaatgtggatagcaatgaataagaaatgaccatgcatggtgttagcagaaaattttaacatgtgttttacctttagaatactaactgggttcagcgtagtatgtaattttccttccttatatccatgaaaaaaaatgtacgagtgctccctttcatttcaaaccttcagtagaggaaggaggaagagtagcatttaaaatgtacattaggactggttaggttgcttttcctagttagcactgatcttagaaagaaggttggtaggcatattccaactgccacagcacccttcctgtttcaaatgtggcaggttattcattttgggtgcagtttgtctcctccaatgattagacgaaagagttttctgaccatcattcaaaaggaatgtgagaagttaatgaatcctagaggaaagcggctgagaaaaggcatctggcatttggttgagagcctcctatgtggtgctagtcaaactacttttacttggaccctgaattcaggacagaaaacactgctccttctcctcgctctcagttgttgggaaagcatggttacattgaatggtcagcgttaagtgagctttgcaatagttgctgtgcttataaagcaactgacaactggcccttgtcctttcctaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtaaagaaagagagcgtgaggtttatggatgcatttttagtttcaaagtcattttatggcattcctgtgtgtcaagtcattaagctccttgccactcaaagacagaaggaatatctttttattgtaaacttgatagtgttaaaagctaataactagctatttagagaacacagaaacacttgacagtcatctatcagatagcatttcctttaatgcctaaaagaaccttcctttatgcaacagacattaaaaggaggttaaaccttactctattgtccaggaaactggtttgatatttaaacaaggacgacttcagtgaggtaattcatgttatgtctgttgacacagtcatttgaactgggaaaaatcagttactgggaggagtggcccttttcataaggagaggttttcctgtagttgattaacttaaatgttggggcagtaggtgataggttaaaatggggagagttaaaaagtaaacctctctctcaaatcatttttaagcatttgagattgtatgtctttttcttcgtcctgaaaaggtttaagtatgaagagacaaaaaaggaaatttgtattagaaactagaaggcttatgacaggtggtagcttgctttcttggcggagctcagataccttgaaataacattgtaaattcagataaggcttttcatgctttctttaattcagagagcaagatcaattaggtaccccatagaacattctcagaacccgttggctgagtgaatgaggaaaatgttaaagcgtaccgatatgatttcaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaa

SEQ ID NO: 103 - DNA, 15093 bp, Homo sapiens
gtcagtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatggtaaggctccgggacgcggcccttccctgccctgccctctccgcgcccgctccattaaagttctccatccagtggagagccctggctggctggccctctggcagagcggtgcccgggtgctcccttactctggcaaacctggatctcaggctcacctgttgtggaagtggaagaggctgaaattgacaggaactgacggattgggaaggatagagaagtatgcgcaaggccaaacccccaacccgcaaacctcatcatccacccacttctagatgagccgtaagtttagctctaggttttttgctgtttaggttcaaatgatgggacttcttgtccccttggggaataattttgatctcctgactctcccttctcttagtcgactcttcaactaacctctgtctgtccttctcccatctcaccttcatccctcactgatcaccccgatctgatcccccttgctccacctgtagcccccaactcactcccactgccccctgcctctctcctcctaacccagccagttcaggcttctaacccagttcaggctcctaacccagacagttctccggcaaggtttctgcaactaagaaaagtaaaccccagagacagaatgaaagagccgggagttggaaggaccaagagcagagacagagagcaaggaccgaaactgcttcttcatgacaccaaaatacaaagtaaaacatgcagtcagccattcacgtgatcgagagctgagtcggagatgtgcagcccaaataccacaacgactcgctgcatttttcactttccgtctaatgtttcgaaatcaaggcactgacgtgaagatcaaagacggtataagaaagaaagcaagagacagatgacagagtcctcccccccaaaaaataaataaaaaacaggtgcatgattagagagatgtagagaagttagaacactagggagcgggagcagagtcgctgtcaaatggagagaacttagaggatcaaggaggagagaaagggaaccaaccagccgttggccttgcacatacttcagtctgcttgatcaacaagactcttaaagtagaaatgtttgttgcattcttacaaagaagacaatgccttcagcagtgtttcccatggtgaatggtgtgtactgggggtaaagggagagtagagctaggaattggtattgagtatctctcctcggagctacaggtgccagctcttgtggggatgtcctcagccatgtgtagagccagagctgatttattccatctgtccttgcccagccagaggttggacatctggctataggcaaagccctcccagaaactagggaatgaggcaagcacttagcttggggagcccaggagacctatgaagagaaggaggcagatgtcagcaagcaggctgtctgtgtacttagtgaggtggctttgagctggagcctgggccaagccagggtggggatcaggtgtgtggatggggccaagcctaggaatagtgctagagcagggacagggattgggcagagccagggactaacacatctgagagctcattgccaacttgcttagccctcggcccctgccttcttccctggtaggcatcagactcagcttggctcttctcagcccccactgcagcttctgatcacagagagcacagggcagtgatttagggagacacactagctctagaatcagacacatgtggattcatgtgcccactctgccccttacgggctccgctggcctcgggcgagtcatagcctctctgaacctccctttcttctttggtaaaattggggtcatcaatgcctgccccccctcccagctgtggtactgacactcttctccccagggacagagctgcccagccctccgtctgtgtggtttgaagcagaatttttccaccacatcctccactggacacccatcccaaatcagtctgaaagtacctgctatgaagtggcgctcctgaggtgaggaaaagggaagagggagggggagggaggagtgaatccccgccttgtcctctactctcctagcatgggaagatacctgccttgttaatgaagtgagtgcctgagggcccctaacacatagccagcagttgacaagtactgactgagactcccttgctgagcaatgtgccgggagctctgggtgaaaaggccagagcctttgctcactccagagtaagaaaagccttgtgccaaggcttttctcttttttgttttgttttgttttgtttcgttgagacagcttctcgctctgtcacccaggctggagtgcagtggcgcaatctcagctcactgcagcctctgcctcctgggttcaagcaattctcccatctcagcctcccaagtagctgggattacaggggtccaccaccatgcctggctaatgtttgcatttttagtagagacgggttttcaccatgttggccaggctggtctcgaactcctgacttcaggtgatccacccgcctcagcctcccaaagggctgggattactggcgtgagccaccacctccggcctccaaggcttttctatcttactggaaaaggagaagcatccacagtacagccagacaacaggggaacactaatgactgtaaaggcagtggggagaagggagagaccaggctgtgctgtaggagccagaaagaatttctggaagagctgggcctactcgtattcctatctaaaaatctgctagaccacatggaaattggtacggggtcccaagaccaagggagacccctcacaatgagctgccgtggactagaggatatagcctgagggctgtcccagtttctcccaatgtgggagctctcttcctggcctcttgcgtctcccttaaaggaggtaggattgagcacaagctcgtttccagtgcctaacctggtatctcctcaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaaggtgcttttcctcccttgacttagaacatggctctgaagtcccttccagccaggaactctagtctagagcttttctgtctattaccatagctcaccatgtctgccagcctccctggccggagaactagttgcccaaacagggcaggactttggagaatgttagataaaaatagcccaagttgtttgagatttaaaagggaactggagttgtttatcctacagaagagaggtcttggggtgggttgggacagctgagtcaccaggtccaggcctgtgaacttgttttttcagggagggttcagggagaggaagcgaatccatgaacactcagcatagggcagcaagcagtaggcagaatttgggtgaacgccccgcttctttaggggtgaacacccaggggtcatccctttgaaatgggaagtgctactaaagagaagttatggatccctctctggagaggtaagaggaaaggataagcccccaactcagtgggatttttcatcccaccagttgggattgagaaagttttgtgtgcatggagacctcgctctgtaggattcagagttagagccgatggtctaggaggtcattggcttccaaatgcctgcccacaggccactgctcagctggtgcagaaacgtttcccagcaagtgtgtttaaaatatctatttccagggcccagcctcagaaattcagaccaactgtgtcttgaatgggcccagggcatctgtattttttttttttttaacattttgttcttctttgtattttgatttgagcaaggcaattataaaaagacatttttgaggaaatcaccatatttgtatatgaaatggtttttagggcatattactaggtatttgtttgttacatgtgataacagcatggtagttatatttacaaaggtgtgatatgtgagagatacatacttacgtaattaggaattaagtaatacagtgcttgggatttttctttaaaatgctaaagtaaatttcatggggggatattgatgaccctcccctgccaccaattacttcaaaattggcctagtgtttgcaattactaaagctgggactttggaaatcattatattctcttctacttttctgtctattggaaatttctacataaaaatataatcaatgcaatttatcacattaaccatttaaaaaagaaaacaacatttaaaaagaaactaagcaaagttaaagtagaaagaaaatgtcctaacctgtagaaaggtatctatctacacatatctaccataaatattatgcttaacagtaaagtgttgggctgggctcggtggctcacggctgtaatcccagcactttgggaggccaaggtgggtggatcacctgaggtcaggagtttgagaccagcctggctgacaaggtgaaaccccatctcttctaaaaatacaaaaattagccgggcgtggtggcgtgcacctgtagtctcagctactcagggaggctgaggcaggagaatcacttgaactcaggaggcagaggttgcagtgagccaagatcaagccattgcactccagtctgggtgacagagcgagactctgtctcaaaaaaacaaacaaataaacaaaaaacagtaaagtgttgaaaacgttttataaaaaagtttttcttttaattgacaagtaataattctacatgtttatgaggtacagtgttatgtatacataatacatgtataccttgtggaatgatcaaatcaaggtaattagaatatctatcacctcaaatatttagcatttctttgtgccaaaaacatttaaaatattatctttcagctattttgaaatatacagtccattattattactacagtcaccttgccgtgcaataggcaccagaacttattcctcctgtctcactgtaacttggtacccctctccttgttccctatccacttctcccacctgcctccttccagcttctggtaaccacttctactctctacttctatgaattgaattctaaaagaattctacttagattctatacataagtgagatcttatggcatttatctctttgcacctggcttatttcgctcatgatgtcctctaggtccatctgtgttgtcccaaatgagagtttccttttttttcaatttgagacaaagtcttgctctgtcacccaggctgcagtgcaatgtcttgatctcatctcacttcaacctccgcctcccgagttcaagagattctcttgcttcagcctccttagtagctgggattacaggcacgtgccaccatgcccggctaatttttgtatttttaatagagatggggtttcaccatgttggccaggctggtctcggactcctgacctcaaatgatccacccgcctaagcctcccaaagtgctaggattacaggcgtgagccactgggccgggcctcagtttcctatttttcaaggctgaataggattctgttgtatatacataccacatttaaaaaacccattcatccattggtgggcatttccatatcttggctgttatgaataatactgcaatgaacgggggatacaggtatctcttcaatacactaatttcaatatctttcgatatatacccagtagtgggaattgctggatcacatggtagctctatttttagattttcgaggaacatccatactgttttccataatggctgagaaattcaccaccagcgacatgcaagggtttcccttttcaccacatccttgccaatgcttgttacttccatcttttggataatagccaatctaacaggtgtggagtggtatctcattgtggttttaatttgcatttctctgatgattagagatgttgaccattttttcatgtatctgttggtcatttgtatgtcttcttttaactgtctattcaagtcctttacccattttaaaaacaggtttatttgttttcttgttattaagtagtatgagttccttgtatattttggatatgaaccccttattcaatgaacatttgtaaatattttccacccattcatagattgtgtcttcactctagtggttgtttcttttgctgtgcagaagctctttagtgtgatgcaatcccatttgtctatttttgcttttgttgcctgtgctttagggatcgtatccaagaaatctttgcccagaccaaagtcttagaactttgccccaggttttcttctggtggtttttatagtttcaggtgttacatttgtctttaatccattttgtgttgattgttgcgtaagaggtgagacaaagatctattttcattgttctgtttgtgaatatccagttttcccaacaccatttgttgaagagactgttcttttcccattgtgtgttcttggcccctttgttgaaaatcaattgtgggtttatttctgggctgtccatcatattccattggttgatgcatctgattttagggtatatgtatttttaatgtgctccccaagaagtccttacattctgctgcattgacaaacctgtggccaagttttaggcctaggttctaattaagcttaattctggaggcaaagtctcggcggggacacccaggccctcctcagccctcaagtctcatggtattcccccccaccccaactccatttagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacggtatggggttccccaaggccccagggccagaactcccttggcttccctgtcccctgggctggaagcacccttgtgtgccattgggaactttgcttatggactaaagggagggtctgggatggtgggtgggcagaggagggagtagaaaccacctcagccctcagagctatgctcttgtgagatgctcctcaaaggaattgcctactagggcaattgggcaccccagagcccttgtagatgaagcaataaggctctgagaggctgtgtaacctaccagagggcgcccctgttatgggagagctggcatctgcaaaatccaccctctctcctctccaccactgttgattccagccccttctgggaagatcttcagcatctataaaacaccgctttttcttttaaaatacaaaataaaattgtggtcattacagagatcatgtgctgcattggtaattgtggggtttgtcatcttagacaaaggatactgaagggggttggctgaaatcacctctaaaggcccaccagctctcagtgtccgtgtgccatgaaataaaaggattttgttaattgctatcatttttgtttcagttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtgtgagtcagctgggctgctctcagcatggggagggagactgggagggcctggtgcaatccaaaacgcgtgcacctgggatgctggtgccagccactgtgttaggtgctgcttcacatagctctgcatccttaataggagagaggtcctactgtcctcattttagagatgagggaactgaggctcagtattagcaacttcctagggttgcacagctaggacttggtggcagaaccaggtctcttggatctagggtcctcccactggagcacagcggtgtttcccaacaacatccccctcccccggggccatcttcagtgagctgtgctagttcctgttgttacagtcttctgctgttcttcctcagagccagggatacaaagggcttctccttacttcccctactctgctctgctcctcgccagagctgctaaagtcagcaaatactgctccaggctgtcagtcaggtgccggggctgtagggggagggagataatagaggacatggaggccacggtcttgcctaggaggatcttgcatcctggctggggagatagagtgtgcacagaggagactgtaacaagcaactcttattggacagcagatgagatgtccagtgcccaatgaaacatgccaacagtaagtgctctgggagggcccagtccagtgtgggcagagtctggcaaaggtgaaagtgactcctgctagatctgcaacaaatttcagtttgtgaaggacactcaacagctcagtgtcatttaagtctcaatgcagaggaaggcactaagtgggtatcaggcagtcttaagagtttttcatacattcattcactgatacatgaaatagttccaaatctcagctttacaacttttgaggtatatgactttgggcaaattacttaacttctatgtgcttcaggatcctaatatgtaaaaatggggctgatgatagtatttacctcctataagtataaaagttaaaagaatctgatggtattggtacatggtcagtgctgtgtacttcacaactaccttatgaggtcagtggctctgacagagtaattaatttgtccacaattgcacagctagtaagtggtgaagctgggacttgaacccagatctagcagcccccggagcctcgattcttacctgctgtaccatcctgcctcactgttctgtttgctgtgatgggagtcatgtgcagagagctggaagcagttagcgcatctcctgagggaatccttcagggcatggtttggaaggccaggtagggattcgcagaaacctagacacatctagagttgtggcctgtagtttgccttgggccactcactgaatggttcctgacagtgggcaatggatttcatgggaccagagtcctatgtccagaatcaccgtgccccatggtgacaggccacaaacacatctctctgggcctgcagatttcaccgtgaccaacgtcatcatcttctttgcctttgtcctgctgctctccggagccctcgcctactgcctggccctccagctgtatgtgcggcgccgaaagaagctacccagtgtcctggtgagtcttgcaaggaggtcactgccccgtccttcccagccacacccgagcttccaggagggcagggagctcttttcctcccagccagtccattgccttagcttgcctctgctctcagccctgatgtgattgggagataccttcatcaagcgctgtggggacagagggaggaagtgagcatgaagcccagtaccgagaatgttgccatccagtagctcagatgagacacatggaatcacaaatctcaatgaccacgagccattttgatatgatctactagtagttggccatggactagcccctgtgcattgcatctctgattatgaggcacagttattatccccatttcataagtgaggaaactgaggcacagagagattgttacacacagagggccacacagccaggaagagtcagggagggaacccactttcctactgctattagccatgggtgttccacaagagagaaagaaggaaaggccagaagtgctggtcctcgggctgctgccagagtgggccagaggagagaggacactggggggcggtggggatgctgcgccactggagaggggatgctggcaggggacagggaggggctcatggaggaggccaagccctcctcccctcccagggtgtgtcctcttgctacattgtactgacaaatgatacatttgtggcaagccagtctccaaaactcagcttgcaaagattgggcagcattttccaaacctcggcctggtctctggcctggagttcaggccgcattgaagattgcccaccatagcctccatagctggcactattgcatgatggctgagggatcagctgggaaggaaccagctccgtctgcaaggcaggggccccacaactggaaggggaatctccagagcgatcctgggatctctagggaaaacaagacgagagacaagtgcagtggcacaatctcagctcacttgcagcctcaccctctcaggttccagtgattctcctgccttagcctcccgagtagctgggattacaggcatctgccaccatgcctggctaatttttgtatttttagtagagacggggtgttgaccaggctggtctcgaactcctgacctccggtgatatgcccacctcggcctcccaaagtgctaggattataggcatgagccaccgcaccctgccccttctgtacttttggatcacagaactgacttgtccttgagggttttttctcttcaggataaatatagctcaatcccttcatctgatgatcgtagtcattaccacatgaataaattataatgcacagagcactgacacattcattagtttgttctcattcattagcttgtttgatttgatctttcaacagttcatcaaggtaagtattattggacaaggaagggatttcaaatcaggacagttgaggatgaattccagatgtgttctttactgttgtgccactttgtgcaagtcatttaacttctctgagcttcagttttctcctctaggaaatagaggtaataatacttctcttacagaattattggagggtaaagttcaattcaacatatatttattgagcaccttctatgtaccacactttgttctaagcactgtagacacattacaacataaggaggcaggtactgtcattatttccatgttacagatgaggaactaaagcacagagagggtaagtaatttggtcagggtgacaaagctgataagagtcagagctgggatttgaacccaggaagtctggctctagaggacacatcctaaatcaccaagcaatgtgataggaatagggactcaaccaataagagctgcatttgaatcatcatgtaccaaggaaatgagggcagatgtgcaacagtgagtcagtgagtcagtcggcagaccttaggagggcctactgtgtgccagctcagtttagactctggagacagggtagtaaacaacactagacagttcctgccctcaaggagtttgtgttcttttgggaatgtggagtaagtgagtgtgtgtatggtgagagacgaaaacaaacaagtaaaataattctaggaacaaagtgctaggaagaagtaacagggttaatgtggagagagtggcaggagtactgctttaggcaaggtattcaggaaggctttgctgaagaagtgacatctgagctgagacctaagccatgtacaggacacagccatataaagtgccgagagcatttcaagcaggagggagagtgtgtgcaaaggccctgaggcagcacggtgcttgatgtgttctgggacagaaagaacaccagtgtggctagggcagaggggttatgtggcttccttgaaacccttggcaattaacagagagcagccccttcactgtgagttccacacttgtgccactgccccacgctgcagccaccatgttcgcgtgagtcactactcggggaatagaaaacttaatttggtgtcttacatccagaattttagaaaatgaagtaggcaggagggcatagactgggatacaatagaataagaactgcagaaatatcgtggcacagctcataatgatgagtattattttgtgaaactggtttcagttatttacatacgggttatatatacaagtcattatgcaacttatttctgattttgagtcatagtcaaaaaagtttgaaacatgcttctagatgggtctagcctgctttcaggtttgaaaagcactgtggatggagccacctgagagttttcaccatgctcagcagaccttggttctgcctgttactccatctgggcctgagaatacaagtttcttgtgtatctggcctgagccaaactgggaattgcattaggaggaaagctggattcgaaaacaaaacagaatacattccagtgtaatttagactgtagtctcctccatcgagctctcctcctgggcctggccttccccggcagcactgggatgggtgctggaaggtgactcctgcttctctcactctgccctctcttccccagctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacagggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccacaggaa

SEQ ID NO: 104 - DNA, 30875 bp, Homo sapiens
cccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcaggtgaggggtccgcggggagggggcgcgcttgggaaccgggaggccccgcgagatgccgcccctgatcccatccctgggcgccctgcaagtgacttaagagccttcggggcctcgggagagaagatgcaaacgccacggccggctgctgagacgcaactaggctgctgctgccgtcgattctgtaacaggagaaagccccatccgcgcccggattacagaccgtctgggccctaaactcagggggagactcccggcgtcttttgattccctgtcctcctgcagctctctgctggcgggcgtctaaataaagtagcttccccaaaagacccaagatcccaccgtggctgtcatctgacccttctggagactatcagttcaagtggaggcccccaccagtccccgagtgccctgacagccctccctgaccccaagtctgccccctcagtgccagccctccctacagatgtgcctcccatcacccgctgcacctcccctccttccggttcaggcccgagcaccctgaaatctggattctgtcccccagcgccccagctccatggcttctaaacctaaatccattgaaaccttttctgtcctctaaattgactgcctaggttccaataacaccatggtcacctccttcctttctcatgaactcttccctggccttccgggatacccctccggtttcccgccctgtcaggctgtctctgcttgggaccctcctgctctgtcaggtttctatgtagctaattgtgatgcccaaggccttttctctccttccctggcactgttcctttgggggatttcagccaaaccctggcattaaacacgggctataggcccatgactcgcacatttatatctctcttggtaccagttgggtgatgggtggtggtttattatagtcttctacttttctacttgcatgtaggtttcaaattttcttttctttctttcttcttccgtttttttttttgtttgtttgtttttttgtttttttgtttttttttgagacagggttttgctctgttgctgtggcccaggctggagtgcagtggcttgatcttgcctcactgccacctccgcctcccgggttcaagcgattttcctccctcagcctcccgagtagctggaattacaggtgtgtgccactacgcctggctaatttttgtatttttattggagatggggtttcgccatgttggccaggctggtctcgaactcctgacctcaggtgattcaccttcctcagcctcccaaagagctgggattacaggcgcgagccaccatgcctggccaggtttcgaattttctattaaaaggtttgaaaataatttctgtctctagcccacatctcttcttggtgtgacctctgggctcattcatctggctgtctccctgacattcctacttcagcctctctccagcatctccaacctaatgcagctcaaatgggactcgtgagttccccagctgagctccaatcggggcaccagctgcttaagcccaaaatggacattgacctcagcttttatgcatcaaatgtatcaggaagtctccagtttgtttttacgtctggaaatatatctgaaatccatgtgcccaccctaccccctcatagctttctgccaccagacaaatccaaggctcctttgtctgtccccattttactcctgcccctccagaaatttctcctcacggctgttcaaagaaaatctagactcctcagcacagccaacctgtctctccctccctcacccacgtggcctttgaagacatggagccatagaggagaaccaagtgctggatgtgggctttttcatgggcatctgttttgaggagaaaagttgtaaatgtttttgtcttattttcatagcattgggaatggtaccacctcccgaaaatgtcagaatgaattctgttaatttcaagaacattctacagtgggagtcacctgcttttgccaaagggaacctgactttcacagctcagtacctaaggtgggtctggcctcactattggcaggaacgcaccggaggagccagccctgggctggtcactgggttgggccacaggaggaagggagtctgactacggtcaccgtgtgactgtgacaaccctcagggagcctccctgccagccttttgctgtctgggaaattctcgtggccaccttttctcttttaggttttctagttgtgatggttgacgatttgactgttaatcacagggctgctggcagatacagacattttatcatgcgtatgtagatataatcagccatagtggtaacctcatgctgtgcccatcccagcttgtttgtcacagttgatatattttaaaagaaaaataccactgctgtcatctctaggtatgagtagtattgctggaagtcagcaatgttgagtggatgctacccaagaaactgagatatgcaaagcggtcaggaagccccttgctaccatatatcacctgttcccctccaatggattataacatcatgccccagtgccatgcgcgatgcacataatttgcataatgagtgctcagtttctccgtggttccatcctgaaattaaaagtaagacagctactgactgttaaaaaccccattctcggacaacagcaggggctgtgaaggaagagtgagtgtcaccctagacggtcatctcagtggtgatctgaacgccctctacctctcctgcctgtcagtgtttccctacgcctggtgaaggaagtcagtgccagcactcccttggcagcctgccaccatacgccacatgctggactgcaggtgacacacctttaggccaggcgcaaacagcagcaggaggcccaaggctgacaagccaacacacctgctttctgtgtgactcagaaacatacgaagatagacaagtccttcagtgaggcaggaggaaatttcttcccagatccagctgtcatttcacaaaaatccccaaggcctgctacatcagagaagaagtagaaaggtgaataagatagtcctcgtctgtgcattgctggcttttgttttttaacttttagttcaaaataattccagactaacagaacatttcaaaattttaagtagaatacaaagaatttccaaatagcctacaatcagattcaccaatttttttttttttttttttttttatgagacggagtctcgctctgtcacccaggctggagtgcagtggcgcgatctcggctcactgcaacctctgcctctcgggttcacgccattctcctgcctcagcctcccgagtagatgggagtacaggctcccaccaccatgcccagctaattttttgtatttttagtagagacggggtttcaccgtgttagccaggatggtcactatctcctgacctcatgatccacccacctcggcttcccgaagtgctgggattacaggcgtgagccaccacgcccggcccaggttcaccaatttttaatgttggtcacattctctcccttcctctctctctctcatgccctttgtgctgtaatatttcactgtgtatttcacaagaacaaggataatctcttacatcacatagtacagtgagaagctcaggaacttttacattcataaaatacttgtatctaatttacagtccatagtccagtactgtcagctgtcccaaggattgaaggagggcatactctataattaatttttttcctgatgtgcattttctagtactgattggctttatcatttgctttctgtgctgtctctactcagtctgaatagccacggagattttactgtggaaaattaaatttcttctctgtctgtctgtctccctgtagtttttcttgttctgtgctgtgcttttgggtttgtttgtttgtttttcttttttttttttttgagacggagtctcgctctgttgcccaggctggagtgcagtagcgcgatctcatctcactgcaacctccgcctcccgggttcacgccattctcctgcctcagcctcccgagtagctgggactacaggcgcccgccaccacgcccggctaattttttttagtagagacactgtttcaccgtgttacccaggatggtcttgatctcctgacctcgtgatccacccgccttggcttcccaaagtgctgggattacaggcgtgagccaccgcgcccagcctttttttttttttttctttgagacagggtctcactctgtcaccaaggctggagtgcagtggtacgacctctgctcactgcagcctccacctcctgggttcaagcgattctcctgcctcagcctcctgagtagctgggactacaagcacatgccaccgtgcccaactgatttttgtacttctagcagagatggggtttcaccatgttggccgagctggtcttgaactcctggcctcaagtgatccacctgcctcagtctcccaaagagctgggattacaggcgtgagctaccacacccagcccatgccatgcctttttgccattatagtcgaggcacttggctttgcatgtttatcttttatgttagcgatcccaatgacttcatgaagtgacttcatgagggtatccacacctgggttccaggtctcccccgcgtggaactacagagtgagtatggcatgtgctggagaaaacaaaatatgtgctggccgtgtccttggggaagatatttgatccctaaagatgtgattgcctcatgtggctctacaaaagagttgtttagagtttagcatgagcaattgcacagcacaaactctctgttgtttgcgtgcattggggcagggcgtccagagccgggggcacttcagaggatgtactggtgattttaatataaaaacatccaaaacaattagatgtaaatatgaggaatgggtcatattacctatttaatgcggggagaagtatttgtacatgcaataaaaataacctagtgaaggccaggcgcggtggctcatgcccgtaatcccagcactttgggaggccgaggtgggtggatcacctgagatcaggagttcgagaccagccttaccaacatggcaaaaccccatctttactaaaaatacaaaattagccgggtatggtggtgcatacctgtagtcccagctactcagaaggctgaggcaggagaatcacttgaacccaggaggcagagattgcagcaagctgagattgcaccattgcactccagcctgggtgacagagtgagactccatctcaaaaaaaaaaaaaacctagtgaaaaagatgttattgcaaaacaacttttgaaatactgcacatgctggacaattgatgcattagtttaaaagaaggaaatgggccagtaatcccagtactttggggggccaaggtaggataatcatttgaggccaggagttcaagaccagcctgggcaacatagcagcctcttgtctctacaatttttttttttaattagctggacttgagttggaaagaaggaaggcggaagggaagaaagaaggtagggaggaaaaaaaatatggccacatgtgagaaaacccccttaatgaaatgaccgctggattttccaaatgatgggatgttaagcagccgtgaagaaatggttgattgacaaatatttgtggtatattaagtgaaaaaatagcatgatcccaatgatctctatctactttttgcaagggatttttctaggtatcactaagaatgctgtgagatgtgatgtgctaccttagactatgaagtcaaacagatctgagttcagttgggcagatttcttaggctctccacgcctgacccctgtgtacttaataaatgttggctgttgttatttttatcaccatcactttcatcatcacttctgggagcaaccaaattggttttggcaccagaagatgtcttgggggaccaatcagatagctcctcacttttttattttattttataaatttttaaattaaattaaattaaattttttgagacagtgtcactctgttgcccaggctggagtgcagtggtgcaatcacgtctcactgcagcctccacctcccaggctcaagcgagcttccctccttagcctactgagtagctgggactacaggcgcatgccaccatacccaaataatttttttattttttgtagagacaaggactcaccacgttgtccaggctgttctcaaactcctgggctcaagtgatcctctgcctcggcctcccagagtgctgggattataggcgtgagccactgagccgggccagctcctcactttttgcaggatgagagcctgggcttcctttgatcacgtggagccaattacacctccttggctgttgcgagcttagattcaggagattgtatttccctagcatccaacaggcatgtccaaatgtcatctcttttcttccacttcactttctgtcatgttccctttagcggttgctgtcggggctggtgttctgactgagactgatgaattgttttataatttttccagagtaattgcaatgatagtcatttataggacaggacagtcacgggtcacttaacaactggggtagattctgagaaatgcatcattagacagttttgctgtgtgaacgtcatgcagtgtacttgcacaaacctagatggtgtagcctcgtatacacctaggctatgtggtttagcctattgccccaggctgtaaacctgtacagcatgttactgtactgagtgctgtaggcaatcgtaacacaatggtatttgtatacaggcatatcacagagataaggcagttttggttccagactaacacaataaagctaaaaccacaatagagtgagtcacatgaatttttttgtttcccggtgcatctaaaaattatgtttatactgtagtccattaagtgtgtgatagcgttatgtctaaaaaaatgtgcacagcttaattttaaaatatttacttgcggaaaaatggtagcaatcatcagagccttcagcaagtcataatccttttgctcgtggagcatcttgccttgatatggatggctgctgactgatcagggtagtggttgctgagttgcagtgactgtgacaatttcttgaaataagatgacaatgaagtctgctgcatcaactaactcttcctttcatgacagatttctctgtagcatgagatgctgttcggtagcattttactcacagaagaacttctttcaaaattggaatcctttcaaaccctgctatcaactaagtttatgtaatattctaaatcctttgttgtcatttcaacaatgttcatagcatcttcaccaggaataaattccatctcaagaaaccactttctttgctcactcattagaaacaactcttcatctgttcaacttttatcatgagattggagcaattcagtcgcatcttcgggttccgcttctaattctagttatcttgctgttttcaccacatctgcagttacttcctccactgaagtcttgaaccccttaaagtcatctatgagggttggaatcagcttcttccaaacccctgttaatgttatattttgacctcctcctatgaatcaccagtgttcttaatggcattttgaatggtgaatcctttctgggaggttttcaatttaccttgcccagatccatcagagaaatcactatctatggcagctataactttacaaaatatatttctttattttattttatttcattttattttattttttaagatggagtctcactctgttgcccaggctgaagtgcagtggtatgatctcagatcactgctgcctccacctcccaggttcaagtgattctcctgcctcagcttcccaagtagtgacaccacaccaggctaatttttgtattttttttttagtaaagtcagggtttcaccatgttggccaggctggtctcgaactcctgacctcaagtgatttgcccgccttggcctcccaaagtgctcagattacaggcatgagccactgtgcccagcttcaaaatatatttcttaaataataagatttgaaagtcgaaataactccttgacccatgggctacagaatggatgttgtgttagcaggcatgaaaacagcattaatttccttttaaatctccatcagagttcttggggaaccaggtacattgtcaatgagaggtaatattttgagagaaaactttttatcctgagcagtaggtcttaatactgggcttaaaatattcagtaaaccatgctgtaaacagatgtgccgtcctccaggctttgttgctccatttgtagagcacaggcagagtagatttggcataattcttaagagctctctgattttcaaaatggtaatccagtgttggcttcaacttaaagtcaccagctacattagcccttaacaagagtcagcctgttctttgaagctttgaagccaggcattgacttctcctctgtaactatgaaagtcctagatgacatcttaatagaaggttgtttcatctacattaaaaatctgttgtttagagtatccaccttcatcattttagctagattttagctagatcttctggataacttgctgcagcttctacatgggcacttgctgcttcaccttgcacttttatattatggagatggcttctgtccttaaaccttatgaaccaacctctgctaacttccaacttttctttttttttttttttttttttgagatggagtctcgctctgttgcccaagctggaatacagtgacacaatctcggcttattgcaacctctgcctcccgggttcaagtgattctcctgcctcaacctcctgagtagctgagattacaggtgcatgccaccatgcccggctaatttttttgtatttttagtagaggtggggtttcaccatgttggtcaggctggtcttgaactcctgacctgatgatccgcccacctcagactcacaaagtgctgggattacaggcgtgagccaccacacccagccccaacttttcttctgcagtttcctcacctctttaagccttcacagaattggagtgttagggtcttgctgtggattagactttggcttaagggaatggtgtggctggtttgatcttctatccagaccactgagactttctgcatattttcaataaggctgttttactttcttattattaatgtgttcactggagtagcactttaaatttccttcaacaacttttcctttgcattcacaacttggctaactgtttggcccaaggggcctgttgtggcctgcaatatgccttcctcactaagcttaatcctttgcagcttttggaatagggatgcccgaggagaaggagagaggcaggagagtggacagtgggtggagaagtcagaacactcacaacatctattgattaatttcactgtcttatataggtgtggttcatggtaccccaaaacaattacaacagtaacatcaaagatcactgatcacagatcaccataacacatataatcatgatgaaaagttttgaaatattgcgagaattaccaaaatgtgacataaagacatgaagtgagcatgtgctgttggaaaaatggcaccaatagacttgctcaatgcagggttgctgcagaccttcgatttgtaaaatgcaatatctgtgaagtacagtaaagcaaatcacaataaaatgaggtatgtctacatctaaatgtatttaaacatagaaaaggtacagtaaaaatacagtatcattatcttagggcatcaacgttgtatatgtggtctgtcatctaccgaaatgtcattatgcagcacatgactttattgaaaatcattgtaatatctttattttggtaaatttttgtaaatcaatgtctcataaatcacatgcccctgttttcaaaaatacgtaatcaaggaagcaagctttcttggtcaagtatgctgaatactcaaccccttggagaggcacgtagtcattaagatgttcaagtctctgagaagttctgttttgaagacacgtatttctatgtttaacacagtttccactcccgcgccgcccccccctccaaattaagtaccagtcagcctcagggagactgaagccagaactctcctgattgacctatctttttgattgtgtagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacagtaagccattttgttttccctttttttgtaatgtcatcatcttgccttgtttttttccacattggttggtccatcaacaagaattctttgagggcccacaaatggatggccttgcacaaggagcttaaggaatataataaagagagttgtatccctaaagaattcatgggagagacagaaaaagataggcatatcatcaatgcaacaattaaatataaatctaacaccttcagtgcctcaaggatgtgactatgttggggcccgtgctgttgaggagaagttctggaaggattcttgtggtgaattttctgggagaaagtcagtatggaattatgacttaaacaaagaaacataacgtgataggcaaaagaatgaaggcagatgtagagatggaaaatatgatgcggacagccggcttgcccagagcgaaggacagagggagggatagggctgatggcaggtgggttgggtcagactggttggtcagcatcaaaaattgttcccaggttaggtggagattgcagtgagccgagatcacgccactgcactccagcctgggcaatagagtgagacttggtctcaaaaaaaaaaaaaatattgttcccaggttagatttggagggtcatggtgaccaccagagtcccctaaatatgagatgagcatatttagaatatcaggaattgaaaactaattaaaccatatattagcaattgagagagtaaagaagattagaggttaaaagaacctaattcacaaaattcacatacagcccttcaaaactcacatagagaaaagcactaaaagaattgtctctggctaggcatggtggctcacgtctatgatcccaacactttgggaggctgaggtggtggatcacttgagcccaggaattttctttttttctttctttctttctttttttttttttttttttttgagacaaagtctcactctgacacccaggctgaagtgcagtggcgcgatctcagatcactgcaaactgcctccagggttcaaatgattctcgtgcctcagcctcctgagtagctgggacttcaagtgcctgtcactatgcccagctaaatttttttgtatttttagtagagacggggtctcaccatgttggccaggctggtcttgaactcctgaccttaagtgatccacctgcctcagcctcccaaagtgctgggattacagacatgaaccaccacacttgtccttgagcccaggaatttaagaccagcctgggcaacatggtgaaaccctgtctctacaaaaaacaaaaaaaataccaaaaaaaaaaaaaaaaaaaaattagccaggcatggtggagtgtgcttgtagtcccagctacttgggaggctgaggtgggagagtcatctgagcctgggaagtcaaggctgcagtgagccattatcacaccactgcactccagcagcctgggtgaccagagtgaagtcttatctcaaaaaaagaagtgtctctatatggggagtggtctttatgccggtccctgctctggacccccatgacccctacagttacatcctccctggtagagaatgatgctaggatgcctttcttccctttcccaattccatcccaagcctgggtaaaaacgtcttacttttggaatcataaattatcaaagttagattatattttctaatggtacctttacaaaaacaaaggaaagatgaacagaaaagtaagtttcacaatagttaaaagtacaagtttttgctcctataattgctaactggcttaccaggtcctaacttgtcccaaatcctgttagctcccatccatggaagttccctttagagcctaggtacaacacggttaagcagcttgtcaaaaagtcatacaggtcatgagtggctgagcaaggattcagacccaggctcttgcttctgtgctcttagcaactactacccaatattggagatttgcctcttgaagtctatgtattttagtgataggaaagtgtttccaggcatcatgcataacctatttatacttgctttggcaaagtattccaacaagttttcttgtctggttttcagacgagcactttagaatgatggaagcaggtccattaacagccctgaaaaagtaacagcagccaaagaagaatacaggacataactcaaacaccatgattgcctggaaccatttatgaatcattctatagttattattgagtacatctgtgtaacagctgcattctgagcactgaagctacaacaatgaacgagacaaaatacctcatggagcatatatgtgctaatcaggaatacagataataaataaatagatacatattacatgacaggtagtgactatggttcttaagaagactgaagcaaggcaataggacagaaagtaatgggagctgcacttctacatagaatggtaagatacagtctctctgaggaagtagcatttgagcagagacccatatgaagtgaaggagccagccacatgaatatctagtaaaagagcattcagaagggaaacagctttagacattgttggaaatatatatggttaattatatatgttaaacatgtaaaggtggccactaaaaataatagagatgccatctgtagcttccatcctgaaaaaggaaataaaattcaagccaacaaaaagcaggaataaaagaggagaagacaccaaaaacataaaatagaaatttaaaaagaaatccttatagaaaatacaaaatagcgtagctggaataattccaaatgtatcagaaaccacaataaacataagtggactaaacttcattaagaaagacaaagattatcagattttttaaaagaaactaaatccaactacccttcttagccatgtcaatcaatgtcatgacaatagtatatcaaagcagtgtacttccgtggactaattgttctgcatggttatgaaaaattaatgttgaagtttttaaaatgtgatttttgattgtcattttgcttgttcttctgcttagccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaaggtaaggttggctaattgcatttcagaggtagtaggctttcatattctttgcagaatcttgcaaggtggcagcaccttatggactggtcctctgtaagccaagagcttcccagactgaggggttactggtatctctggctcaagcttcccagactcctaagggatatgtgtagagcagactttcaggacaaagtctgcacagtgacagcagacctttccctccctgaagggcagctgcaggggaaggcacagttgagtcagagttagctaagggaacttggagctggctgaattaggtgatcagcaaattgacaactgtcccatgacatcaacccctgtgtcccacacacaccgcaaatcagggacgtccgtggtcaagacagccccttgttgctctattcttcaggggacaatttctttaaaaacatgggcttggagtcaaaagatctgatcggaatatcacccgtgccaccatgtgccattggtcactttcttgaccccagcctcctcaagtctgcaaaatgggcataataacttactttattaataaaacaaggataataacctacttcgtaagattgttggggaatttaatgaaataatagaaaatataaactcatcccattgcctggaatgatgtatatatggtcagtacatcagtacatgaggtttccttcctctttgctagacatgttaaggttatttttattcatccttggtcaaggtttattctgacacctaatgcttctgagctgaatgccattcatggtcctaaactgacatatatatgttatgtatgtcatattacatatatgttatcccttccacattaaatgttgattttaccacttaattctcaaagtgtttgggaagaagggatcacccatgtttattatcttaggaatgatgtagttaaatttatatacacacactgcatagcccaaaaaatctcaagttaatttttttccccaaaaaatgttccattaaatgatgcagtgtcttagtcctttcctgctgccacaacaaaataccacagactaggtaacttataaacactagaaatttatttctcacagttctgcaggctgggaagtccaagatcaaggcaccagcagattcagtgtctggtgagcactggcgtgctctgcctcctagatggtggaaggcaaagggcaaggatgtaaacagctcccttgctgctcttttctaaggtcaccaatggcattcaggaaggctctgccctcattatttaatcacttctgaaaacctccacctctgagtcctatcatagtgacagttaagtttcagcatatgaattctgatactcacaatcactgatcaaatgcaggcatctctgctaagccctggggtataaagataagagcagattgctcccctccgggagctagcaacagacctcaattaaggatctagttttacagtgagcagggtcaggtgcctcctgaggcaagtgtgaatgcaaactccacttactgtttagcttcttttctcacacatgcccacaacatgggcatctggttacacatttgtcctctctcttcggccagttgtgtggcaaccttctgtgtgacttaccgagtgtggaaaggctgcctgctgcactgctcctctcacaggtgcctgtgatgccaccaatacaggttttttgggggtttttttgaggcagagtcacagtctgtcgttgcccaggctggaaagcagcggtgcgatctcagcttactgcaacctccgcctcctgggttcaagcaattctcctgcctcagcctcccaagtagctgtgattacaggcatctgccaccacaccccgctaatttttctatcaatacaggcttatatggttcccctctagaatgtagagattcctgaggcggtgccagactaggtccctaaactcacagcatgaagggcttttgagaattctttcttcctgttgggagaaagtgagaagataaaaccagaagttgcccagacgtgaaagggcagaaaaagccccagcagggattgagaaggtccctctactactatgccaccaccttacctgcttgcctctgagtttaatctttgaaaaaatttgcattgtaaggttttagaggcactggacttctggaactgcaagcccgccatttttttcagttgttgctttgatttgcttttggtcttttaatttacttattagaagttaaaccattttcttcatatattccataagtctaatccaattattgacctccatgggcttagctcctcatgcagtagaggcatataggcatgctgtcaacgaccccaaccccaaaaaagaactaaccaattgcgactgggtgtggtggctcacacctgtaatcccagcactttgagaggccaaggtgggcagatcacctgaggtcaggagttcaagacaagcctggccaacatggcaaaaccccgtctctacaaaaatacaaaaaaaaattagctgagtgtggtagtgtgcacctgtattctcagctactcgggaggctgaggcaggagaattgcttgagcctggcaacggaggttgcagtgagccatgatcgtgccactgcactccagcctggacgacaagagtgaaactccatctcaaaaaaaataataattaaaagaccagtttattttatttatttatttacttttttctttatttctgagacaaagtctcgctctgtcaccgaggctggagtgcagtgtggggtgatcctggctcactgcaacttccacctcccaagttcaagcgattctcgtgcgccaccacgcccggctaattttttgtatatttagtagagatggggttttgccatgttgactaggctggtctcaaactcctcagtcccccaaagtgctgtgattacaggcacgagccaacacacccggcctgctttatcttttttaaaaaagaagtgatggcttgtgtgtcatttaagctggagaattcaggaaccaaaatggtttgtgggcaccactgtcagtccttgatgcaccccctgagtggcctcagggtccctgaactgagaggagcacctgctacctgctccttcctattttaagtctaaaacggctattatcactgataaatgtgaaaaaaaaaaaggtggtgcccttccactgcttagtcatgttcttatttttgtctccattactagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacggtaagccctgagatgcacctccgctaagcatcctaaacagctttatagacacctgccctagacatgattgcatccaactcaaattccagctcagttcagaaatctatcgccctgacattatctctcagccctgactgctcagcttcatgctaggaaggagaccacacccgcttctgaggcagctcattcactcttagatcaaaggagttgctagaaaccttttctgtctggtggagcgaggtctgcctccatgagccccccttggcagtacttattctaccatcccaggctccctaaagcaaggctcatcagtcctcccaagaccaccagcagagctcaagccctgtcacataccccaaaggtctttcctccccaggcggcacatctccagccactgccgacatgtgatgggaagcaagtgtcaggaaatctgaccacggtcctcagccagtgctgcctgattcagggccccttatatgcaggaatccaggatgtcaacacagtccttcacacaccatatggatcacttctagcttggaggaaggaacgggagaaggaaagagagaaggttcccatgggcctaaacactgcatatttatgtgcagacacattgcagttgcatgttggtgaaaactgaggcccaggtgtctgcatacaaacagcaggccttcctataatttaaagatgttggtgaagggttcagcaagctcagacaatggaaggatgaaacatggcatgcggcatgcagtttgatcaaaaagaaaaacatgtctgccggacgtggtggctcacgcctgtaatcctaacactttgagaggccgaggcgggcggatcacctgaggtcaggagtttgagaccagcctggccaaaatggcaaaaccctgtctctaccaaaaatgcaaaatttagccaggtgtggtggcgcacacctgtaatcccagctacttgggaggctgaggtgggagaatcgtttgaacccaggaggcagaggctgcagtgagctgaggtcatgccactgcactccagcctaagcaataagagtgagaccctgcctcaaaaaaaaaaaaaaaagaaaagaaaacatttcaaatagcttgcaaataccagtaatcacccatgaactgacaaaatccaaacattttacaaaacaaaagggtatgagccattgaaaacctgctttcatcaaacaccattttcattttttcttaaaacacacctatcccatttaaatcccacaagttttcaatgagagcattagaaggatcttctcccattttacaaactagaacatgaaggttcagagagtgatgcactttggatgttgccctcatccagatctcacgctgaaatgtaatccccagtgctggaggtggcgcctggtgggaggtgacgggatcatgggggcccatttctcatgaatggcttatcaccatccccttggtgctgtcctcccgagagtgagtgacttcctgagagacctggcggtttaaaagtatgtggcatcttgctctctcttgcccccacttagctttccaccatgattgggagcttctagaggcttccccagaaacagataccgctatgcttcctgtacagcctgcagattcatgagctaattcatcctcttttctttataaattacccagttttagttatttgtttatttgttttttggatggagtctcactctgttgcctaggctggagtgcagtggctcgatcttggcacaacctccgcctcctgggttcaagcaattctactgcctcagcctcctgaatagctgggattacagtgcccaccaccacacccagctaatttttttatttttagtagagagtggggtttcgccatattggccaggctggtctcgaactcctgacctcaagtgatccacccacctcagcctcccaaagtgctggggttacaggtatgagccaccatgcccagccatccagttttagttatttctttatagcagtgcaaaaacagcctaaaacagagaggttaagtaacttgcccaaatgctagtaaatgaaaaggatcaaccagaacacaggctcattcatctaagcccaggttatgtttcctgtaacttactacctatagattaattccataggtaaactgaggcaccgtgtccttgtggataaaacaggaaagagtagtctgcctcatggtgtggtcagatgaatctgaaacaagttagagaactttacacggaggatgtagattagtagattctcccacagttcacaacctatgcagagcagggtcctctctcctgccccctgtggaactctccatctggggtgagtaacaaaagcattccttgaatcatgtcaccatcacccagatgtgtccttgtttaagatgctaagatgccccagtttgagacaccaggagacccaagcactgccccagaggttcattacccaaaataaaataacagggcggggcccatggatccctgtttgaatgagtctccgggcgccaaattagagaactaccgaaatattaatggaaggatggatggatgagtaggagcctggaactttctcaagacctgggatgtcaaatcccaaggagacctcacgtgtccagctgtggtgtggactgggggccgctccagccagctcactgccgtatgaccctggaatcaccaagagcagactcacatgtttgagctgaacatgctggaagtgtgggccagacggcaccgcttctgggctccggtgcatgaaacaaacaagaaccaagaactgggataaggagtgctgaaacccgcaaggacaggagctggggagatgggaggccgcctgcgggaatgaaagcacaagagaacgagggccatggggttgggggcggcacaagtgctcaggtccttccagccgcttccctcatacagatgccacttccatccctcagacgtttaaggagtgtgcactgtgagccacgcactgtgacaagcaccatgtcgtgccagcaggtgactgcacttgctgtagctccagggtcatgtgctgtgtcagggctctttgatccctgtgtccctttaaaacgacatgatcttcatgggcagtgtttgttctcttggcccctctcagagccaaatgctgtgctcgtgagggcggtgctggttggcaggggatgggcacagagaaatcaggtggccagggcagctggaggagggacctggagccgaacaaggggagctgggaccacgagcaacccaggtgacatcctggactctgtcaaagataagcaaagcaggacgctaattaaagcagtcaaaacattttattcagtaatgactggagttgggaaaagggccgagttccatttactcagaggtgttttaaagggagaacgagggccggggcaggaggatcgcttgaacccaggagttcgagaccagcctggccaaaatagtgggacccccatctctataaaatattttaaaaattagctgggcatggtgacacatgcctgtcgtcccagctacccaggaggctgaggtgggaggatcacttgagtcctggaagtcaaggctgcagtgagctgtgtttgcactactgtactccagcctggacaacagaacaagactctatctcaaaaatgaaaataaataaaaggagaatgagggagtagaaagaaagaatgcgtggggagttgagcagaatcagggaagtgaaaaaaattttaaatcagctaaggggatgggtcagtgccgtgaggccctctgtgtctgtgaaccggtgtttatcaaggctaggcttctaccctcccacagagacagggagacagaggccctgtacttcctgatgatttcaaaagaatggctcgcagatcattgagaaaaatatccctgcgttgtgggagatacatacatgtctcaaagggacagaggaaggattcaccactataagccctttttaataaatgctctccgaaagagaggtcaaggcctcgcatcaggggctgggaagaacaaatggtaagttccttaggcagccttgggtttttccagacaggaattcaagggtgtggccttggcctgctagaagctatgctggggtttggccaagtctcttagtgcaggggtttgtttgttttggctttggttttggtttttgaggcggggtttcactctgtcgcccagtttggagtgcagtggtacaatcatagctcactatcacagcctcgacctcccaggctcaagcgaccctcccacctcagcctttcaaattgctgggactacaggtgtctgccatcatacccagctaatttttaaaaaattttttttgttgtagagaaggggtctcactatgttgcccagactggtctcaaactcctgggctcaagtgatcctcccacctcggcctcccaaagtgctggggttacaggtgtgagccaccacacctggcttagtgcaggggtttggatagagttgttcacgcagagtttctgtttttctcaatatagaacgagatggtgcctgtgtttaactcaggctcaggtgtccaggggagtatcacttgctgtgtcaaggcagaagtggtatatccagacctgggaggcccattgctacactgccagtagtaggtacagtggatcagaattcttgcttgttattcttttgatgtatgtcagcaataattccagaaaccaaactttggagaagataggaaaagggtgaaactcttcaaaaacctctgggtcctccaaccagttgctgtttctgagacgtcccccaagataaacgtacaggctctgttttcagggattgtgatggttaaaatgctcttgggatcactgtgacccgacctgtgacaagaatgtaacatgcccattacccctggcagaaacggtcccctcctggatggtggccgtcatcctcatggcctcggtcttcatggtctgcctggcactcctcggctgcttcgccttgctgtggtgcgtttacaagaagacaaagtacgccttctcccctaggaattctcttccacagcacctgaaagaggtaggtaggatggagtgagatgtggatttgaaaaccttgatcggaaagagctttcctttctagttagggctgcccaattccagacaacatgttttccaggaaaacacacacgcgcgcgcgcacacacacacacacacacacacagacacgcctcttgtgtgctggtccattctcttgtaaccatgtcaggtgaaggaacagccccgaggaaaggggcgcggggttgtccagtatccctctctgcacctagggcatcgctccttctccagccttcactgcccaaagccccaggtccctgaggagcaaaggtgatggttctagggcaggaggggaaaaacagagctcagtgtggaagaaagagaaaactggaggctaaatgccaggaaatcaccagagggagagaatgggaggaaagaaaggaacatttccagttttggaatatacgagagcgattgaaattctgggtagtgtttcctggactttaggaaggctatttgtaaaagggttaggaagaagaaacaatgcacctgactaatgataacaggactgaagaagccctaagaaatgaaactctggatagtcactgacactagagaatgaaaagattccaagcccggacccaaaggaactatctttggtctcatttcccaggaagcagactctaagatagagatttgtattcaaaaggcttgatggggaacatccttgggaataataccctaaaggagtgaaggtagccagatgtggcagagagaggttgagctgtcacacagccacaacagaggcctcagccaatcccatgtggcctctcgagctggggtggccctttagagatgtcctaagctgaggcaagagggatgggcgtgtgaactccacattggccatgcgctggatgtgggctactcccaggaaggggccctaagctagggtgagaggtgagacagcagcagccaggagctaggagcacgagtgcctcattcctgaaggcaccacagcctccattacagtcacccctgggaccacttggatctactggaagcagctcctccaggatctgagttgatctcgtttcctggggagggttacaggaggaagatgagtggaatgcactccagcccccaccgctgctgctggtgtcgggaccacaaaggaatgcttgtgggctggctccttcctccgctgccctgagggcccgctctcctctcccgggaggagcctgtgctgtaggggctgctgacctgattgggtgacccagccctcatcccagaaagcactgagcctccggtccccaagcccatctcaggcaatggcctgtccctgcacttgtcaatttgctgtcaaaatcgggcaggggagtcccaggaggtgcccagtgactctggcgggtacccactgtgatacagtggtgacttctctcttgcctgccagtctcttggcctgaggaggtggcttaaagtttatcgggccttgtttcatgtcccctggtagaaatgctcccactctgggaaccttctagaccaggtgtcagcaaactttttcttaaagggccaggtaaaaaatattttagaaggccaggcacagtggcttatgcctgtaagcctagcactttgggaggctgaagtgggtggatcacctaaggtcaggagatcgagaccatcctggctaacatggtgaaaccccgtctctactaaaaatacaaaaaattagccaggcgtggtggcgggcgcctgtagtcccagctcctcgggaggctgaggcaggagaatggcgtgaacccgggaggcggagctggcagtgagccaagatcgcgccactgcactctaacctgggcaacagagcgagactccgtctcaaaaaaaaaaaatacaaaaatacaaaaattaacccggcatgctggcgcatgcctgtaatcccagctactcgggagactgaggcaggagaatcgcttgaactcgggaggtggaagttgcagtgatccctcacaccactgcactccaccctgagcaacagagcgagactccatctcaaaatttaaaaaattttaaaatttatatatatatatttgaggttctgttggcaagaaataaaaatcaaaattatgtagtcacttatataaccacttaaatataatcatttaaaaatccgaaagccatgtgaaaaaacaagtggtaggccggatctgccccgtgggcctttgtttgctggccctgccctagacccacagagcctcaaatcacaaggccagggagcagcggtttccccagtaggtcactgggcatgatgagggtgaacagggccactcctgccctgcgcttgcttcctgacgcaggtgttccacctgctggggacacagccccacatgattgttggtcttgggtgcatgccaggggctggaggacaatgccttgccctcaccaggtgtcatctccaagctggcgcctcccctgcactttcaacaggccgctccgtccttcttccagtctggcagctgctgggtggtgcagggtgggatacgaccaggggggtcccgccttcactgtcagtgggcccattggtctggcaccatgtgatacggcgtctctactagtttgtcggggctgctgtagcaaagtagcactcgttgcgcagctgtaacaacgggaattgattctctcacggttctcgaggccagacgtccaaaatcaaggtgtcactaggatggtttccttggaggctgtgagggaggatctgtcccaggcctctaccctaacttctgagggttgctggcgatctttggcgttccttggcttctagaggcatcacccagtctctgccttgatcttcacaagccttctccctatgtgagtgtctgtgtccacattgcccctcctttatacagacaccagtcacgggaggagggctcaccctgctccactataccctcattctaacttaactgatcccctctgcagcaaccctatctccaaatacagtcacattctgaggtagagggattaggacatatgaatttcttttttttttggagacggagtctcactctgtcacccaggctggagtggagtggcatgatttcggctcagtgcaagctccgcctcctgggttcaagtgattctcctgcctcagcctcccaagtagctgggattacaggtgccctccaccacgcccggctaatttttgtgtttttagtagagacagggtttccccatgttggccaggctggtctcaaactcctgacctcaagtgatctgcccgccctggcctcccaaagtgctgggattacaggcgtgagccacagcgcctggcccagaacatgaattttgtaggaacagaattcaacacctaacaggatcctctaccaggagagaaaacacctgtgaaaccttgggaatcctgacaggccctgcaggacacgaacagcaaatcactcctaaactaaaggttagctccagccaggatgcaccactgccccttccagagtggtgcaagagtcgacgtcatcagcttgctaccaggtggctggtcagtctcctcggggaatgccgtcatatcaggggctcagcattgatctctgtcgcaggcaggttggacattccacagcagtggtggctacccagccgtgggagtgggagccccttctttcaggcccacgcgcagcctccatccctgccaccacggctgctgtgttcatgagccctgtgccatgtacaggtgaccagtggcagaggctggctgacatccactggctgtgtcatcatgtctccctggctgtctgctgtctatgatacatgctctcagtgggagttaatatgggatgcagaaatctccacgctccagctactccctcaggtccatccttcttcccaaacgtccttgtccctaaccttccagtcttccttccccagggcccctgaccaccaggcttgtcactaacccctgcctgggatcccacagctggcctgatcttgggctgcttttctttccacataaaggtgatgatcagacccacggcccaaagctctgcccgtggggacactttctccctggttggggctgaagtgcagcagcgggccactttcggtgtgtgcccacataccatgctaaccttgccatgaaaccaggccggcctttcctcctacttctgctaggcataattacccatccccctttatggtcatcatgtgagcagacacagacacggtgcgacaggggtagaggggacaggagtccgagccacctgcatgtggccaacatgcaccctctgaccccatctcaggacctactgggtctcaggcctcatgatggtcacttctgggcagcaccatcacctcgcgtccctcgtcagaagctctgtctctgccgggaccccatagcgtcccaggagctgctttttcaaacagagtacaattatctgctgcagatggccccgcctgaccccagaactctcgtatctatgttgtgactttcctcttgggatttgccataaactccacccagcatcttttcccaccccagacacttcaaggatatgcgaagtcacacattccccaggttggattcacaggccgtccctggtgggtaatgtaccagtcctgaggtgtgcatagggctgcaggctgcacggcccataccttctgcagggccctttcctgcctggggcccctccgtgccagcagcctcctgtgtggtttgataaacatattggaacagtcagtattcctaggcgtggaacatgctgcctccagaaccctgaggcctccacagcacaatgcttccttcctagtggtgggaggggcaagatacaataattggtcctttaaagaggatgtcctggcatgccccactgcaagggtcccctcaaatatcacagatgtggcaggtccctgaatctctacagggtgagtttctcaccctctgcagtgtgtgtgcctcaccaatgccttgccacttcttggcgtgtctggtcctattaatgtattgttgtgatagctaatatcaggcccttgtccccgcaccaccagtcagctgatgcaggctgcctctggcaagggcacagagccttgaccgaggcaactgccttctgggaagggcacagcctagaaagggactcagctgtgagccatttcagcctccgatattcctggaggctgggggaacaagcgcctcctccacaaaagggatctgggcaacatagcactgcatctaccctcgatggcaagtggggcacaggaccataggcaagtgtttcagagcgactagaaccccctacagagagtgccaggccgagcatggtggctcacacctataatcccagcactttgggaagccaaggctggcagatcacttgaggtctgaagttcgagaccagcctggccaacatggtgaaaccctgtctctactaaaaatacaaaaattagccacgcctgtaatcccagctactcaggaggctgaggcacaagaatctcttgaacccgggaggctgaggttgcagtgagcagagatcgcgccaccgcactccagcctgggcgacagagtgagactcgatctcaaaaaaaaaaaaaaagtaccaaggagactgcagcaccagcatgaactaagaatcctctatgagcttttgagaagccacagctgcagcaggaagaacaaagaatgagggtgggccctttgcttgggtaaaaggtgttgtgttaactgagaaccaaaaggaaacaaaattattcacctgctatttttgcttctggcttcaccatcagagaaactggtcagacaggaaagaacagacggaatgaacggtagaggggcctgctggcataagctctcacctccgaggctagaagactttgcagacttgaccgtggagccagcccctgtaagatctgagaaatcagagatgggagtggagggtgctggagaagggccaggcaactacggagcagttcgaggtcctcacatcacgactttctccagcttgactcataatgatagaatccattaaccaggatccagaggatcatttcgagttcagggagatttgctaggaatggagactttgagttaaaaaagcactagggaggttcatcctacactgatctattgagccagccaccagtttgtgtgtgtgtgtgtgtgtgcgtgtgtgtgtgtgtgtgtccaaccgggagactcagctgatactgcttccttgagatttaatacaccttcctttgatctctcctgtccccattatcccaggaaaatccagagtagcttccagtccattctcattaatccactggatccaaagtttagagaggttccccttccctccagcctccttcctggcccaacagaggagcaccccaccaccctccatcagctgctcaaaacccacaagggaaaaatccctacaggtccatgccaggaggtagtggagctaccctcaggttccattaagtcataccagaaggctgagtgtagaaatgacattaagaggggttccatctgtagggaaagggttcaagatgcaaagctttacagaaggttctccgtctaattgtgaagattaagagcactggtggacctaggaagatgaagaatggagagtgggaaaccagcagagatttcaggaaatgtataggggcatcttcatcgttcaaagcaccggagagacaaagattattagactgtggtccctgcccttaaggagccctggctacaggtgacacaaactgagaagagttggtgtctattaaaagtgagaaggcagctctgtctgatagagcatattgcaagccatgtgtgttttagatttgctagtagccacatttttaaaaagtccaaagattgggccgggtgcggtggctcacgcctgtaatcccagcattttgggaggccaaggtgggcagatcacgaggtcaggagatcgagaccatcctagctaacgctgtgaaaccctgtctctactaaaaatattagccaggcaaggtggtgggcgcctatagtcccagctactcgggaggctgaggcaggggagtggcgtgaacccgagaggtggaggttccagtgagctgagatcgcaccactgcactccagcctgggtgacagagcaagactccgtctgaaaaaaaaaaaaaaaaaaaaagtccaaagattggccgggcatggtggctcacacctgtaatcctgacactttgggaggctgagacaggttgatcacctgagatcaggagttcaagaccagcctggccagcgtggtgaaaccccatctctactaaaaatacaaaaattagccaggcatggtggcgggcacctgtagtcccagctactcaggaggctgagggaggagaatctctggaacctgggaggcaaaggttgcagtgagccaaaactgtgccactgcactccagcccagacgacagagcgagactccatctcaaaaaaaaaaaaaaaaaaatcttcgtttgtatagcagtgagtatccccacttgtaaaaaaataaaataaaaataaataataaatcaaaagatgccagaggccgtggctcacgcctgtaatcccagcactttgggaggccaaggtgggtggatcagctgaggtcaggagttcaagaccagcctggccaacatggtgaaatcccatctgtactaaaaatacaaaaattagctggcgtggtagcacatgcctgtaatctcagctacttgggaggctgaggcaggagaattgcttgaacctgagaggtggaggttgcagtgagctgagatcgtgccactgcactccagcctgggtgacagagcaagactctgtctcaaaaaaataaaataaacattaaaaataaataaataaaataaaatagattttccagccaggagttctgtgaaaaaatctttgtaaacccagaaaaagaaatggagaaaattgatcattaactgtcctctttccctccacagtttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggctctgagaaggaaacacactcggctgggcacagtgacgtactccatctcacatctgcctcagtgagggatcagggcagcaaacaagggccaagaccatctgagccagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaataccagcaccttagaggtcgaggcaggcggatcacttgaggtcaggagttcaagaccagcctggccaatatggtgaaacccagtctctactaaaaatacaaaaattagctaggcatgatggcgcatgcctataatcccagctactcgagtgcctgaggcaggagaattgcatgaacccgggaggaggaggaggaggttgcagtgagccgagatagcggcactgcactccagcctgggtgacaaagtgagactccatctcaaaaaaaaaaaaaaaaaaaattgtgagaaacagaaatacttaaaatgaggaataagaatggagatgttacatctggtagatgtaacattctaccagattatggatggactgatctgaaaatcgacctcaactcaagggtggtcagctcaatgctacacagagcacggacttttggattctttgcagtactttgaatttatttttctacctatatatgttttatatgctgctggtgctccattaaagttttactctgtgttgcactatatgtgttcatgata

SEQ ID NO: 105 - DNA, 35645 bp, Homo sapiens
ccaggcacgtgcacagtgagtttgtgtaaatccagttagaccaaaatgagcgaggtggagagcctcttaaccggatgctacgggtgatgactgggaggaggagaaaaattacctctttatcttgcatgaacatcttaattttcaggtattgggcgtcaggcaaagataattaaagctatgtccatgagtcttatcccttgaggccttgtccgcttgatattttctttgcctaactcacttttaaaattttattatttttatttttttgagacagtgtcttggtccgtcgcccaggctggtgtgcagtggcgcgatctcggcttactgcaacctccgccccccgggttcaagagattctcctgcctcagcctcccgagtagctgggattacaagcatgtgccaccaagcccggctaatttttgtattttttagtagagacggggtttcaccaggttgaccaggcaggtctcgaactcctgacttaaagtgatccacccacctcagcctcccaaagtgctgggagtacaggtgggagccaccgtgcccagccctaactcacttctgaagttgctgctacttgcactgatttcagtttttttttgtttttgttttttgttttcaaggtggagtcttgctctgtggcccaggctggagtgcagtggtggtgcgatcttggctcactgcaacttccgcctcttgggttcaagtgattctcctgcctcagtttcctgagtagctgggattacaggcaggagccaccatgcccggctaaaatttttttgtatttttggtagagacggggtttcaacatgctggccaggctggtctcgaactgctgacctcaagtgatcttcccgcctcaggctcccaaagtgctgggattacagacatgagccaccacacccggcccacgatttcagtaatttctttgtgttcagtaaaactaaaaaatgactctgggctgggtgcggtggcctgtaattgcagtgatttgggaggccgaggcgggtggatcacctgagctcaggagttcgagaccagcctggccaacatggtgaaacccccgtctctactaaaaatacaaaaattagccgggcgtggtggcaggcgcttgtaatcccagctattcgggaggttaaggcaggagaatcgcttgaacccgggagaagggggttgcagtgagccgagatcacgtcattgcactccagcctgggcgacgagcaaaactcggtctcaaaaaaagaaaaatcattctgtcattctggccgctgtttgaagaatgcgaataatgcaacagggagatcagatacaagactggtaaccgaggtgtcagagttgagactcagtttcgcagattgcattggcaagtgaccaagtgggtggtgccacggttgacaaccctatttcttacatcactgagtggatgtacaaggattaaaccacactggggaagaaaagtgctcaaccctgaggcaccctcacacacctcggctcttgtgaacactagtgttcctgccgaagcacgcctacttaccccgctgagcagagcctgagcctgcaacctccagagacctggggaaagccacatactccgcttcccgcccccggcaagggcgtgtcagctacaaggggcgtgtcatctctaggccccgccccgcgctgcgtgcccacgttgcgccggcctcgcgccagtccgctgggctgcagggactgcggcgcctgagggagtcgctgacgggcacgctgactggaggctggcggacaggcgacagcgacctgcggcaggtgagctgtccgcgccctcccggggccttccttccgcccggcttctcggaccgcgctgcgtccttcgcgggccctgcctcggtccaggccttcggacctgggcttggccgggccacagccctttgggtcccctgcgccggtctgaggggagacccggccgggggcggccggaagctgggtgaggccgggcagaaggacgaagaagggcgtggaggggctgtcaggggagggcgaaaccgcggacgccgctctccagaagtcgtctccccgggggcgcggggaggcctgaatggctctctttggcgtccccgttgggcccaccctctcccagcgtcacggctatgctgggcgaggtgacccccggggtcgtagctgggggcgtcggcggtgcagacaggggatgccggcagagattggagcccggcttggctgtttcccgggctgttggcattgaccggggctctgcccttcctctaatgcccttatctctataggaagtgccccttgagtgggtgtcgtgacttcacgagtgaaccctggtacgccctggagcagagtcggactgggagggatcaagtgtgggggcagccggttagtccggacgcgggtttacctattactttctgagcgcagtgctctgggtggattaattgccctgcaaaagctgccgggacctccttgcagtctttgcacgaggcctgcctgtgtcatgccatttaaatcgcgtctgggccgggtcggtggctcacgcctgtaattccagcactttgggaggccagggcgggcggattgcttgaggtcaggagtccgagaccagcctggccaacatagtgaaaccccgtctctactaaaaatacaaaaatcagccgggcatggtaacgtgagcctgtagctccagctacttaggaggctgaggcaggagaatcgcttgaacccgggaggcagaggttgcagtgagccgagatcacgccattgcactccagcctgggcgacagagcaagactccatctaaaaaaaaaaaaaaaaaaaaaaaaaatcgcttctgatgagccggttgtcgtggcctgtggctgtccatccttacgtactgtgttttgttgatggcgctacaaaccagacaaggtggagtgtgattgaagaaagaaacgctggccggtgcagtggctcactcctgtaatcccagcactttgggaggccgaggcaggcggatcacctgaggtcaggagttcgagatcagcctggccaacatggtgaaaccccgtctctactaaaaatacaaaaaagttaaacgggcggggtggcgcgtgtctgtaatcccagctactggggagtttgaggttggaggatcacttgagcccacgaagtggagattgcagtgagctgagatcgcatcactgcactccagcctgggtgacagagtgagaccctgtctcaaaaaagaaaaaaataaattatcacaagacaaaatttgtgcttatcaggagttcacagttaagacatatataagcttacttggtgaaattagaaaaagttatcagataaaacattcaggtttaaacactggtgagggtgtgggaatttgtggagccttggaaacacactcattgaatgacctcatctacctggggatgtgaagagggaaatcctgtgattcctccattgtctgacttgatttccttttttccttggctgtggcaacatgttgaagtgctgtgagtcaccaaaagggggaacgtgagcaactctagaaatgccagtgccagtgagttacagacaataaagcattgaccgcctttagctcacccctcatcaagtctgttgaaaacttgtaaaattggacagctagagctaccttgattttttggtttccttttaacagctgactctcttcacaggacagttgggctctacatcaggattgcacccaaaactggaatatcactcctccaggaggaagatatatttgaaaattagaattgtgggcccggtgcagtggctcatgcttgtgatcccagcactttgggaggccgagatgggcggatcacctgaggtcgggagatagagaccagcctgaccaacatggaaaaaccccatctctactaagaaaaaaataataataatacaaaaattagctgggcatggtggtgtgtgcctgtaatccgagctacttgggaggccgaggcaggagaatcacttgaacctgggaggcagaggttgcgatgagccaagattgtgccactgcattccagcctgggcaacaggagcaaaactgcatctcaaaaaaaaaaaaaagaaagaaagaaaattagaattgtgtatttcactgtaaaatttgaaattcagctttaactccttggaaaggaaagagatgaaaaacttgacctagactgggtgcggtggctcacgcctgtaatcccagcactttgggagaccaaggcgggtggatcacctgaggtcaggagttcgagaccagcctggctaacattgtgaaaccccgtctctactaaaaatacaaaaattagccttgcaaaaagtagcctgtaatcccagctactcgggaggctgagcaaggagaattgcttgaacctgggaggcagaggtttcagtgagccaagatcatgccattgcactccagcctgggcgacaagagcaaaacttcatctcaaagaaaaaaaaattctatcagagtgaacaataagtaggatgctagcacatacctgtaatctcagctacttgggaggctgaggcaggaagttaatacttgatgagcctaagtttttggtgtctttggatgctgcttgtcgatctaaggggtttccaaacgcttcttttttggtaaaattgggattatgactaggaatctgttttttggagtttcccaggtgatccttgtttggggtccttgtctaaggcacaggctggaaagaggagggagtggactggcagggaagatagagcagtaagcgaatagaatacctggggaaagggacgccagaagagtgattgttgtctggtgaactgtgctgtcagtgtgtatgtcagaagccaacaaagtggatattctcttcactcagcttagggaaaaaattaatttttgtttcacagatagattcgtttccttcccaggagtattataggcctaattactgtcatagttctcagtaactttaaaaaggctgtggggaagaatggcataacagactagtatcttgtacccagcctgcctttttcttattctattttttttttttttttttttttttttttttttgagacagtcttgctctgtcacccaggctggagtgtggtggcacaatctcagctcactgcaacctccgcctcctgggttcaagcgattctccagcctcagtctcctgagtagctgggattacaggcgtatgccaccatgcctggctaatttttgtatttttagtagagatgaggtttcactatgttggccgggctggtctcctactcctgacctcaggtgatccgtccaccttggcctcccaaagtgctggggttataggcatgagtcgctgcgcccggcttttttattttttattttttatttttttgaaacagagtctggctctttcacccaggctggagtacagtgatctgatctgagctcactgcaatctctgcctctggggttcaagcagttctcctgcctcagccttccaagtaactgggactacaggcatgcaccaccatgcctggctaatttttgtacttttggtagagatggggtttcgccatgttggccacgctggtctccagctcctgacctcaagcgaaccaccctccttggcctcccaaagtgctagtattacaggcgtgagccacagcacccggccttttttttttttttttccttagagtcttgctctgtcaccagggctggagtgcagtggcgccgtctcggctcactgcaacctctgcctcctgggttcaagtgattctccttcctcagcctccctagtagctgggattacaggtgtgtgccaccacacccagttaatttttgtatttttagtagagacggggtttcaccatgctggccaggctggtctcaaactcctgacctcaagtggtccacccactttggcctcccaattagaattagaggtggagcgaccgtgcccggctaagggcctactattttttttttttttttttgagacagagtttcactcttgtcacccaggctggagtgcagtggtgtgaccttggttcactgcaacttccacctcccaggtttaagcgattctcctgcctcagcctctggagaagctgggattataggcgtctgccaccacgcctggctaattttttgtatttttagtagagacggggtttcaccatgttagtcaggctggtctcaaacttctgatgtcaggtgatccacctacctcggcctcccaaagcattgggattacaggcgtgagccaccgcgcccggccaggcctcgtatttttgcttttgctcatgttttcatgtctgagatagagggcctactattaaagcactgtgctgaggctgcaagaaggtactagtgtgattaaaacaatctggtccgggcgcggtggctcgcacctgtaatcccagcactttgggaggcggaggcgggcggatcacgaggtcaggagatcgagaccatgctggctaacacggtgaaaccccgtctctactaaaaaatacaaaaaaaattagccgggcatggtggcgggcgcctgtagtcccggctactcgggaggctgaggcaggagaatggcgggaacccgggaggcggagcttgcagtaagcagagatcgcgccactgcgctccagcctgggagacagagcgagactccgtctcaaaaaaaaaaaaaaaaagaaaaaaataaaacaatctggcattataatgccatcctgattttagttaatctagttgactggctggcctcataagtagctgtgatgatcataatttttatgcgaaacacctgtcattgagcatacaggtgtactgaaagaattgggtggaacagggtatttgaaatcagaattgttctggaaagtcgggtacataaagctctatctttagcacagttgtctgtattgcacaattaatatttatagaatggtacaccttatgttatctttttatttttccacctaactctctctctagattgaaaggtacttgacgtgcagagcaagatcttatctttctttgtagtcacagtactcaagagggtgataaatgtttgttgatgataatgtaatgtcacctgtccaagtgtagccatcatcttcagtagttacttgatctgctgttgtgtctggcaagactgctatgtgctgctgcagaggagccattgtcaccttgaactatctctgtggcagtctggaggagggcaggagggagaagggaaggaataaatgagcaaagctgagtgtggatagtagtgtttgacggcagatgaaaaagcaaacttggtgaagtgtggcctgggtggtcatctaacttctacctagaagacattaaacctttactctcttctttttatgtaggaaggcagagggaaagtcaggccttcggttggcttggtaatagcaggtatcccagtaattagaaaataacttaaaaaactccattcctctaccatatacttgagaatttgtcaatctcagcaaaattttcaaatgtctgtgttcagtgtcatatttgtcctgctctgtaagactttttgtgtttataaaaaggcaagtggacccagaaggggaaaaatatgctgttctgagaaactagctgctgtaggttatgcttttctgtctttgcttgtggctcttctggttatttgagaaaggcaaaaaaacccaaagtcttttttctactctgttcccacagtcactcaacacaacacttctgataccagatatatgggagttgtttccccatacaccaagcaattctctagtagacacaccggtgcggtgtcctctaagtcagttaaattctgatactctatctggagatagcgtcagatcccaccaattgagggctcagtcccacaaaactgtcccaacttgaggcactagtcacaagtagtaaattgtcacctatacttctgacctactagctataaatcgaaagttctgacaatccctcctcgagtttgattaatctgctagagtgggtcacagaactcaggaaaacactttacttacatttaccaatttactctaaaggatattaagaaggatacagatggctgggcgtgctggttcatgcctgtaatcccagcactttgggaggccaaggagggcagatcacctgaggtcaggagtttgagaccagcctgaccaatgtggtgaaaccccatttctagtaaaaatacaaaaaaattagccgggtgtggtcgtgcatgcctgtagtcccagccactagggaggctgaggcaggaaaatcgcttggaccctgggggcagatgttgcagtgaaatgagatcacgccaccgcactccatccagcctgggcgacagactggaagaaaaaaaaaggatacagatgaatagccagatggaagagatgtatagggtgaggcatgtaggaagaggcatgaagcttctacgccctctctggaactttcgtgtattcagctatcctgaagctaatgcaaaccctggtgtgtgtgtgtgtgtgtgtgtgtgtgtgtgtgtgtgtgtgtgtgtgtgtgtgtgtgtgtgtgtttatggaggcttcattacaaaggcataattgaatacgttattggccactggtgatcaactcaacctttagaccttctcccgtcccctgaggttaagggggtagggctgaaagttcccaccctctaatcacatggttggttccccaggcaatcagcccccatctaggagcccaccaagagttacttacttacaacaaaagatgctcctattacccaggaaattccaagggatttaggaaattacaaaagttttaggagctctgtgtcaggaactgaggttaaagaccaatatcagaatgaaggattctcctagtgcccccatctacaaaggttttaggagctctgtgccaggaacctagggtgcagatcaaatatatctataaatctttttgtttgtttgtgttttgagacagagtcttgctgcgacacccaggctggagtgcaatggcgctatctcggctcactgcaacctccgcttcccggattcaagcgattctcctgcctcagcctcccgagtaggtgggactacaggtgtgcgccactatacctggttaatttttgtatttttagtagagacggggtttcaccatattaaccaggctggtcttgaactcctgacctcaagtgatctgcccacctcagcctcctgaagtgctgggattacaggcatgagccgctgcatccagcctcaaatttatctctgtatcttcttctaaattacagtatcacacccgtgcatatgcccaaaaatttttttttttttttttttgagacggagtcttgctctgtcgcccaggctggagtgcagtggtgcgatctcggctcactgcaggctccgcctcccaggttcacgccattctcctgcctcagcctcccgagtagctgggactacaggctcccgccaccatgcccggctaattttttgtatttttagtagagacggggtttcaccgtgttagccaagatggtctcaatctcctgacctcatgatccacccaccttggcctcccaaagtgctgggattacaggcgtgagccactgcacccggcctcatatgcccaaattttaaaggaggcaccacattcaagtccaaatgcctaaaggtagaaggatcaagaaacagtagtatgaggccatttgagaagtatatatagttatccctcagtatctgtggagattagttccaggacccctcaagggtaccaagatccaggatgctcaagtttcttttcttttcttttttttttttttttttgagacggagtcttgcactgtcacccaggctggagtgcagtggtacgatttcggctcactgcaatctccacctcccgggttcaaatgattctcctgcctcagcctcccgagtagctgggattacaggtgtgcaccaccacgcctggctgatttttgtatttttagtagaggtgaggtttcaccatattggccaggctggtctcgaactcctgacttcaggtgagccgcctgccgcgggctcccaaagtgctggtattacaggcatgagccactgtgcccagcttaagtttcttatataaaatggtgtatagaatttgcatataacctatgcatatcttctgtattctttaaatcatctgtatttataatacccaatacagtgctatgtaaatagttgttatactgtatcgtttaggtaatcatgacaagaaaaaaaatctgtacatgtgtagtacatatgtagccatctgttgttttttttttccctgaagattgattggttgattgagacggcatctcactctgtcaccgaggctggagtgcagtggcgcagtcttggctcactgcaacctccacctcctgggttcaagcgattctcttgccttagcctcccgagtagctgggattacaggtgcctgccacaacccccggctaatttttatatttttagcagattccgggtttcaccatgttggccaggctgatctcgaactcctgaccttaagtgattcacccacctccacgtcccaaagtgctatgattacaggggtgagccaccatgtcaggcctttttctgaatatttttaatctgaggttggttgaatccactgatgcagagcccatggatatggagggctgactgtactgtattgagcttctaaggtatgcagagtattggcactgaggggatgtgcaaatacaacaacaaaccaagcatagtctttgtttactaggagctggtagtaactgtgggaagacacaaaacagtaaaatcactttgtaaggtttatgagagttttgagaggccagggaagttaaagagtggagaaatggagaaaatgggagaacttgtactgaacccattaggacagaggaggaagggaagagaaggaaggaggccaaagaaagaagaaacccttcttagagcactcagggtcttactgaaaactttacccataaaaagagaatgtcactgatagactccttttagaacagggattgatttttttgtttttgtttttgtttttatttttgtttttgtttttgagagaagtctcgctcttgtcccccaggcttgagtgcaatggcttgatctcggctcactgcaacctctgcctcccgggttcaaacaattctcctacctctgcctcccaggtagctgggattaaggcacctgccaccacgcccggctaatttttgcatttttagtagagacaaggtttcaccatgttggccaggctggtctcgaactcctgacctcaggtgatccacccacctcagcctcccaaagtgctgggattacaggcttgagccaccatgcctggccacaggcaacatttttaaaccatacgattgtcctggagagagaatctgaagccttgctctgattctgaaagggatttgcaaccaaaaaaggataaggattgttctgacaagtaccctttcttcccatcttcaaaagtacacatctcttaatttgtgtcttcaaacacaaattgtgttcaaaaaaggaagtatttgagtagattaaagacagaaaccctaggacattcctttgtaaacaaacagccttttaccaaacaccaactgtcaagggacttgcctgagtacttgtccaaaggacagcgtgtccccatgtgtaggcagtggtctaatctggttcctaggagaggactgctgaggccacagcaacttaactggctagtgtgggtgaggcagaagtgtttgaagctcaaggtctgtcaaggacagctgattagagtatgtctgtccctaatacagggttagagctcagtaccaatgctggggatgaggtgagttgaagacacagaaactacatggttttttggaaggtcacgaacttttcaaggaactagtgggcaactggaaatgatatgtgaaagagtagagggagctctggcctagctgccagaaaactctgggcaggtcaggtctgggaacagtggctaatccaggcccagcttcccactgttgatttggacatacaggcctaagataagagaccgtgcccagagccactggtcacttagcacaggtagtgggaaatggtagccagcaaatgtttaattgaatatcttatgtctcctagaccacagctgagcaaactaggccaagctcaaggtcctgaggggaatgaggagctgagctcagtcccttttggccccctttctctttccctcctcattttaagtatggaagctcacttatttcctttttgtattggccatttgtgtagggttttgtttgaaaaagggcttgaggctgggcgtggtggcccacgcctgtaatcccagtactttgggaggccaaagaaagattgcttgagcccaggagttcgagaccaacctgggcaacatagtgagaccctgtctctacaaaaaaatttttaaaattagctagacatggtagtgaatgcctgtagtctcagctgctcgagaggctaagttggaagtatcacctgagcccaggagttgaggctgcagtgagctctgattgacccagtgcacttcagcttgagcaacacagcaagaccctgtctcaaaaaaaaaaaagaagttgggcacagtggctcaggcctgtaatcccagcactttgggaagcctaggtgggcggatcacctgagatcaggagtttgagaccagcctgacctctaaaactacaaaattagccaggcgtagcccagcggctcatacctgtaatcccggcactttgggaggccgaggcgggcggatcacctgaggttgggagtttgagaccagcctgaccaacatggagaaaccccatgtctactaaaaatataaaattgctgggcgcagtggctcacacctgtaatcccagcacgttgggaggccgaggcgggtggatcacaaggtcaggagatcgagaccatcctgtgaatggcgaaaccccgtctccactaaaaatacaaaaaattagctgggcgtggtggctggcgcctgtagtcccagctccttgggaggctgaggtgggagaatggcgtgaacccgggaggcggaggttgcagtgagctgagaacaccagcctgggagacagagcgagactccgtctcaaaaaaaaaaaaaattagccgggcgcggtggcatatgcctgtaatcccagctactcgggaggcagaggcaggagaactgcttgaacccgggaggcggaggttgcggcgaggggagatcacgccattgcatgccagccttggcaacaagagcgaaactctgtctcaaaaaaaaaaaaaaaaaaaaatgtagccgggtgtggttttgcatgcctgtaatcctagctactcaggaggctgaggcaggagaatcacttgaacccgggaggcagaggttgcagtgagctcagaccgtgccattgcactccattgtttcgctgcaacgagagggaaactccatctcaaaaaaaaaaaaaaaaaaaacaggcttgagtatacctctcacagccctggagaatgcctgagctgttggacagttgccttttccattatgtctgcttttttctaaagctattcattcattgttgcctaatcatgtcctcagtcagtagttgatgttctgggctatttgaatttcctctgaataatgattaatggagataatgatgtttgaccagttctgggaactcttgggaattaaaggaattaaactcttggacattaaacttcactttaatgtgtatagttgtgggtgctgccccattggagaagattgtgacaggaagttacacagttttacagcaaactgctgggattttttatttttttttcagtaaattatgataactgtagcattttcctttgcaataatgataacctaaggccttggtgtttcctctaaaatgtacatagatacaggatgtgggtttgttacaaagttgtataactattgcctttttgtggctgaccccttccctagagaacaacatgaagagaccttgctgctgctatgaaacccagactctaaggacaacttgggggacattggatattttttcacagatgtagacatcaaggagtcagtggtttgtgtatgcgttgagtggagaaggctggcaagcatttgctaccatgactgttaaaaatgtgcctgtacatttctttttttttttttttttgagacaggatctcactctgtcacccaggctggagtgcagtggtgtgtttttggctcagtacaacctccaccattgtgggctcaagcaatcctcctgcctaggactcctgagtagctgggatgacaggcatgtgccaccacgcccagctaatttttgtagtttttttgtagagacagggtttttgccttgttgcccaggctggtatacatttctttatataaggagggggcaagtaacacagtgttatgctaccaatcaggctttcagagaccataaaacaaaatctaaaaggtacgctcttagtagtcatatctgtggaatgtaaggaagccagtttaagaccaatgtaatgcagcattttcccttcacacatgaaacagtgagttactcgagcacaaagcatcaaatgcttattccccccacaaggccattcttatctttcaccaagtgtttagtcactaggcagccatcatcctccctccctctctcccttcctcccttactttcttcctttcttccttttgcagtggcacagtcatgggctcaagtgatccgcctcagcctcgcgagtagctgggaccacaagcactcaccaccacatccagctagttttattttatttttaaaaattttttgaaacagagtcctgctgtgtcacataggctggagtgcagtggcacggtcttggctcactgcagccgccacccccagggtcaagtgatactcctacctcagcctcccaggtagctgggactacaggcatgtgccaccatgcttggctaagttttgtattttttgtagagatggggtttcaccatgttgcccaggctggtctggaactcctgtactcaagctatccacctgccttggcctcccaaggcgctgggattacaggtgtgagccattgcgccgagcctcatccagctaattttataatttttggggggaggtagcaacagagatctccatatgttacccaggctggtctgaaactcctggcctcagtgatcctcctgcctcagcctcccaaagtgttgggattacaggcgtgagccaccgcgcccagcccattattcttatatctgagattcacctttaattgccctctgtcatcagcactttgagaatgcctcaattttgagaataccttgtattctggaaatcattcattcagtcaacaaaccctgactggtgtgtaattgggcagtaggaggccaagataaatgacctgtaatctggaaaacaaacatataaacatacacataccataacgagatatgagtgctaggatggatcacaaaaggcttacttaggtagctctgaatataatatcaggcctacaatattatcacttatgttgttttttggatcttatttttagaaacagcacaagctttttcttggaggaaatatagcaaggaagaggggagctgttctgactgaagcagggtatgggaggcccacagcctttcctgctttgcctcctgttcaaagccatcctccctgcagttcactgagaaatgactccttggagctccaaggaagtcctacagctagctagtagcagacctggtagtagaagttagttcttctgattcttagctttcttagcagtcaggtaccagactgataaacgaaaatcaaatttctcccagttatatgttccatcccacaaagaagtaataaacacatttctgtcaggggcttcagcctgcctggatttgttactgggtttgttttaaatgtttagcttccaggcatccaaatacatacaaaaaaggtctattcccaggaacatactgtaacccttttcattgtcatttgtgggcagtgccaagctgcctctaatagcttcttctgtttttttggtggaaattcagtttcctcagaaatctatataagggatatttgataaaggtgactaacaatctcgtctctgtaaattgatgaagggatgagaggggtattagactcatgtcctcttttgaatgcacactgcttttgtggtccggcagggtttctcagcgttagtgctgttgacattttgggctagattgtttgtggtggtggggtatgtgtgtgtgtgtgtgcgtgcgtgcaagcacatttgtgcgctataggacattgagtagtatccctgacctctacccactattgtcagtagcacactcccgtctttcagttgtgacaactaaatatgtctgcaaacatttccacgtctccaaacatgttccttgggggacaagttggcccccagtggagaaacactggattggagattggttgtcatgtgataaaaatgcaaatcagatttgtcacaggacaaagtaaattttcagttacctaattaaacctttactttttataagtcgctctaaagaaacaaaagtgtgtcctgtcttccatcctgattctcggttactggagggcccttcacctaagtcatgttcaggatctccttgaaggagttaaactaaaacaatacaatatcttcccttaggtcttttgcagaatttattttgctaggccgggcactatggcccactcctgtaatcctggcactttgggaggccaaggcggctggatcacttgagttcaggagttcaacactcgcctgggcaacatggtgaaaccccatctctacaaaaaataccaaaaaattagctgggcatggtgttgcatgcctgtagtcccaggtacttggggggctgaggtgggaggatcacttgagctcaggaggtcaaggctgcagtgggccgagattatgccactgcgctccagcctgggtgacaaagtgagactctgtctcaaaaaatatatatattttgctagaaatcccaagatttttctctcttttctttttgtttattttctttctttttttgagatggaatctcactctgtcactcaggctggagtgctgtggcatgatctcggctcactgcaacctccacctcccaggttctgagaagctaggactataggcgcatgccatcacatctggctagtttttgtatttttagtagacgcagggttttaccatatttgccaggctggtctcgagctcctgaccttgtgattcacctgccttggcctcccaaagtactgagattacaggtgtgagccactgtgcctaacccccatatactttcaaacaaaaaatggaaatatcactgtctccatgaaaagccatacaggcagcatcaaaactacactaggggccaggtgtggtgcctcctgactgtaatcccaacaatgggagggtgataggattccttgaggctaggagttcgagaccagcctgggcaatatagtgagaccctatgtctacaaaatactttttaaaattagcatagtggtgcgcacatgtagtcctagctacttggaaggatgaattgggaggatcgcctgatcccaggaggtagagactgcagtgagctaatatctcaccactgcactccagacacagtaaaaccctgtctctaaaaaaaaaaaattaaataaataaataaatggtttacactgagggtcacagactttgagttgaggttcgtcatgaagaatctccattttcattctaatagcactagatacaggctgggtgtggtggctcacagctataatcccagcactttgggaggccgaggtgggcagatcacgaggtcaagagatcgagaccatcctggcgaacatgctgaaaccccatctctactaaaaatacaaaaaattagctggatgtggtggcacgtgcctgtaatccctactactcgggagtctgaggcaggaaaatcccttgaacccaggaggcagagattgcggtgatccaagatcacgccactgcactccagcctggcgacagagtgagactctgtctcaaaaacaaaacaacaacaacaacaaaaaacacaaaaaaggctgggcacagtggctcaccttgtaattccaacactttgggaggccgaggcgggcggatcacttgaggtcagcagtttgagaccagcctgggcaacatgggaataccctggctctactaaaaatacaaaaattaattgggtgtgttggcacatgcctgtagccccagctactcagaaggctgaggcacaggaattgcttgaacccaggagtggggagaaaaaggaaatattaggggacatttgttaagtttatatttttttcttttctcttctttttcctctttttttgagacagagtctcgctctgtggcccaggctggaagctggaattcagtagttcagtcatagctcactgccgcctttacctcctaggctcaagtgatcttcccacctaagcctcctaagtggatgtgaccacaactgcatgccactccctccacccccgtctgcctaccagctaattcaaaaaaatttttttttgtagagatggggtctccctgtgttgcccaggtcagtctcaaactcctaggctcaagcaatcctcctgccttggcttctcaaagtgctgggattacagacatgagccactgggctcagccattaattttaaattgcaagtgacatattctttagtttattaatcagcaccatatgatgtcacagttttataactcatttatctcatttaattctcatacccaccttgtggaattgttatcactgtcctttacagatgaagaaagaaactccaagaaattaagtagctggcccaagtccacccaactgggatgggcagaaccagggtttgctcttggttgtgcctttctacagcctgtgccttaaccacatctatgtgctgcctcttggcctctgtgtggccagtagattctctcatggctaggctcatcttaattaacatttgttgggtgcctactatggctcaggctctagagatcattgtaaaatccagtccactgccccagctcctcgtgtgtcttttgaacacattagtattgtgctgtgcagaaaggacttctgtgcatatgcctgctattacacttgttgaacccaatttctacaaactttcattcagatggagggattcagtcttcttatcatataatacatacagaaatacaaatatttaaatatttatctaaattaatagtcacatatgccatttatacagttagtgagttacagccaagtgacagttgtgatgggaggctgtgtctggggagttacatactggtgaggaaactagaaaacatggctgtcgggccggcactgtggctcacgcctgtaatcccagcactttgggaggccgaggcgggtggatcacgaggtcaggagatcgagaccatcctggctaacacggtgaaaccccgtatctactaaaaatacaaaaaattagcggggcgtggtggtgggcgcctgtagtctcagctactcaggaggctgaggcaggagaatggcatgaacccgggaggtggagcttgcagtgagccgagatagcaccactgcactccagtctgggcgacagagtgagactctgccacaaaaaaaaaaaaaaagaaaacaaggctatgaaaatttaacacattgactgggcagggtaatgcatggtgatctgttttctcttcgctccaatcctgaaaggtttctttgaagagctggagtgtctagaaagctttcctagaaagctagtgtacattttgctaagtaatcactgtgtcacttagattttctgctctttaagtgtggttatgagatgtgttccaaacaatttgttactaaccatgaagttgatgaatgctttgcctttaaaaaaataagtttgggtggggtgcagtggctcatgcttgtattcccagcattttgggaggctgaggcaggcagatcgcttgagtccaggagtttgagaccagcctggacaacatggtgaaaccctgtctttactaaaaatacaaaaattagccaggtgtggtggcgtgtgcctgtagtcccagctgctttgggggctgaagcaggaggatcacttgagcctgggaaatccaggctgcagtgagctatgatcacaccactgcactccagcctgcgtgaaaaagtgagactgtctaaaaaaaaaaagtttggccaggcatggtggttcatacctgtaatcacagcactttgggaggccaaagtgggaggattgttgaggctaggaggtcaagaccagtctcggtttgattgggttaaacattatccctgtaagttggctctcattctgagaagttgtttagagtagaagagagggctgcatttacagctaattgctagtaatttcacatcatctgcaatatattttctggacactctgcccgactagtcctatgggacgttgtcattcatgtgcaaatcaggccctatatactaagggaggaaaacagttgaggacctcctttttttaggcactcttggtgccttgtgcattaagatagtgagtcagaggataagaaggaagcagattccattccccttaccactctttgggtgtaggcagggcctgctggtagtgctgggaaagccgaccatccttctttgagcaagtccaatagctgctgctgctagttctgtcccaccataggcacagtctatgtaggatgagccaaccatatgtggagttactggttcttggtctgggcttgttcctttccccaatttcagtccccaccagaatctgggcagtcattgtgaagaagcctaggaataataccttactctataggcctgtggaaacgtgtaaagataccttgcaggcccagagtgagaaattggagccaccttgttcgattgaccaaaggcttgtcctatggagttactaattttacaggaagtttatgttaacatactttctatccattgcactaccatttctgaggcacaatatatttcagtaggcagaaagatagaactgcttagattttaaatactcaatacatgcttgacacagtttagtctatttctcttcagttactatggcagtgggtgctatagagatgtgcagaccctattgtgacctccctttggtatagggatgctctggagcccctggcttcattgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaaggtgagtgttttagggacaagcagcatcaacttcggaatcttcaactgggcctgagcacttatttctcagaaataatagaatcttgctcacttttctttctttttttttttttttttagatggagtctcgctctgttgcccaggctggagtgcagtggatcagtctagctcattgcagcctccacctcctgggttcaagagattctcctgcctcagcctcctgtgtagctgggattacaggtgtgcgccaccacgcctggctaataattctatttttagtagagttggggtctcaccatgttggccaggctgctctcgaactcctgacctcaagtgatctgcccgcctcggcctcccaaagagctgggattataggtgtgagtcaccatgcctggcctcttgctcacttttcatactaaaacaacaaattacaggctgtagtttaacctctctactgcatgcataaatgcagtgtggtacgagtgcctctgtagcccataacttcagtttccttgttgctagcagtctgtggtgacactatactaatctcacatgcaggaaccaatgaggattagccagggacacaggaggagtcaccttgcattcagaatgactcaagtttagtctcaacttgaccattagctctctgagtgatcttgcccatgttaattctcttgatcttagtttcttcagagccagtgagacattgcttgaaagtgacttagcctggtatacccaggtctgtcagacttatagtctggtgctctcttgggtgaacttgagggccttctgccaaggcaggaatggcttcttttaaaaaaaaattattttattattatttttttttttgtagagacggggggtctcactatgtttcctaggctggtctcaaactcctggactcaagtgatccttcagcctcggcctcccaaagtacagagattataggtgtgagctaccagtaccagcctccaggaatggcttctaaggcttcaggctgtttatagagaggaaagcacctgggagctgatggcactctcaggtttcccaaaatgacagttctgcatatgcatcttaatcacctactttttttccctccacccccaaatgctattcacagtccttgtttatgatagaagctgaagcttacaggtgacaatttttgtgcctgtatgaaaggaaacatgactgactccacttatccacacgacacctgctttcaaggttgttcagtgttggaataatttttgcttgatggtaacctagggatgacccaaggtttcattagttaaagccagccctgtgggatgcatgaagtctagcctctgtccctgtaaaaatcccaccagaaccattttagaattcactcaggacttcacccctcccgctcctggtgctgcttatggaactaaagaatcctcatcttctcagccctgggacacattgtcctcatataaagcgaggtggcaatcagggaacaggggcgagtcttgtgcttatttcagttataataggaaggctctaccaggactcatcattgtcccaacaatagtcgattccaggccccttctttgaactcatttcagtgtctcaggttctgtccttggtgtctgtcttcactgcttgctcagttgtatttgaacatggctagagatgagcacacttctcttctccagtaaaaaagcctgcaagaaaagtcttggacttcttgaactgctattcagttgtcttttttattcaatgtattttttgagatggagggggtctcactttgttgcccaggatggtgttgaactcctggccacaagtgatccttctgcctcagagttccaaagtgcagagattacaggcttgagctaccacaaccggtctcttgtcagtttttgaggttacttaagaggttaatgcctttaaattagtttgcagttgttttgcttttgcctgccttcttgcccaaatgcgcaagtgcttatttagtaatctgactcaagtgctttgtgtccccagagtccccacttttccaggattcattgtctttttttttttttttttttttttgagacacagtcttgctctgttgtgcaggctggagcgcagtggcactgtcggctcactgcaacctccacctcctaggttccagaaattctcgtgcctcagcctcccaagtatttgggattagagtcacacaccaccacacctggctaatttttttatatttttagtagagatggggttttgccatgttggccaggctggtcttgaatgcctgacctcaggtgatctacccgctcggcctcccaaagtgctgggattacagacatgagccaccacacccggctggattcagtcttaacttgctctttttttttttttgcatctcactcccttgccaggctggagtgcaacggtgtgatcatagttcactgcatccttgaactcctggggtcaaaagatcctcttgccccagtttcccgagtggttgggactacaggtgtgtgtcaccacgcctggctaattattttatttttcgtagagacaaggtctgactgtgttgcccaggctagtcttgagctcctaggcttaggtgatcctcccaccttggcctcccaaagtgtcaggattataggtgtgagccactgcacccagcctggatttgctcttttatcaagaggttaatatttattcttccgttcagtgaaccgtgggattgaattcccccagcgattgaaatgaaagggcttatgtataacatttcctgaggaatggtagtaccagagttcagaggagacctcaggccatttattctataaactcagaagctgtagttctagatgatgtggcttcttcagggtgttgagaagtctctgttatctcgtgccttgttggattagaactgattgagctctgtctgctgccccaaacatgtggctcagccaatctccagtggcatctgcaatgtgggtattctagcctccagtgctcacgtggctcaccttagaaagggcagatattcctatttcctgacgctgctggagaatgaggtctgagtcagaagtcctcaggtgtgacctgcccagaactatctgaaattgctggatttcttgttcttcctcagtgtttaacaatcacccaattgctcattctcaccagcgacttcctcagtaagagctcaatatttgaggtggtgctgcattttgtcaaacattcatgcgtgttagcccacttagtcttcgcagcacacagtggattaatggatttttaaaagctggtatttatgcacgatggaatactactcaaccataaacaagaaggaaattctgtcatttgtgactacatggatgcatctagaggacattatgctaagtgaagtaagccaaagaaagaaagacaaatggtgcatgatatcacttatatgtgaaatctgaaaaagtcagttatagaaggagagtgtaacatgttggttaccagcggctgggggaagggaagggtgggtgtggaaaggggagatgttgatcaaagggtacaaaatttcagttaggagaaataaggtctgatgatctgccttacagcatggtgactatagttaatatggttaatattataatagtattgtatacttcaaaattggtaaaagagtggattttaaaagttgtcaccacaaagaaatgataagcatgtgagctgatggatatgttaataaccctgatttaattattccccaatgtatacatgtgtccaaacatcacactgtaccccataaatataattgtcagttaaaaacttaggagtcaagtcagatctgaagagaagtcaaaacagatttcatacagttaatttagagacatgggacccaattaaaaatttgtattactttacttggtattttagaatttagctgttattttcttgttacacacacaggcacaggcacacaaatcctctatttaactggctttctcagtaggaactccatctgtgtatttgcaacagctgtaactcaggttggatgctccccagggtgctggcctataagtcatattggaccctgatctgaatctgagggaatctggatctctcttgtaggaagcttttggtttaactgggaagacaggatgacagtcagttgtggaagctgaagcgtaatcacctcatattaatatggtggcaattttatatcggagtgagctctgagctgcaaacagccttctaggaagcaggcaggggacccccatccagggtgatggtaagaatcctgatgcccaactgcaaggtgttcagcagggagggagcactcgtggagtcccagtgcagaagtctctgagcagccacttagcctccctgtgtttgtggggtaacaacccgagttcatgttgtgggcatctcatgcagtgtagtagctggtcactgtcaagtgtcactatttcattgagtcagaagcctgcagaattgttctcattccagggagtgagtcagtctgctgttgcttactctcggtgctggctgagctcagcaacctgctctcttccttcagttcaggtttctccagggcaaagaagtctttattgttcctttctgtatgaccagatgggaaatgaattataatatagtccttagattatattcccacctggtagcaatgcactgagttacctgacctgaaatttgttggacttagtctccatggaggaggatttaccatcttcgttgtctcagaagtcctggtagtgcctcatgccagcaatttagcaggagcaaaagctttgagacagtgttctggatctgctgagctggtctaaaggaacctcttttgcttgaagtaactgtgataggaactttgttactgcttctgttagctcaggtgttggaatgagaatcagcagctgatgaggtgaacagctaggagtactggaattatggagtagtggaggtagattttataaacagagggtcccagttttttggaaatgggaaagagagagggtagactggcctttctagaatttgtaacagaaaagaggacccaggagcttccattgactagttagttaatgcagtgcgggatcttagctggtttgcttggtccaattcctgtctctcggtttcttttttcccttcccttcgctgccttcccctccctcttccctttttctttccaagagaattgagtcactccatataaaagaagcagccagttggctaaaaagtccaacaaaaaacaagtatttatagctctccaaatttcccacttgtcattatcagtatacttttgcacacagttatagtcggtgtttgggatcctttttaaaaaaataaaaagtttctgtaggcttttccatgcatgaacacagcttatcaacttgccccggctgtgccaggattccattgttgactgttgtttgagcagtcatgccctttgttcttaggctgtgtgttgtttttttcctaacatcatagtatggctgggtattattttgatacagattacaattactattactatttcttgaagtgtatttcccagagtggaatattttaggatctttttttctcttttgtgggggtggggaacatgtagcttcttgtggatattagacattgaagtctaaaaaggttctatatttatgatttggccctcaattttctagagattccaatggttcctgcaaagaaaagagcattcaagtatagaaaccagccagactaagtctggacatgtagcttttcagaaagtgaaaaaaaattatgtttctgcagttgcaaggtggcctctgaatgccacactgtgtggccactcccttggacagtggctaggccacagggtcgcctcccctggccccagtctgtgggttgaatatgctaaccgagccttcccaggagcctcctctgcccccagcccccaggtctgtacagatggtagttggtactttcagcccgccttgagaactcagtattcttcctgttagctttccttcaaagtaaaatcggtagaacctattttgagtgtagaaaatttgaagtcgtggacagcagattacaaaaaattgcccaccaccatgcctggctcatttttgtatttctagtagagatgggctttcaccatgttggccaggctggtctcgaactgctgacctcaggtgatctgcccacctcggcctccctaaatgctgggattataggtgcgaaccactgtgcctggctcctttttgtatttttcggagaagcacaaggacttgttgtttaattaagcaagactatactctcccagagcatgcagttattattgagtaaaacacagttaatgagatttaatcacgttccctatcactgttgtgcagcatgataagtaggtgcaaatggcaagaagcacgctgaagttactgcagttggtaacctgggccatggatggcacttgtctttgcctcattttgcctgtaagaagcatggggcctgtggtcctggggtacctggaccctcagcctggtgtgtgtgtgccctcagcctggtcctttacttccatcacccatctagaggctccaggaccctttactgcacccctccctcctctagatagctcagtgttttcatcccagcacctttttctctgctgcctgagaactgagcagccagagacaaattttggctctcagggtcctcaagggtgtacagcaaagctgttcttattatttaaagtattttatttatttatttttgagacagagtcttactttgtcggccaggctggagtgcagtggcatgatctcgactcactgcaacctctgtctcccaggctcaagaaatcctcctacatcagcctcccaagtagctgggattacaggctggagtgcagtggctccatctcggctcactgcaacctccgcctcccaggttcaagcgattctcctgcctcagcctcctgagtagctgggattacaggtgtgtgccaccatgcctggctaatttttgtatttttagtagagacagggttttaccatgttggccaggccggtctcggactcctgacctcctgatctgcccacctcggcctcccaaagtgttgggattacaggcgtgagccaccgcgcccggctagcaaagctgtacttttaccaaaaaaaaaaaagaaaacatttataaatcaaggtctgaaggcccatgtgaggcttattctacagcttgcaatgcctgtttttgccccttggtaagtggacgcacagctgggcagccttatgctatctctgtgaactacccatttctggctttgttcataatattcccttgatctggaggccctcccccagccctgccccaaatcctgtctgtgttgagggtcctgccccaggaagccctctgcatactcttccctgcatgtaatacctgcctgctttcacattcttctagactgtgctgtgcatcgtacagttcatcagcattattgcagagtagagtgtctctgatttggagtcaagagaaggttccatttttctgtacatcccgatgtttattttctgagtgttctcagacatcactaagcctcagtcaaaataaagtatgatcatgatgtaacattcattgagtgcttatcacatggtaggcattgtgctatatgagttattgcttgacttcctaaaataatcccagtagagatgctaaatctaaaggtgagagagatggttcaaaaagacctcagtgagcaaaccatgtactataatatcctaaaagataacaaaaatgtaactaggtatctagagaaaactcaggaaggatatgtgccttgggccttttaaggaccatttcttaacacttctgtgttcttcttgacacctgtttctgggtagagcacatagaaaatgctcagtaaataagttctttttccttggcccagtttggcctgatttggccccagttctgtctttgtgagttactttattagttgtcggtgctactgtgctgctattcatgtggaagattccccaaatgggctgcgccttacattgcctgagcagaagccccgagggatggaggatgagcttgccttgttatgggactgtgtttccctggctgacaaaggctcagcatttgcagcaggcaatgggaattgattggccaacttaatatttccttcagcctagcaaagtcctgagtaggctagggacagtctgcttttttggtaactcctgtaggctgccttctgcacaaggcacccagcctctcacaggtaggatgaactggcctcagcacgcttgcagaggggtggaactgtgcgttgcttgccaagctttttgtttccctaaggtttttgaggttttctttgtttttggtaactttcaattttttttttttttttttttttttggacagagtttcactcttattgcccaggctggagtgcagtggcgcgatcttggctcactgcaacttctgcttcgtaggttcaagtgattctcctgcctcagcctcctgagtagctgggattacaggcacgcgccaccacatccggctaattttgcatttttagtagaaacagggtttctccatgttggtcaggctggtcttaaactcctaacctcaggtgatccacccaccttggcctcccaaagtggtgggattacaggcatgagccaccgtgtctggcctaacttttaattttgatacggtcttttttttttttttttttttttttttaagacagtttcgctcttgttgcccaggctggagtgcaacggcgtgatctcggctcactgcaacctctgcctcctgggctcaagagattctcctgcctgagcctcccgagtagctgggattacaagtgtgcaccaccatgcccggctattttttgtatttttagtagagacagggtttcaccatgttaaccaggctagtctcaaactccagtctgcctcggcctcccaaagtgctgggattacaggcatgagccactgtgccctgccttgatacagttttaagcatacagaaaaatggtaagaatagtacaaagaactctcatacctcttccccagattcactgctaggattttgccttgtttgcttttctgacttgccagtgtcccccaccctgcagcatatgcacatgcacacacactgtcttctgaaccatctgacagggagttgcaggcagtgtacctttacttctgaataccccagtgtgtatttcttaggaacaaagacattctcttatataatcgcagtacaattatttttaaaaaccagcaagcttaatgtcaatacaatgctattacctaatacattgttcatattcagattttttccatattccactatggtcccagtaatggcagagctttattttaaagaaaacaatcctggggtgtgtgggtgtcaccttggttacattcgctctgaggaaagcagaaccgacaggtatttggggaagtgactgccgtgggtgccacatcaccagctccttgtgtctctgcaggaccagaggagcgagagcagcaagaaccacacccagcagcaatgtcagcggaagtggaaacctcagagggggtagacgagtcagaaaaaaagaactctggggccctagaaaaggagaaccaaatgaggtgagcgatgggggctggctgcactgaatcaggtgggcccagcacctgtcgtgctcagcacacctggttttgtctgttggcagcactggggagtggccatgggccatgagctctggacccctgggtgcctgcttggccctgcagggaccgcatacagcttcggctgcttagaactctccccactggtccattgtctcatccaaggaggcagggcaggtgctcctgggagtgctgataggatttgatggtagttatccttttttctttttaaaaacttgtgcgtttcctcatctgggctgagaaagggtaaacgcaggcaaagctggctctgttcagtcttttaccacataaaagactgcagggcagcctttccttactctgtatagggacagctcatgctaaacctgagcttccaggccctgttctgcatcattagcctctcatagccctgtcattggccaagttttttttttatcccttgaaataattgctaataataaattgattctcagcacatggatgataacgagctaatctcctaaagaagacagcagaagccagaccatgataaggccaaatttttctcactcttgtagatggattgtgtggacacatgtaagcccctgcccaagtaccaccatctttaggatcacatgttttctaccttgtccatccatccacacacctttacaactgtgtaatttcgttaagcagcacaaacccagcgtcctggccctagcctctcggttgtctcctttgcatccttccgtgcttggtcctagtcacatatagtctcaaagaagctgtgggtccaaggtgggaggaaggcagtagggccatctgaggagacccatggtcacagccttactgaggtgtgtgaattccagaagacacgttccaaggcaggctgttcttagagaagccagcaaatactgaagggaatacagatgtgtgtctcttcgaccactaggtggccacagaagcaaagcattgctcatttgggtggttcccaacacagacacatggacgtgggtactactctcaaggagcaggccacagttatcccttgtgtcctgagtccttggagcagaatgtcatgtctgcttgtcctgtgttccctgacaagttgctgctatttgtgttggagtgaagtgtctgagaagccccagcctccagtacaacaggtggtcaccttggggtgtggactcaatcttctctctatggtcctttctggaaagctgggaagggctaattgacacacaaacacctcccatctctccacagaatggctgacctctcggagctcctgaaggaagggaccaaggaagcacacgaccgggcagaaaacacccagtttgtcaaggacttcttgaaaggcaacattaagaaggagctgtttaaggtttgtgccccgcattgggttccagactgtcatatggggttggggtgggggccttggtcccatgagaaaagtgcccctggagccactctgagggaaaagctgggcttttctccacactccattccttcttgacgttaagctctggctctcggctgggtacagtggctcatgtctgtaatcccagcactttgggaggccgaggcaggtggatcacttgaggccaggagtttgagaccagcctggccaacatggtgaaaccctgtctctactaagaatacaaaaattagccgggtgtggtggcgcgtgcctgtactcccagctacttgggaggctgaggtgggagagtcacttgaacctgggaggcggaggttacagtgagccgagatcgtcccactgtactccagcctgggtgacagagcgagactctttaccccgccaaaaaaaaaaaaaattggttctcatggcttagatagaataacatagtggtgtgaaggaagcaaaagtatgcgtgttccaaagacttcaccatgccattcctttaagaaacaaaagcttccttgtgtgttaaataattcactacataaaaatggaccataggattgggtctttggggttgggggttgtcacttgagcctctgcatccagctgctcggatgtggtgtgctcaggcatagctggcctcctcctgtcacctccacagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcaggtactattgggggctgccagctgctagggctgaagagggaaactttgacagtggtagcagatccatagtggcccatgaaggcacacatggcattaggacagatgagctgcagggtgccgagaggaaggtggccaccagattggccaccagagcttgtgggcccagtgggtggttcccagcatggaggcctggtgtgatagatgccagtgggtagtgttttgggaagggtgagtcctctcgcacatagaggggtctggaagaatggagctggcttcctccctcattgcaggatgctggtcttgaagaatggttaattttcttttcaagttttgctctgagaagccctgctttataagttaatagagagccagtgccaccaaggagagtaaataagctctgtttacaagtagcctttagatgaggctgaacctggggaagcttactctgtccccaggtcctgtcagcttccactgaggcctcccagggcactcaggatgagtatgccctgccacagtctcattctcccatgttccaggttttctgttgcttcttgataaaaaaataaccagcacctagaaatggggatgtactcatgccctcctgtctgtgctgtggtagtttcagtggcttgagccacctcagagaaggctacatctctggtcagttcccaggggagacccagcatttggcagccttcttggggtaccaatatccacacctccccagagctcttgctagggagggaagaccatcaggcagtgcagctgccgcccaccagtgctgcttgctgtgtagttggcacacctgagcaagctcacctgctccagctcactctctctggagggcgtcctctaaaaggagagtgtagccaggcgcagtagctcatgcctgtaatcccagcactttgggaggctgaggcaggggcattacttgaccccaggagttgaagaccagcctgggcaaccaaggtgagacaccatctccccacaaaatttaaaaattagccaggtatggtggtacacacacgtaggaggataaggtgggaggaccacttgagcctaggagtttgaggctgcagtgagttagccatgttcataacactgcactctagcctgggcaacagagacctcatctcaaaagacatttaaaaaaaaaaaaaaagtatgggcagcccaaagatggctcagtcgatcctctgctcctgcagatattcaatgaactggaccaggccggctccacactggccagagagaccttggaggatgggttccctgtacacgatgggaaaggagacatgcgtaaatgccctttctacgctgctgaacaagacaaaggtaggtctgtgtgtcctgagctcccctcctggggcaggtgtagcaggagactccactgatgccatgtctcctattggtgctgccacacaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagcta

SEQ ID NO: 106 - DNA, 64258 bp, Homo sapiens
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcagggtaagggcttcgggcgcacctggagggctggggcagctagcggctgggggaaaccgccttggtcaccgcagtctgtgggaggctggagggaggaaaggaggtgcgacggatccccttttctgtggctgccttgaggccccgcgggtacctagctgtgtggtcgcgggtagtggctcttgcgccccctgctgcgcttgctcccttggtccggagcgctccccggaatgcccggtgaagctgtgcgggaaccctgcggtctgtgtacaggactgtgtccttgcaaacctgactctcgagcttccttcccagtgcccccaggagcctttacacaaccgcgtcccaggttactctaaggggagactgcccgagagggcgcgccccagcggggtgatgtacccgcctggggagtcctttgtaccagcgcccctcttctccctctgcattgggggtccacctcgcctggtcctccccccacccccgcgggtgcatgtgtggatgacagtgccctgactatgaagggactgacatcacgggcgctgagtcacggatcttcccgctgcacggagtcactttggcagccaccaactctgggaagccaagtgccccagtcctgggaattgagtcgggaggctggcaagggagtgagacctcctggggctggcacgtgctggactcccctctagaaaagagaaggacccgtgagggagagggcagaggcacttactgctcccgttgactgtaatctgcccctggcaaaccaggcttttcttgggctctggccgcatgcccagctgcgtgtctagtctctcttctggaagagttgggcaactggctctccagaggtttattttagggtcccagtgcttctttgaggacacagcagaaaactaaggggcagctgacaggcttctggaacagctgacaggctggggaggctgaaggctaagactttcaaccactagatcacactgaattccagtcctaggtgaacactgatctctccctttgaggaggtgactttctgcaactagaggctgagctggagtgtctgaggctctctttgctttttggatggttgtggtccttatgattggaagaaaaaaagaagggattccattttcaatacacatttataactcctgccagtaacagacactgttgattggggcacccattcaatgttttctaatcctccactgtatctacatataactttgtttgaaagaggagactgaggttcagggaggttgggatggcgggatggcaggttgtcaggccccggtgatggaggccaacccctcccgtggctctgtgctccagtgtggtagatgtctaagactctcaaatatagaactagatcagcaggcagagctgggggcattggggcaagctgagagtcactcttgtctggctgagtgctgggacagaaaaggctgagggagggaagtggaggcccaggcttgcccatggtggtgttagagggatgcaagacaggttccagggctcggatggcctcaggagcaagcagggctcccttggctgcctctgctgctgtcacgccagcccaaggctcctgccccagggaggttactgttactgctgtagttgccaccacctgttgctcctgagtggatgctaggcccttccagggcagccagttacagtcagttttccatttccctggtgctcaggaaggattaggagaggtggtctcatggcctgaacagcccatgaaaggcagaactgagagactggggaggaagtgaaagtcctcccagctcagaaggaaaatgcagagaagtagaaatacccagcccctctcccacacccacacagactcagcccacaaactggagagtaaaaataaagaaatcgtacaggaagcatggagcaaatgactgtgagatgtttcgctttagagaagtgaggagcagagggggagcagaggctggagttggctgagaggggaaatccgcaggtacagcctgcggggctcttagagcccagaggtttgttttcctcgggatcagctgccgcccacacaccctggagctgccaggacttctcaggtgtactcgttgtctaagggcctggactagctgggacttaggcttctgccggttccaacactctggtgctggaaggctggacttgggtgactcaagttccctcttcctactgcaatgcaagaaaatacacaaaagaagtatgtatacctttaagtatctcaaagagctatctcagcttctgaatttccttctagggcacctcttcctgcccccattacccacacacgtgcctagcctcaccctaaatcagtatttctcaaaagcttagttctgagcctagcatcagatctggtgtgtgtgctgggtgggagggctttggtaaacatgatgatttttgaaccctaacccagatttattaaataagaacacctaggagtgaggcctggggcatgtccttttaaacaaactgccccttgtgattcttaggcactgtcaggtttgaggacggctgcctaaatggtgtcattgaggaactgaatgaaggccctcccgcttcgggctctctgttgccagaaatctctccttgctttggcttgctgcttgtttattcattgcagcaaacatttcttgagtcggtgtagagcctgtgaggcctgtgtaggatcagctatgcagactccaccctaaaaggagcctgaaaatggtcatgggtaaatcctgagaagggctgagaaaccccagactctgaccgggccactgggtaccaactacccgtgaacagattgtctggcttggggtagggggtggttagagagaggaagttcctctgactgaggaccaagatcccaaggcagcaggcacactgatcctgaccctgaccctcatctccagccctcagcagccagggtaaacaaatactcccctcactgggtatttgtagattacacaaagtaacctaggtgctgactgctgaaaatatacactcccttcccccgtctcctgaatcctggtcccaccaggcctggaagccacagacccagcaagcaaaagagtttccagtcaatgaatctagtctggattgaagctgtgctctgtaatacggtagccactagccacgtgtacctatttaaatttaaattatgccagcgcagtgactcacgcctgtaatcccagtactttgggaggctgaggcaggaggatctcttgagctcaggagttggagaccagcctgggcaacagggtgagatgccgtctctacaaaaagatttaaaaaattagctgggcacagtgacatgagcctgtagtccctgctactgagaaggctgaggtgggagaatcacttgagtccagtctgcatggagccatgtttgcactaccgaattccagtctgggcgacaggagaccctgtctccaaaaaattaatttaaatgaaatcaaataaaaacttagtttcttagttgcactagtcacattttaagtgctcaacactcacattgctagtggctactgtactgaacagtgcagatacagatctcttccatcatcgtggaaagccctactggacggtgctgggctagagtgttaaccagtttcttccagaggttttctgttctcttttcctttatccccctctgccttctgctctcctccacctgaacacagctcattttgcataggtgatggctaaggtcttcaagccaggcacatctctgccctgcactgccaagtaaaaatgataacaccttgggcaagtgatttaacttctttgacagccagtgttctagaaaatagaaataattgtattacctcgaagggtggttatgaagatgagatgagctaagtaaggtattaaatagagtgtttacagaagtccctaacacacagcaagtgcttaaataagtgtaggtgatcattcattcactccaaaaatatatttttggagtgaacacctcctactctgttccaggcactattctaagagctggagatacaccatgaataaaagagacaaaaaccccaggcttagttgagtttcattctagtgtgggagactattaacaggatgtaaattaagtatgtggtatgctagcgactagtgctaaggagaaaaactaaagccgagagggagacagaccccatgtgtgtttgtggcagggtggggtggcatggtgccttggatgggaggccagggaatgccttgctgagaacataatatttgagtgaagacctgaagaaaatatacaaatctctagagattccctatatgtccatcttgggcaggaaaattcttgcctcctctttaacaatgtgtactacctgagggtgtgttatgttctggagcagagggctctgtggggacacatggatgctccctgccctggagaagtatctctggggtaacaagtcctcagccctttagctccttgaagtctagcagagggaagtgctaaatgccaggtcataactgcaagtctgcaggtgggatccttgagggctggagtggcaaggggaaggtgacaaagaaaaggccttttttttttttttaaatacaggatcttactcccgtagcccaggttggagtgcagtggcacaatcactgctcactgcagcctcgacttcctggtctcaggtgatcctcccacctcagcttccggaatagctgggactacaggcgtgcaccaccacatctggctaattttttgtatttcttgtagagacaggatttcgccatgttgcaggctgctctggaacacctaggctcaagcagttcacccgccttggcctcccaaagtgctgggattacaggcgtgagcctttgtgtccagctgggaggtttttttgtgtagttaatctgtgttctttaccctctcctcttgcctgggatctgaagaggtcaaaagtccctggcaaaggcagaggcttttctgccactgggttcaggcttgacgttagctggacctcagcagcctcccccactcctgctcatcccttgccagctctgtcgggtgctttctactcttaggagtatgtccctgaggccctgcatccagcctattctccccagcacctgttctctgaatcagttcccactccacttcccaaccgctttcccgaaaagcatcctttggtcttccctctctatatgatggttacaataactgttaccatttatggtgtgtcaactgtgtgcaagtagctgtgctaggcccttggcatctgtgatctcatgtaatcttcaaaacagcctcaggtgagagaagtgctggccccattgcatagatggtgggctgtaggacaagatgagaggccagttttgcacatatggaaacaaatgtcttttgttttcgtttttgttttgagacagagtctctgtctcccaggctggagtgcagtggtgcaatcttggctcactgcaacctctgcctcccgggttcaagcgattctcctgcctctgcctccagagtagctggcattacgggtgcacaccaccacacctggctaatttttgtatttttagtagagatggggtttcaccaggttgccagtctggtctcgaactcctgacctcaagtgatctgcctgcctcggcctcccaaagtgctataggattgcaggcatgagccaccgcgcctggccgcaacgagacaatcaagagaagatgctgataaggagttggatatgggagtcaggaatttgggaatgaggactgagcttgagatgtaaatgtgggagtcgtgtgctggcagatattatttcaagccctgagagtggctgaggtcccccacatctattcatatgcctttggtcagtggaatgttttgcaatccacatcactataaatgaatttcctctgtctctgagagaggccgctgaggtagcagagagaaaacagctttgagggcaggcagtccaggcctgtctccccattaactgcttcaccagctaggggacctttgggcaagtcactacaagctttaaagtataaaatactttttgaggccggatgtggtgtatcatgtctgtcatcccagtgctttaggaggccaaggcaggaggatcacttgagcccaggagttcgaggctgcagtgaaccgtgacagcaacactgcactccaacctgggtgacaaagcaagaccctgtctcaacaacaacaacaacaaaagtataaaatactgtaacagacaaaaatgcatgcttgataaatgttattgatcctaagagccttttttttttttttttttgagatggagtcttgctctgtcgcccaggctggagtgcagtggcgcgatctcagctcactgcaacatccgcctcccaggttcacgcagttctcctgcctcagcctcccgagtagctgggactacaggcatccgccacgacgcctggctaattttttgtatttttagtagagacggggtttcactgtgtcagccaggagagtcttgatctcctgaccttgtgatctgcccacctcgtcctctcaaagtgctgggattacaggtgtgagccaccgtgcccggtgagccttttttttttgtttttgttttgagacagagtctcactgtgttgcccaggctggagtgcagtggcacaatctcagctcactgcaacctctgcctcccaggttcaagcaattctcctgcctcagcctcctggcctcagctgggattactggtgcctgccaccacacccggctaatttttttgtatttttagtagagacggggtttcaccatgttggccaggctggtctcgaactcctgacctcaggtgatccacccaccttggcctcccaaagtgctgggattacagacgtgagctaccgcgcccggcctttaaaagcctattttgatgggaggagggggatgctataatgtgaggactttctcccagaaaaggagagagaggcactaatgcagtggggataataattaaaatcgcttaacattttttttgaaagattaggtatgttctgaaaatagtgctgaggtttttgcattaattatctaatgtaatcctgacaacatttgaagtacctatggttattatttctattttatggatgagaaaagtgaggcctagagaggttgagaaacaagcccaaagtcacacagctagtgagtgactgagatagggttggaacttgggtatatctgaatcctgggcttgacctgtagacccctgctcctgtggactaggaaatttaaacaaagaacttcctctttttttttttttttgtatttcattatatggatgtactgagtttatttatctggttccccccctttttttttttgagacagagtcttgctctgtcgctcagacttgagtgcagtggcacgatgttggctcactgcaacctctgcctcccgggttcaagcaattctcctgcctcagcctcccgagtagctgggattacaggcatgcaccaccaagccaggctaatttttgtatttttagtagagatggggtttcaccatgttggccaggctggtctcaaactcctgacctcgtgatccacccaccttggcctcccaaagtgctgggattacaggcatgggccactgtgtccggccacccggttaccttttgatggatgtttagttgttcccttcttgctcttacggcccctgctgtggggaataactttgcatatgcctcttgttgtgtgagtgcaagtacacctgcaggatatattccccgaaggggaattgatgggcaaaggccatgagatttgtcatcgtgagacagaatagaagttgcaccaatttatacttccagcagcattgtgagaatgcttgtgtccctatgcccttgccaaaagtgtactattaacctggtatctacacagacaatggcgtctgtgtggaattaatttgcatttatcttatctgaataagattgtatgggttttttaatgtataactgacatttgcataatctactatgacctgcctgttcatattcaatgctaattttattttgattgggtcattaatcttattgtttacaggagctcttgacatattaacatgtcatacatgacttttttttttttttttttggtggtgggggtggtttttgccaagaaatttctttttttccatctctctctctctctctctttctttctcagggtctcacggtgtcacccaggctggagtgcagtgacatgctcatggctcactgcagcctcaatttcctgggactcaagcgatcctcctgtctcagacttctgagtatgaggctcagactcaaaagattggggcttttacaggtgcacaccaccacacttgactagcctttgtattttttgtagagacgggattttgccatgttgctcagactggtctcaaactctgggttcaagcgatcctccctccttggcctcccaaagtgctgggattacaggtgtgagccactgcgcctggctgcaaatttttttttccaactagttgaatttaccagtctcttttatagcttctaggttttgtgtcatacttaataacatccttcccattccaatattttatttttatttattttttgagagaatgtcaatccacctttattggaggaaaccttgcactgtaactgttttaaataatgtgtgccctgccccaccctgtgcctggtgggctcagaagatcatctccagctgccgggcatactcggtgacctgtttggccagttctgtggagggaatggtagtgtcttctggctcctgctgctggccggcaaaactatattagttgttggggcccgggacccaccctcacttcttggtgtagtcggtcatctttttgggtgtgttgaagaagaggatctggtggcctcggtaaaagggattttctcataggctttcttgatgcacccggccatctcatccctgatagtgtcaagcaggatgtcgatgaagacggtgtagctcttggcgaggatgttacccttggccaggaacactttgttgtagctgccctccattaggtattgctccagggacacagggtttttggtgtagacattggtctggatgtccttggcaggcagccactccagctccatgtggaactcagccacccgcttctgggacagcaggaagaggagattgaggcccaagagctggtgcatgtaggctgactggggaagctgttccttgtaatcaaagtagcagcatttgagctgggtcatgtggcgctggaaggaggggatgtcctcgcataggatgctccactggccccgatcttcagtatgtcacgggccagaatgagctgctgtttggtcagcttggtccctgtggttggcaagaagttgagctccagaagaactagcttgaggcagcccagctcttccctgcacttgctaagattggggcttttacggttccactcgcccttgagttgcttgtacttgccgtcctcagcctgcaggacagggccctaggtcgccaggggcccggagctcaaggcgccggctgcactgttcacctccacccccattccaatattttaaaagattctccttttctggtattgttaaaagttttaaaagtttaaatatttgatccattttgaatttattaatattatggatgaggtatgaagtctgactccagctttttctttccagttgtcacctgacatctctttacagtttattgaattcatctttcccccaccaattttcaaagttacattttaaatctaccaaattcctgtatacttgggtttatacgcctcttggcatagcgagtagttaaaagcacaaattctgaggcccaattgtctggacttgaatgcaggtcacccctaattagctatataacctcagtctcttcttctgtcaaatagactattgagaagatcaagttagttaatctatgtagcacacttagaaactgcctgtatgtgtagcaagcacttagactaagttatttttttaatgtggtaaaaacacataatataaaatgtatcagccgggtgcagtggctcacacctgtaatcccagcactttgggaggccgaggcaggtggatcatttgaggtcaggagtttgaaaccagcatgaccaacatggtgaaaccccatctctactaaaaatacaaaaagtagccagctgtggtgacaggcacctgtaatcccagctactccggaggctgaggcaagaggggaggcagaggttgcagtgagccacgattgtgccactgcactccagcctgggcgacaagagtaagactccatctcaaaaaaaaataaaataaaataaccattttaaagtatacagatcagtagtgcagactaaactattttttatttttattagttctgaactttctagtctcttccataatttggtctccctattcatgtgccagtatcgcactgttttaattatgtagttttattttttccttcctatttttttagaggaagggtctcactctgttgccaaggctggagtgcagtgtcttgatcatagctcactgcaaccttgaactcctggactcacgcaatcctcttgccttggctttctgagtagccaggaccacaggtgcatgacaccatgactggctaatttaaaaaaaaatttttttttttttttttgtagagatggagttttgctatgttgcctaggctggtcttgagctcctggtctcaagagatcctcccgcctcagcctcccaaagtgttggcattacaggcatgagccactgcacctggccaagtaaactttagagattaattagggaacactgatgtatttttaatgccgagtcttcctatctcttggtaggcctgatggggcttatgatgagggaggaggagctggggcaggagagcccgacattcaggtctcactgaggggagatgtgcccaggacacttccactggaactgcttccttgatggtgatgtggagtgagctggaccagtgtgtgcgtgcatgtgtctacccaagctcatggcacatgggggagcggagggggtggggatggctcagcagtgattggaatgcaagagtggggactttggggcctgtatgaaaaagtgttatggcagagtgacacacctacgaaagagtgtggtcagcataggcctcacactgggtgggtttttacaaactgaacacatgcatggaaccaccattcagaataagaactgaacagaagcatcctcaggggagccctgaaatccccctatgcacacccctcaaacctccccttatccctcccagctgctccatccacacctccacgtgacttcttaaatcttcagctttgctgcctcatagctaagggggtcagggaggggaagctggggggtctgtagatatggaatgggggtgcgtacatcaggtccctccctctccctgccctcctgccaccttccagaagcacataaaaaaaatctgactgagggccagcctctttgttatactctgagactgtgctcagagatagaagacaagacccctaggccatgcttctgggaaggcagagggctgcgtgttaagcctggaccgagagtcccagagcccagctccggtcctgacaccatgcactgctgtgtgacttctgggccctggttctcctcatccaccaaaatgagcaggttggcctgagtcgtccttaagagtcctgtatagccttaaaacagcgctccttatctcagcaccctacacactggctgtagcttctcctcactgtccctttcaggaccaaaatactgggtgtatccatctgcaggtaccaatggctttcttctaaggccctgctgcgtcctgcttttaatctctttatttctctatctgctcctggggttaggtttgggccagggagtggattgtttgccctccttagatatcctttctttttttgagacagggttgcccagggtggagtgcagtggtgcgatctcggctcactgcaaactccatctccggggttcaagtgattctcctacctcagcctcccgagtagctgggattacaggcatgcaccactatgcccagctaatttttttttttttttttttttgagatggagtttcactcttgttgcccaggctggagtgcagtggcatgatctcagctcactgcaaccttccggtttcaagcgattctcctgcctcagcctcccaagtagctgggattacaggcacccgccaccatacccggctaatttttgtatttttagtagagacaggatttcaccatgttggccaagctgatctcaaactcctgaccttgtgatccgaccttctctgtctcccaaagtgctgggattacaggcgtgagccacttcacccggcctaatttttgtattttttggtatggatggggtttcaccattttggctaggctggtcttgaactcctgatctcaggtgatccgccagcctcagcctcccaaagtgctgagattacaggcgtgagctgccgcacatggccttagatatcttttcctctaattagtttataatctctgagagttgacccaggttgtaccttcttggactggagccaggtggttatctctgatgctgccagaggaggattagatgttttatctcctgagttggtcacacgcgcacgtgggtctctgagtcagcattgagcattacctgtttatgggtccaaaggagcctccctcccagaccctctctccagcagtgtacagtccatcgtgtggatgggaggaaggcaaggccaaggtaaatactgactcagacaaatacaagcaggtacaagaagtacaaatacatatgtgggggaggagggagcaggggcctgccagccaaagctagtcatctgagaagagggggttgcggacaggtggggctgggagctgagtcagagaaggttgctgggcctcccattagagcctgggagccttgacttgccgtagcctgcggccttgcctcttcctggacagtggccgagggtgccctctgaaatgttaaggagaaatgaatgggcccagatggtggggtgacttggggaggacgcgagatttggagtccaaggggaggcagttttaggctctaactcatcctatacacgctgcggctgtgggggaagggagagaaaggccaagggcacgactcctggctcctgagagtccccagtgccccattaggttggcagctgcagtgatggcgctgacccccccttgtgcacacccctcaagcctcagcattcccttccctgggcctctgaagggtggaaagatgtgagaagagcagggaagaggagaggaaattgggagagggggagagagagggtggtggggagcccagagaagggagctgggggtggagcatggagaggtacctgggccaagtagagagaggctttggccaggctcatctgggtccagcgtggattccctcatgcatgagctgtgtgaatttgggcaagttccctaacttctctgatctcttgttgcctcaacaatgaaatggggacaagacttcctccctggcagactttttgtgagtagtgtgctcttagggaaagcccagggcgcagggtaagtgtcccagttgctaatgattgttatggttattatcacatcaaagccaggagccagtctcagtccaaagatggagaatgcaagaacaggtgaccaagagcactgggacttgtcctagccctcgtgggaccaaattctatacttgtttccatgtggacacaaggtgtccacaggcttctcctggaggcttctcagcacccacctacttttagatcaagaccattattgctgacaggggacctttgtttcctctgtagccccttctgaaatcctatgcctttgcaacccaagaagctgggttaggctgggggcctcctgtgctgccagctggcctgggcagcggggacctgcgtctctgctcagaaactggggtggtgagatgggattagcaggcacgagccaagcctgtgtcctcggtggcaggccaggcagctggttcaccgcttacataaacggggccaggaagctgaacttgtttttgctggcaagagctgcggcaagctgcaagagagttgagaaatatgtgtctccgtgtgcgtgtttttctctggttattgacatttgcaagtttacttgaagagggggaaaaagtagaaaaacaacaaagctgtttggattcctggcacccaaacttaggtcccaactggggaggaaccccactttcccagagctgtgctgcagggtccccagaccaaagggtgtctgggccatggtgggggtcccagtgtccctgggagggggaatcctaggccaccggggcagggagatatgggcttgcttgttgggagttactaggacctaaactctctttcccttgaggaatgggaggcaagggaggttgtgggaattttccctcccctagagctctccagggagaaagaagcatttttctgagggcactgggatgatctggtcatcatccttctcccaaagccatcaactattaaataataaatccatagattcattatgtgttttcaagctgagtattgtttgcttcctgccctctgagagctaatgattgggcgccatgggatgctagaccgcaggagtgggggcctgtgggggatctacaggtcacagtctgaatcctcatttcacagagaaggccagtgggctctgccaggggcggtgacgtgcccatggctgcctgtgagtcatcacaagaccaggaatagaactcaggtcacctgacagcacagagctgtttcctctacaccaaggggcctcctgcttgtggagatgtactttattttattttatttatttatttatttatttatttattttcaagaaggagtctcgcccaggctggagtgcagtggtgcaatctcagctcactgcagccttcgactcactgcagcctctgcctcccggattcaagcgattctcatgcctcagcctcctgagtagctgggattacaggcacacaccaccaagcctggctaatttttgtatttttaatagagacagggtttcaccatgttggccaggctggtctcgaactcctgacctcaagtgatccacccgtctcagcctcccaaagtgctgagattacaggcgtgagccactgcaccctactgagatgtactttatattaaagaacaaatcaaggcagactgtacgtttgtgtcagcccaaccccacacaattaatagtcagtgattaaactgaccagaccagaccagacaccaacactgactgttgaggaggagcttgggggtttgttttcgggaggcaatactgcctccttttgtgatcttagtcccaggtgaggtgcttccttgtcctctctgcagaatcccattctttcttagcctgggctgaagctgctccctccctgtatgtgaccctggccttggcgcagtccttgggtgctcttcctccctcctgcctctgcgctgcttcatgatgcacaggagccaaggaggggcaggggacagtcggttttttctcagggagattggaagagaacagaaacaagaagcaatggaatgctcctgtcctggaggttggtggggcagtggggagaggtggggaagccattgagcctgcacatacttttgacaggcttggctcatgcctgccaaccccatcccaccgcctgggtttctgagcagggacatgggtccccactgcccaggccagctggcagcacaggatggcctccaacctaacccaggctcttgggttgcaaaggcatagcatttcagaaggggccacagaggaaccaaaagtccccctgcctgtggagtcaggcctgatctctttgagggtgctcacaccctccatgttcccctgtaggtcttccttccctccttactgcatttcagatactccagacaccagccctccccagaactctcactgttttttgtttttttgagacacagtcttgctctgggtcccaggctggagtgcagtggcacaatcacagctcacttcagacttgacctcctgggctcaagtgatccttctgccacagcctcccagatagctgggaccgcagacatgtgtcaccatgcccagctaattttagagttttttggtagagatggagttttgccgtgttgcccaggctggtctcagccacctgggcacaaacgatcctcccatctcagcctcccaatgtgctgggatgacaggcgtaagccacgatgcctggtgactctcaattcttttttttttaattattattattattattttggagatagagtttcacttttgtggcccaggctggagtgcaatggtgcaatctcagttcactgcaatctctgcctcctgggttcaagtgattctcctgcctcagcctcctgagtagctgggattacaggtgtgtgccaccacgcccggctaattttgtatttttagtatggggtttctccatgttggtcaggctgctctcaaactcccgacctcaggtgatctgcccgcctcggcctcccacagtgctgggattacaggcgtgagccacggcgcctggtgactcagttcttaatgccttgcatatactgttctctctttatggaatgtaactccctgtggctccacttatcaaacccccactcatttatcaaggccccaataaaatctctcttccccctttagaataattgatccctcttcttagttccctcagtatgttggagacatttatatcaggttggcctgtattacagatagttttaagttctagggctttgtggggtttaaagaagattacgatatggaaatgataggaaggagtgccagtgcattgtagatgctcagtagcttcaatatggagttttttttttcctggattaggaacttctgaacttgcacatcatgggtgcacaaaaattattgaattcttgaagaagggacaggcataggcttgcaatcctggctctgaatgctgagcaattgctcacggacaaatgctccgttgattgtgtgctctttgctaaatttcagtgtgtgcaccagccacgccttcgcccccgcgtgccccgtctcctagggcctactatgcaaggcctgtgtcaggccggggtgggagcatgagaatgactgggcatatctcccaggaccaggaaggactgctctcaggagccccctcctcacctggttcctcatcgtgtctcttccttttggcccttctctttggtagggcctacttagggagggccccagcagattcccagggaacagaaaaacagacagatgggaggaatcaaggctgagcccagggatggtgtcttgtgtccaccagggaatcaggcctacaggggagggctgggctatgggtgcagaattcagtgacagtgacagtgagagaactcagcagtgcaagggcaaagtggcactgtttggcctgaaggtgctcggaagctgcttgtattgaaaaatccaccctcatcccccgacatccctcagtgcccactgcgctctgccgtgccctctccctccttcctagaaatcctaactcacacagacccaggctatgtagcttgtttaattaaatatatatatatatatatatatatgtattcattataagagcaatataggcaacttatagaaaattcaaaaactacagaaagacacagggaagagaaagaaatcacctctaacaccatcatttggagaggagggcagaggtagggagaggacacttctatgaatgttacttgttctgagagtcacccatgaggcttccccactgccacccagctgtcaggggtactgagtcagagatttgggtcaggaggcagagggctgagtgggtgggagggaaggggcggtgctgcccactctgactttagcaagtatgttttcttatagtctttatgagtatttctttgatcattctgcatacagtgcttttaaaagcgtagttaacacagtgttgttcgcaggttctagaggaaatatattttgaagcagggctgtgacaggcaatacttgccaatgggtggtttataattaatcattccctgttttaaaaaatagtgactcagttttaaagattcagaaagccattactcaagttccttggcagaggaagtggccattatgttgctccctgcagctctgcttttgtggaagagggaaaaaaaagtatttttatttggtatttctctgagctgctcagatactttggccattgttagtgagtgcaggagcagaacagcccctgctattgttcaggctggccgctaaacatggcaagagcttcccgctgaactggggtaggggaaatgaccagaaagacatttactggatttggcaaaggcagaagcagaaaagagagcttcctctggctccaggagtctatttcttgcctcagcgggctcctctgccccccagcctggggcctgcccatcacacaacacgagagggcaccacttagaccccttcacctgcaaaccgtgcgcctgggagtttttggtgccgagaccctgtccctgtgggcacccctaacatgccctatattcaacaaacatgcatgaagcacctactaagttctctgatgagtgacgaccaggagcttccagtgttgtcaccatggtcggggaagggacctttatatagttgaggactgtgccatgtgaaaagtgccagtgattggatgagctgcagtggtccttgacccctaccttagaccttcatgcatcctgcacttgtgtctgttgcatgccatgtgaattctgatttctgctaatcagcgaatcagctgaggaagggatattgcaagcattgcactgggagcagttctctttgggcactgtttccatctttgctcctgcaagtttgtcatttgtgcaggaacttgaaatccgtgttaggttttatcttgacagctgctttatccagtggaaaatggaaaagtggaaatattgatgcactgattagaagtgtcgttgcatcttccatacgtaaccgcattcaggcactgatggacttcaagatgtgggctggatgtggtaaactgctgcctccatcaggtgctcattggagttcaacgcactggaccgtgtgttcagttgtgatgtagcaggacaagccacagacaaaacccctcagacaccgagttaaagaaggaagggcttcattcggctgggagcttcagcaagactcatgcctccaacaaccgagctccccgagtgagcaattcctgtcccttttaagggctcacaactccaaaggggtccgcatgagagggttgtgattgattgagcaagcagggggtacgtgactgggggctgcatgcaccggtaattagaatggaatagaacaggacagggattttcacagtgcttttctatgcaatgtctataatctatagataacataaccgattaggtcaggggttgatctttaactatcaggcccagggtgtggcgccgggctgtctgcttgtggatttcatttctgccttttagtttttactacttctttctttggaggcagaaattgggcataagacaatatgaggggtggtctcctcccttagtgaaggaaaaggacacaggtcacacacgccaacaccagcagtttcattcttagggaagttcttgggcaagtgcactgagtcatgagaaagttgatagccaccctctttgatatggcaaaacaatgggaatgaccgcaaacctccctcagtgagagaatgatagggtcacacaacgaaatattacatagcagtgagactgaacgaactacgtgtcagtgaatcagagaaacatataaatgaggccgggccaggttgtcatccctctaatcccaacattttggaggcccaggtaggaggattgcttgaggccaagagtttgagaccagcctgggcaatatagtgaaacctcatctctcaaaaaaaaaaatatacagccagtcatggtagcatgtacctgtagtctcagctacttgggaagctgcggtgggaggatcagttgagcccaggaattagaagttgcagtgaaccatgattgtgccactgtacttcagcctgagtgacagagtgagaccctgtcccaagaaaaagaaaaaaaaaaaaagcagccgggcacagagcctcatgcctgtaatctcagcactttgggaggctaaggcaggaggatggcttgaggccgggagttgaagaccagcctgggcaatatattgagaacttgtctctagtaaaaattaaaaaattagccgggcatggtggtgtgcacctcccagttactcaggaggctaaggtgggaggatcgcttgagcccaggagtttgaggttgcaaaaagctatgattgtgccactgcactccagcctgggcagcagactgagaccctgtatcagacacacacacacacacacacacacacacacacatatacacacaaaggaagttcgagaaaagcaccagactgagaccctgtatcagacacacacacacacacacacacacacacacacatatatacacacaaaggaagttcgagaaaagcaccagctgggcgtggtggctcacgcctgtaatcccagcactttgggaggccgaggcgggtggatcacctgaggtcaggagttcaagaccagcctgactaatatggtgaaaccccatctctactaaaaatacaaaaaaaggaaaaaattagccgggcatggtggtgtgtgcctgtagtcccaactactcgggaggctgagacaggagaattgcttgaacccaggaggttgaggatgcagtgagccgagatcgcgccattgcactccagcctgggtgatagagcgagattctgtctcaaaaaaaaaaaaaaagaaagaaaagagaaaagcatatcacagcagaagactatattcaaaccatttatatgaagctcaaaaatgaagcaaagttaagaaaaatgtagggatgtatgggtagtgaaagttaggttggtgggctttcctgggtattttatgcttcataaattaacttttatgtatgtagcttttacatacattatatatatgaatttgcatgtattcagtattatgtaatacattaaaaacaatgttcgcaatgctaaaaatatattgttgaagattctgtgtgaaagctatactgtagttgtggctttttataaccctttcaagccctctgggcagtagcagtccaccccttattgccctcagtggacttcaccttctagggactcagaattttttttttttttttgagacggagcttcgctctttttgcccaggctggagtgcagtggcgtgatctcggctcactgcaagctccgcctccctggttcaagcaattctcctgcctcagcctcccaagtagctgggattacaggagcctgccaccacgcccagcaaattttttgtatttttagtagagacagggtttcaccatgttggccaggatggtctcgatctcttgacttgtgatccgtctcgcctcggcctcccaaagtgctgggattacaggtgtgaggcccagctgggactcagattttgctgaggaccaggacagtactgtgtgctgtgtcctggccttgcagcagtgaatgtgtctcccgtttctcaagggcaggtctctgggatgcctgactgtgtcttccttgccagtgcctggctgctgcagcctcctcaaatgtttatcaaacacaggacttgcccaccgtgggagaaagtaaggccataggtgtctcaggaacctgcccaaactcgcctggctgcacggtgacaattcaaccagctttcttacccaaggtctgttggtgaccagagaaaaccttagatgaccggctgccatgatggccttatatctgtcccttttctgccagccttgaggtagagggtgccagggaggaggactctggctctaggtgttaaagtgagagggaagtgtgaagggtatctgtatagctagacagggctcaatgccaggcagagctgtctccgcccctttgatgtctatgtctctgtccctggactgtggccagtagccagtgtggactccaacctcaccagctttaggggtgttatctgcctgggagtcactgatccttactccctcctctgacagccaccttggatggggtgaaaggaaggacagcctgccaagtatgagataaaaacgcctcataaacaagaagggatttgcaggccaggcagagagccttgtgctgcttctgagtcccaggagcatgggcgaggaggtgaggtcaggcactcagcagctgctggtcctctctgaaatctttggccagatttattgctactgcttgctaataaatggttatgcatttggttcaaaggaccaagtgtgcttacatgaaaactggctgtgttccctggcctctgtttccttagctggttggactaatttgattggttaataaatgagtccaaggtggttgggctaatttttatcttagattctatgactctataactgctactcaaaaaaagtgtacttgttcctttaatctttaatcttatttttcttgagtagtagaatacacccaatttttttcaaggggtagagaatgcattttttttttaaccttccagtttggtccctagagtaaacacagcattgctgtagtagatgtagggtactggagggagcatggaacagggaaccagaagccctggttcctaccccagctgggcatctgggccagtctcttgattcctctgtgcctcagttaccaactatataacgggcattctgccatgaataccctgcgatttggaaacctcctgtgtacgtgtgcacttgggtgcctggcattcattcctaatggcatccattcgttcacacattcatccagtactcagcagactcctgccatgggccaggcaacgtcccgggcacttggaatataatggagaacaaagcagggtgcctacttctgtggtgcttggagtcttgaggggaagagagacacggaattcgtaattacatggcagcgtgtgggtgacgtattgcagaatgagggcctagtggagctgggggaccggaaacgatgtttaggccgagacctggaataggaggagttgtcgtggggatgatgtaggaagaacgagtgtgaggaggagagcgaggggagttgaggggagggctccacaccttctaaggagtggggagagatgaggcctccaaggacagaagggccctgcaggccacgctgaggagcttggacttcatcttgtggatggtggcaggcccttgaagggttttctaatccagggagtggggtggctggatcatggcttcagaaggctctcccaggcagctggatggtgaagaccaggttggggaggtcaccaggagaatgctgccctaatccaggcagaggtgacggtagcctgggccacttcatcattatcactgaggcctctcgtggcttcctcagaccagaacgaagcccccttcttcagtggctgtgggctcaccaagtgtcttctccctcctccagaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatggtgagttgtgcctcagaggtcccggagatagttcccgtaagaaatgaggctttgtgcattccagacagtccctgtctgagccttcaaactcccaccatttccttggcgcaagaattttggggaaggcccaccaatgtctgccatccagatgctggcaaagactgctgctgggtgggagtgggagcgtctgactggtggggaacattggctttgggagttaggacttttggtgaactggtgaatagcctggggcccggagtcaggcagcctgggtttgaatcctgctccctcacatacagcttaacttctccacccttcagtttcatctttggcaaaataaggttaattttattaccttaccttagagttgttgcaaagggggtgtatgtgaatttgcgtatgtgtgtgtgtgtatatcacacacatatgctgctaaaaagtctgcatagcccatcctaagctctcaaattagctattcttatttttttagaattagcaagttcttagctccctcatacctagataaagacttcctggaaccagtgccctgtgtgtcgagccctatgccaaggcactttcttccttgtatctcttgtaatccttcagcagccttgtcagggaaagcaggcttatcatcatttccatcatcattacattatcatcagtttattttatacatgaggaaactgaagagcagctaggacttgcccaaggccgcacagccaggtctgtgtgactccaaagccctttttttcgatcatcctctctccccttcagacaagttggtcctgaggttcttcccttcccctgtcccggatccgtgtctcagactgaaaggaggactttggtgtcctttaatttcccagctgcgattccattcatgtgtggctgagtgtggccagggtcctgactagctccagggctggggccgaggggcccagccacgtgctcccctcaagggaggctgccctgtctgcgaggtcagtgcgccccaggatccccgcccgcctgctgacacctgcaatgctttcctttcagttccccccgaggagccccagctctcctgcttccggaagagccccctcagcaatgttgtttgtgagtggggtcctcggagcaccccatccctgacgacaaaggctgtgctcttggtgaggaagttgtaagtatcttgggctgagctatgtgcatgttggctccctccttcccgaggccccccagagaggggctggttcaggtgatttcaaaacattatcattaggaattaattccttcaggctgaggaagaggagatgagagggaactgagatttacatttgactgccccccctgagctaggcactgtgcttgtgcttggaaccttgtcctattcacttgaccttggttatcacaacagctatgggaagtgggctttatttttctcacttaacagatggagagactgaggcccagagactgattaacaggtttggttcacttagctagtaagtggctctgctgggaattcaatcccagtctgtctgatttcattcaaagtccgaagattatgggcgttgctctgaaaaacatgcaaatatccctgggagggggtgtagcacagccagaccattatcagtgtctgggcccttgtgggcgtatcaggctatttccatgataaagacacgagagagaaagcggtgatgggcgggggagagggagcttggggccgtggggggagaagtcacgcctgcctgggggctctgcatcatcaccggaagacggcttaacgtgggaagacctgggatgggttcaggcatggatgtagaggaggtggaagatgctgaaaacaaatctgcctctgcagttttgctggtctccatcccagagccacagtctcccttagtccagaggtttacaattgagtttgagctgtcagtcatcagaatatagggcaaggaggtcgcattccaagacccctagtggatgcctgaaatcgcaaatggtgctgaaccctatatatagtatgtttttctatagatatgtacttatgatagtttaatttataaattaggtgcagtaagaggttagcaataactaaaaatagcatagaacagtgataacaatatactgtaataacagttatgtgaatgtggtctctctgtttctcaaaatgtcttattactgtactcacccttcttgtgatgatatgaggttgtgaaatgcctgcatgatgggatgaagtgaggtgaatgatgtaggcattgtgactcagtgttaggctactagggctttctgaccatgtgttagaaggaggatcagctgttttgggtgactctgggtcaccgagccatgatgatggcggtggatgtcaggacgagtgatgggtagcatgcacagcgcaggaatgctgaacaaagtgatgattcatgtcctgggcgggacggtgtgaaatctcgtcacacttctcagaacagtgggcactttaaaatttctgaagtgattatttatggaatttcccatttaatatttttggaccgcagttgaccacaggtagccgaaatcttggaaagcaaaacctcagataaggcaggactactgtatcagaaagccagagcagtgacttcaatagggtggttcagctcccacttgggtctgtttccatagagttactgggctgcctggcagtcatgtttttgttctgtcctctatgatgaaaagtgcggattaccatctgtgaatgatgcagctgccattagcactgtcagctcatgccccaagcctggatagcttcacagcccagcaaaggatacaccttgtttgtacctcaaaggcttgtaccatagataggattagccaggatagagactgtggctggcagcttcccaggccagcctgtggaaagctctgtcatttctgacacttcaactgaaatacttttttttttttttttttgagatggagtttcgctctgtcgcccaggctggagtgcagtggtgggatctcggctcactgcaatctccgcctcccgggctcaagcgattctcctgcctcagcctcctgagtagctgggattacaggcgcacaccaccacgcctggctaatctttgtatttttagtagagatgaggtttcaccatgttagcggggctggtctcgaacttctgacctagggtgatccgcctgtctcggcctcccaaagtgctgggattacaggcgtgagccaccgcgcccggcttgactggaatactttccatgttgacagcgggagtgggagagagtacagtgcttgtcctcccgagcagcctcgtgcctttgcttccatctgctttgaagagtcagcatgaccactgggcgcctttgaagtgaggaaagagcaggggaagtggcttcgagagcctcaggggccccagcccccactgaggccccacccagacctcaggccactgcagggcctggaagagacaggcccctggaaagggattactgggagctctgctttttctcttgtgtgtctgctttcacacccttgcccaactgcagcactgctccctccttcttccacaggcaggggtgagctcagcctctgccttggaccaggcgcagtgctggggcagtgggaggaagcgggccaacaagactgagccccggccctctgaccccacctgggcacacacgtaaagcagtcggtgaccctgccttcgtggctgggtggaagcctgggtggtgttgggggaaggaggaaaggggctttaactcagcctggaaaggttgggtttgtcccatgtgctggattcagcaggagcccagggttcgaacccaagtcagaggtggcagactcgtcaccccagctggagggtgagtggttgacgtggcctcacatgcccacatgtgtcataagagggtgaagcctcaggtttccaggccaggtgggatggtggctgactcacctcgaatgtcttcagttacccagaattcttttctggactcacctgccagaacccctctagcactttttgtgtctctggagtggcatttctgctgggtgtctagtcatctgaggacagatcttttttgttagtgccttgaaggcagggtggggcctctcttgattcatttctatatcccctacagtgccaagagcacaggcccagcgggagaccagagctggccagccgaccattgcctgagtgactagctgagccctccagcctagctcccctcacccctcgtgccaggcgctaggctacatgtttatatatatttgtaaatccagctagtttcctcatctctagattttacatttattgctcaattttttttttttgagatggagtctctgtcgcccaggctggagtgcagtctctgtcactgcaacatctgcctcctgggttcaagtgattcttctgcttcagcctcctgagtaactgggactacaggcatgcgccaccacgccaggctaattttttattttattttttgtatttttagtagagacagggtttcaccatattggctaggctggtctcgaactcctgacctcatgatctgcctgcgttgccctcccaaagtgctagaattacaggcgtgagccaccgcgcccggccttatttctcagtcttaacagaaccagccacgtgtgattgttcatgcctgtaatcccagcactttgggaggctgaggcgggcagatcacctgaggtcagcagttcgagaccagcctgggcaacatggtgaaaccccatctctattaaaaatacaaaaatttgctgggcacgctcaggaggctgaggcaggagaatctcttgaacctgggagggaggcggaggttgcagtgagccgagactgcgccactgcactccagcctgggtgacacagtgagactctatcacaaaaacaaaacaaaacaaaaacttaacccctactaggtaagtagtattaatattcctattttcaaatgagaaaaggagacttagaggcacagggcttataagtctggagctgggattcaaaccccgggattccacttcccccttctgtcccgtcttgagtctgtgcgaaactgacaggcaagccctgcccttgttttgtgtctaacagtcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatctgtacgtaagctctaaccccctctccagcagtttccttctcttttgatttaatactccttatcgacttctcagagtggcagggaaggggtggttgaggggtttggtgagttggtgccttttgggcgttgcttgccgggaggtgtggcaatgataaagcaggcccttgtggagctgtgcatggggagtgaacggggctgggtggggccctgcttgctgggatctcagcctacatgggcttctctacactatatttggtgctgcaaaggagtcatgctcacttttcccacagtgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtaaatttatgttttacttctggtcagagaggcgcccctagatgcttaggcgtagtagaaagggtactagaggccaggcatggtggctcacgcctgtaatcccggccctttgggaggccaaggtgggcgaatcacttgaggtcaggagttcgagaccatcctggccaacatggtgaaataccgtctctactaaaattacaaaaaattagctgggtgtggtggcgcacgcctgtatcccagctattcgggggctgagacaggagaatcccttgaacctgggaggtggaggttgcggtgagcagagatcacaccactgcactccagcctgggcgacagagttagactccatgtcaaaaaaaaaaaaaaatagaaagggtactaaaaggaaaaccataggctctagttcctgcttcacaattggctaccttcgttgctttggataaatgttttaagctttctgagccttggtggtatatcatttattaaatgaaaaggataatgccaggccagtctcctcttcccgggcttgtctgtgaggagagcaatgtgggaagagatttgggctgtagacatgtcaagggttgtggcttgcaggattctatagtgcatgggtggggcagggactttctgcttcagcttccgtgggccctgagggcaaccccctctctagcagagcctctggggttgtgggagcctctagaggcctctgccagctgaagcacagggctggccaaggcaccaacccactggggtgctacctgcccagcaccatcctggatacctccccagagtcaccgtgcccccgccctcaggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacaggtactgcggtgggcactgagaaaggaagggatgtttcaactgtcattgcatcaggtatccattgctatgtgacaagttgcctcaaaactagtggcttaggccaggtgtggtggctcacacctgtaatcccagcactttgggaggctgaggcgggtggattgcctgaggtcagcctggccaacatggtgaaaccctgtctctacgaaaaatacaaaaaattagctggacatggtggcaggtgcctgtaattccagctactcaggaggctgaggcaggagaatctcttgaacccaggaggcggaggttgcagtgagccgaaatcgcgccactgcactccagcctgggtgataagaacgaaactccgtctcaaaacaaacaactagtggcttaaaaacgaccatcatttatcggcttgaaatttcaaaaatacagtcagttaggcagctcttctgctggtcttgcctgaatcaggaatgcagctgccatcagattgggatggtctgagatggcctcagtcacatgtctgacgatggtgctggctggtggccgaggccctgggttctccctgtggcttctcatcctcagctgccagcccagactcagggcaggcgggtggggatcccaccacagctggagggatgcactgcagagaagttagccgtatttaatctagggctttttatttttttcaaatgttaaaggtagtaataattgccattggggattgttgaaattagagcatgaaaaattccagaaagatatgaagaataattatcaccagtacttttactccctagagaaaaccagtgagaacatgttagtatgctgctttcctttttctaggtacatgtatgtgtgtgtgtatttatatatataaatgtaatattccccatgttgtcaattacttttggaaacttattatttagtaactgcctgattaatacatatattttaaaactccatggaaatttgttgttgttgttgttgttttgtttgtttgttttgagacggagtctcactctgtcacccaggctggagtgcagtggcatgatcttggctcactgcaagctccgctttccaggttcatgccattctcctgcctcagcctgccgagcagccgggactacaggcacctgccaccacgcccagctaattttttctattttttagtagagacggggtttcaccgtgttagccaggatggtctcaatctcctgaccttgtgatccacccgcctcagcctcccaaagtgctgggattataggcatgagtcactgtgcccggtcggaaattttttttaacttaaatttttttttttttgaagacaggctttctcctcgttgcccaggatggagtacagcagtgcaatcacagctcacggcaacttctgcctcctgggttcaagcaatcctcccgcctcagcctcctaagtagctgggaccacaggcgtgtgccacaatgctaattttttaaaaatgttttgtagagacagggtttcaccatgctgcccaggctggtctcgaactcctggcctcaagtgatccaccagcctcagactcccaaagtgctgggattactggtgtgagccactgcacctgactaaactttaaatttttttttttagacggaatctcgctctgttgcccaggctggagtgcagtggcatgatattggctcactgcaagctctgcctcttgggttcacgctattctcctgcctcagcctcctgagtagctgggactacaggtgcacaccaccacgcccggctaatttttttttttttttagtagagacggggtttcactgtgttggccaggctggtcttgaactcctgacctcgtgatccacccgcctcgccctcccaaaatgctgggattacaggtgtgagccaccgcgcctggcctaaacttttaaaattttaatcaaattaatacatgcacatggcaaagaagtaataaacagcttataacactgagcagtggtcccttgtcccatgccttccatttctagtcctgctttctaaggaagctgcttgactctttctgtttctagttcctctgttggtgccctccttaactctaaacaacaagcttatatggcttttttttttccctgataaaaccacttgagacattatctatcaacaccctgctatgaaaggttaggatttagcagatctagaatgcaagaatctccctgaccacaacccagagagtggtcagccagcctctgcttaaatgcttccagagacagagagcttactaccccttgcagcaatctgttttattgttcccagtgtttttgttgtagaatggcttcatggctcactttggggtcaaatgtttctagccctgtggcgtagttgaaccaaattaatcattcttaaatacttggcagttaggaaaaaaaaaagaataagatacccatttatttgagtaagtatggataaaaaggaaaaggtagaattgacatcagtcccatcccgacccctgccactttctcccagccctggccccagggagagaaggcttttatctatgggctgcacattcttcccccagattggatggtgtggggtgatggctcttcctcctggctggctttgtactgtggggtccttgtcccttgtctttcctgtcctggggagagccagaggagtatgctggggcttagggtgtaatcctagttggatgcaataatatgaagtgccggcttccatctttgttggcactttccttgttcatcaaggacaggaggcagctttctattgggccctctcctcaaaagcttttttcctgctcagacctggacaaggagtggggcctaactactatatcttacttagggagaccattttaataaatcagtgcatccttcagggtagatcgtattgacctgtccatggttttctttgatttgtgtatactttgagccaaacacactcatttatctgaatgctgagcatcagtatggctttgggggcctttttaaggggggaaaaatcagctctaacatcgtgcagaggaataggaattccaaatataggctgatccctattttaccttttattccaaccacttagttcagatagtcacaagcagcttaaagcttgtgacaagcagcttaaaagcaatcttgcttttttataaagtttcttctaaaaattttcaaattgtaaaatgtacataagatttaccatttatattattattattattttttgagacggagtctcgctctgtcgcccaggctagagtgcagtggcgtgatctcagctcaatgcaacctctgcctcccgggttcaagcaattctcctatctcagcctcccgagtagctgggactacaggcacctgccaccatgactggctaatttttatatttttagtggagatggggtttcaccatattggtcaggctggtcttgaacccctgacctcaggtgattcacccacctcagcctcccaaagtgctgggattacaggcgtgagccaccgcgccctgcccatttatattatttttaagtgcacagctctgtggcattaagtattgttgtgcaaccatcaccactttacttctccaggacttttttcatcttgtaaaactgaaactcagaatctgttaaacagtaactttcctttcacccactccttcccccagctcgtggcaaccaccagtctacttgctttttctgtgagtttgactactctagtacttcatttgcttgcttgcttgcttgcatgcctgcctacctgcctgcctgccttcctttgtctctttctgtctctctctttttctctttttttttgagacggagtctcactctgtcacccacccaggctggagtgcactgtcgtgaccttggctcactgcaacctctgcctcccgggttcaagcaattctccagccttagcctcctgagtagctgagattacaggcgcctgccaccatgcctggctaatttttgtattttttgtagagacaaggtttcaccatgttgcccaggctgcactctaggtacttcaaataagtggaatcagagagtatttgtcctttggtgactgacttatttcacttagcataatgtcctcaaggtttattcatgtggtataacatgtgtcagactttcctccctttttaaggctgaataatattccattgtgtagagataccacattgtgttgattcattcatttgtcaggggacactgggtttgcttccccattttggttgtgcataatgctgctatgaacacgggtgtaaaatatctgtttagattcctgctttcagttcttttgtgtatatactcagaattataattgtggcattatatggtaattctatttttaaattttcatggaaatgccatgccgttttccacagtggctgcaccattttacacttacaccagagtgtataagggttccagtttctccacatccttgccaacatttgttatttttcattttgctgcaatagtcctccttatggatgtgaagtgttatctcactgtggttttgatttgcatttccctaatgattaatgtctttttttttttttttttgagacagagtctcaccctgtcacccagtctggagtgcagtggggcgatcttggctcactgtaacctccacctcctggggttcaagtgattctcgtgcctcagcctcccgagtagttgagattggcatgcaccaccacacccagctaatttttgtatttttagcagagacggggctttgccatgttggcgaggctgctcttgaactcctgacctcaagtgatctgcccatctatgcctcccaaagtactgggattacaggcgtgagccaccacacccaggctgaggatcttttcatgtgcttcttggccattcatatatctttggagaaatatctattcaaatagaaagttctttcttatgtgaacctaactctggcctcactggcccttgctctgttctcagggataaccaatgacaaatttcctagtctgctctctctgaattcttttggagttcccagacctgcatctgcttgggctcctcttcccaggctgttacatgagatggtctgtgaattcttcacctttctggcccccttcccctgaatctggtctcatttgtggatgtccctctttaagttgctgacactctccttctattggaagatggtgtggtgggggctgtctggccagcactgggtacggtctccactttccagcctcaggtggatgtgcttctttggcatagacacagcttctgtgggagctcagatagaacagtcggtttcttctcatgtaaggagcggaagactttgagccctccaccctatgcatgtgtggtttgaggcaggggaagtcttcaaaacccagttgtgaatatatccaagaaagaaacctgctgctcccctctctgctgagggaagagcaagaggaacttggatgattttgacgcaagagggggattcaggttggaaattggcgggcagttctgaaaaataaggggaaggttagagcactaggtgaggtgtgtgttatggaccacggttatttggctgttagggacgcatcagtgtactaaacactgtatcaccgtgtggggtgagcttacccaccccaaggaccttcagctctcaaggcccagacagacaggatgcacctgcctcccagactaggtgtgggagtggtggcctttgggagacacagaggtcctgggaagcacctgggagtcaggttgtatgacactggtaaagttagttcagctctcagagcctcagtcttgtcatcggtaaagtagagatgatagcaccaatcttgttcctttcagagagtttttgtgagtctgatgaaaaaatattctttagaaatgctaaagcatactgcatttgtaaggggatcagcaattacaggacagtgctggttcttgggaggagagtgggaccaggggcatcccagaatcactatcctggatgccatcgtgaactcactgcattggaatctggaggaggaagtagagtgggtggtttgagaaagctttcctggtggttttagtatgtgcttgagggggctggaggagggtgcgtgccccactgtagtatgtctaatacgtaatagatggtgttcacagcacgataaggccgtaagcagactgttctgttggggcagtttagagatagcaggaaaagcttcatggaggaggtgacaattgaattatgtcttgaaggatgtgtaggagggtcccagacagaaaatggggattgtaggcagagtacaaaggcacggagctgtgagcaaggggagggtggcagagagctgcttggtgaggccgacacgtgtgtgggtgggtggtctgagtgggacaggtggaggccggccttggtgggcccctgtaggagtggaagtggaatgccatagagtggggctctggagcctggacttcagcaggtgctgcccccttgaggctggggcctggccccccgcacagactgtagcccaggatagccttttgtatgaagttgggggtcccagggtcactctgtcttagccctgctttggccagcaaggccagcacggtcggcagctttctctcaagcgggagttctgaatttatcctctcctgatgggagttctccctgtcacatcaacattgagtctgggggaatcacaaaatcattttcttcttttttttttttttcagagatggtatctcattctgttgcccaagccggagtgcagtggcataatcatagctcactccagccttgaactcctgcctcagcctctgagtagctaggactataggcatgcatcacgatgcccagctaattttttaaaaaatattttacagagatgaggtcaccctatgttgcacaggccttgagtgatcctcctgcctcagcctcccaaagctctgggatttatagccatgagccactgtgccaggctggagccccttttcaaagagggcgtggggcaaaatgcctgggaaaagcccattaggtataagggggttattccttgcttctcacaaataatccctttaactccctctcctattccccaagaatgggaatcacacctgttggaggaggtgataccaaaggtttgcatttgcacatgagggggtgccctgaagccaggactgggcggtcagtgcctccagctacacgttatcttctcaaactctttggccatccattctggaggagtttgttttgttcctctctgcagcactcccaagtgggacattctggggttaaagagccttggttacacatttccggagagattttgccctgttcacttatccatatggcatccctgaattccctctctgccctgttttctgcagctttctggaacattccactggggccccgcccacttccactgcatcacctgccactttgtgcagagcactggctctggagtcaggcagcattgggtctagttgctgcccttgcccttgactagcacgaccctggggaagtacctcactgagactcagtttgcttatttgtcaaatgggaataataatgcctgcctcaaaaaacccaaaccccagccttgctgggttgtgaggcttcagtgaggtgagaagcaattagcacagagcctggcacatgacaagggtgcaataaatgccagcatgactgcctttcacccgtatctcctgccaagcctgtctctcgagctttggattcatgtcttcaacttggcccagacttctggccagatcctccctcctgtgccaggtgctccgcatgacccaaaccaaacatatcacacccctcacagatctccctgccctgcttgtccaggggacaccccacccacccagctacccagccaggagcttgcacatcgcaccaaatgtctctgccttggtttgggttcttgccacatctcaatagcatctagcagtcagccattctgttgcactccactcttcgtgcccctctccacgaccctcctccctcatcctcgcattgcctatccgcctgacatccttgtgcacaactgggtgattcctaaacgttgggatttcacgggtctgtaaaatttcaaaaacaattctggggaccaattaaagttgctagctttttttttttttttttgaaacggagtttcgctcttgttgcctaggctggagtgcaatggcgtgatctcagctcaccgcaacctccacctcctgagttcaagcaattcccctgcatcagcctcctgagtagctgggattacaggcatgcgccatcatgcccggctaattttgtatttttagtagagacggggtttctccatgttggtcaggctggtcttaactcttgacctcaggtgatccacccacctcggcctcccaaagtgctgggattacaggcatgagccaccgtgcccggctggttgccagcttttaattttgctaagtaaggacataaaatgtaacaagtaagtgataaataactattagcatttaccatcaccataatttcataaaagaaaggatgcttggtcaggcgtggtggctcaggcctataatcccagcactttacgaggctgatgggggaggattgcctgagcccaggagatagagaccagccgggcaccataaggagaccctgtctttacaaaaaaaagttaaaaaaaaattagttgggcatagcagtgcacacctgtagtcctagctaagtgggaggctgaggtggaaggatcacctgagcccagcagttggaggctgcaatgagctatgattgcactactgcactccagcctgggcaacagagggagaccctgtcttaacaacaaaaagactccttaactgccccccacacccgccccccccaaatgaggaagggtgaaacctcaaaatgaggggcgcttttggcacccagacactgtggagatttgtacacacagccttttctgtacttgtctccactaggcttctctccacagaccatcccgggtggcatttgggacccagctggaggtgagtcatttctcctcaggaggctcctcagtgaggtttatttatttgtttctacacgaatagaggagcagtgatgagctgtctgttgggtggtttaaaggctgcgaggaaaggtgtgaagtagggtccccttgctcagcacgcaggagctgcctggcgccactgagcctgtgggtcccacggtctctcctcccctcttcctgtggctttgtggttcattaccactttaaccccagaaacctgagccgccagaggttactgggcattctctgggccacaggctgtgttgggggtcaggactgagagtagaaactttcttcctgaagcatctgtcttgagtatagtatggggagcctttaaaaaaccctaatgacagctgggcgcggtggctcacacctgtaatctcagtactttgggaggctgaggcgggcggatcaccaggtcaggagatcaagaccatcctggctaacacggtgaaaccccgtctctactaaaaatacaaaaaattaggcgggtgtggtggtgggcgcctgtagtcccagctactcaggaggctgaggcaggagaatggcttgaacccaggaggcggagcttgcagtgagctgagtttgcgccacagcactccagcccaggcgacagagcgagactcggtctcaaaaaaaaaaaaagccctaatgactgggtcccatttccatggttctgaggcaacaagcaaggtggagccttcaaggctccagacgaagctgactctggcggggtttggaaaactgctgaactgcacgagcatccatgggcagccatattttctatttagggctgccccatcttcttcttgttttcttcttttttttttagagatgaggtctcactatgttacccaggctggtttcaaactcctggcctcatgggattctccagcctcagtctcccaaagtgctgggattacaggtgtgagtccggcctgcccccatcttctttgtcttctgattttagctttcattctagtgcctccatgccctcaggtcatcctttagataccctgggctataagtgtgtaactgtcctctgctgggctgggaagaacgcaaaggaacaataaactgggtccctcccatgaattctaggttcaattcaggtcgcacttgctgtgcggccttgaacaagtcgctttccctctccgggcctctgtttcccctctgtacaattggaagagtggatgcattcttatacttcctctggtgctgctggtgtgtggtttcccccttactggtgatggcatactccaggaattctggaaaccctccctgacgccgaagcagggtcaccctctccccgcctccttgctagtccttactcctggcccagcgaggctcgtgatttttgtttaaaccattctgtggaattttagaattcttgatggaaaaatgatgagctgacaagaaaatgttttgaaatccagagcattccactcactgcctgttacggttaaggcccaggctttcgcttggatacttagcctcctcttgccttggggtttccgcagaaacactgttcccgtgcagggggagggagccgtgagggtgcctggtccacatccctgctgctgcaatgtgtactaaacccatacaggcaaatgaatatttatttgttatatattttttattgcaaaaaggtgcatagaaggaaattgaaatagtgcttatctctggtgatgtgtatctttccattttcttcttcctgtgtgcaaatatatagtattatgatatatactgtgttacacaataatcataaaaatatatttctttagaaagtttgaatcaaaatacatagaatttttcttgtcttgcattcttcatacagcattatgtcatgtcttcaatgtttttctaaaatatttttggccagacgtggtggcacacgcctgtagtcccagatacttgggaagctgagatgggaggatcactgaagcccagaagttaaagctacagtgagccatcatcatgccactgcactccagcctggcgacggagcgagaccctgtctcaaaaaatatataataattggccaggcacggtagctcatgcctgtaatcctagcactttgggaggccaaagcggatagatcacctgaggtcaggagttcaagaccagcctggccaatatggtgaaaccctgtctctactaaaaatacaaaaattagctgggtgtggtggtgggcgcctataatcccaactacttgggaggctgaggaagaagaatcgcttgaacccagtaggtggaggttgcagtgagccgagattatgccacttcactccagcctgggcaaaagagtgaaactccatctcaaaaaaaaaaaaaaaaatatatatatatatatatatatacacacacacacacacacacacacacatatatatatacacacatacatatatatacacatacatatatatacacatacacatatatatatatacacatacatatatatatataaaataaattttaaaagtttctgcattatgtagttatgtcataatttctacagctagtcccttacggttggatatttggttatttccagcatgctgttttttgttttgttttgttttgttttgttttgttttgttttgtttttgagacggagttttgctcttattgcccatgctggagtgcaatggcatgatctcggctcactgcaacctccgcctcccgggttcaaacgattctcctgcctcagcctcccgagtagctgggattacaggcatgtgccagcacacccagctaattttgtatttttagtagagacagggtttctccatgttggtcagggtggtctcgaactcctaacctcaggtgatctacccatcctcccaaagtgctgggatgacagacgtgagccaccgcgcccagcccatgctgttcttttaaataacattgagatgaactttttttttctgatgctgaagcccctgagacaggactccagggcccatgaatcactaataatgagcctttcttctgtccgcagaatccaggagtcctccagctgagaacgaggtgtccacccccatgcaggtgagctcctgttcttgtaaaagggtcagggctgcagcacctcgtgtttaggagtgtgggctgatgccagaccgaatttggtttaaatccagttctgtcactagtagaaatgtggtcgtggtgagttacctgtgcttttcaaacctctgtgaaagggaatcatagaaattatcttgtcccaggactgtaaggagtggagcagcgctggcctggcgtgcagaactgctctgcgtctagcagctgctatttcatctctgagctttttggacaacgctaatggcttagcttgagattggattctgtttatctgcatccttcccctgtggactcttggtgacataatttgctggaaagaggattacctctgaagctgcttaacaaattccttgagtaatccaatttcctatccaactatatctcctcctgtggcccttaattccctaaatgctaagctgggagtcatagccacttctggagctgtgcggcacagggaaggagcctggggctcttgaaccttatctgtgttccatgtaggaacagctgcaggtgaagcccatacccatggggctagagtgctcccaacacgggttctggggaaactgacaccgactgaggactggccacatcctgctaaactgtgagccttgcatttgctgtttcattggctccttatgttaacattgcaagggagtgcttgtaagggctttttttttttttttttttttttttttttgagacggagtctcgctctgtcgcccaggtgggactgcggactgcagtggcgcaatcttggctcactgcaagctccgtttcccgggttcacgccattctcctgcctcagcctcccgagtagctgggactacaggcgcccgcgaccgcgcctggctaattttttttgtatttttagtagagacggggtttcaccttgttagccaggatggtctcgatctcctgacctcatgatccacccgcctcggcctcccaaagtgctgggattacacgcgtgagccaccgcgcccggccttgtagggcttcttaacgtgagttaagtctgaggccagggccgggcacaggggctcacacctgtaatcccagcactttgggaggctgaggcaggcagatcacctgaggtcaggagttcaagaccatcctgaccaacatggagaaaccctttctctactgaaatacaaaattagctgggtgtggtggcgcatgcctgtaatcccagctatttgataggctgaggcaggagaatcgcttgaacctgggaggcggaggttgcagtgagccgagatcatgccattgcactccagcttgggcaacaagagtgaaactccatttcacaaaaaaacaaacaaaaaaaaagaagtctgtccaaggtgacatagctcgtaagtggtggaaccagcattccagtcatggtagtacctgcatccttgcatcggacctgtaaggacaacagctgcttcagtgtatccactgagcatcttctctgtgcagctttaagcttttggtggagaggcaggtggaaagaaagccccacctttagcaggcatggtgtggatagaaaaaatgcaaataatagtattattgatttttccactgttatgaatgaaatggagaaaggaatgctttgggtggatcagggagggctctgaggaggaggtaactcctgaactggttctgaatgatggtgcaatctgcagaaacaggctgatggtgaggaatgtctcttttaggcacttactactaataaagacgatgataatattctcttcagagattctgcaaatgcgacaagcctcccaggtaaggactgggtattttcatattcccagggtccgagggacagaagatttgtctctgcagaaagtcctttcttatttggacatgtcgtcagaggatcaatcacagatcaatcgcagaaatgttctgtgtgtgtgtgtgtgtgtgtgtgtgtgtgtgtgtgtgttggagagagtcttgctcggttgcccaggctggagtgccgtggcatgatctcggctcaccacaacctctgtctcctgagttcaagcgattctcctgcctcagcctcccaagtagctgggattacaggcgcatgccaccatgcccagctaatttttgtatttttactagagacagggtttcactatgttggccaggctggtcttgaactcctgacgttgtgatccacccacctcggcctcccaaagtgctgacattacaggcatgagccaccgtgcctggccagaaatgttcttttattactttatatgttgaactttgatattgttagctaagatataatgaggagaccgtaagaaaagtgggacaaatcacttcgagatatttgaaaagtgagatatttcacagttggcccacaatacaaatgaatgtgctgcaaacaagattattggagtctgaaatggaatacctgttgagggaaatctttattttgggagcccttgatttcaatgcttttgattccctatccctgcaagaccaggaaagcttaccagtatttgaatcaagaaagatcacaagtcctgtgtttgactaggtatatgggacttatggaatccagactccagaggttcagtagttgagcagctcccctgatgactcttgggcttcgtgaggcagtccttgccctcgttccccatccctgggtggattcctgcctgcactgatgctggctgcctctgctacaacagcccaggtacaaagccctaccatggtgcagtgcacctgtggaggacctgctaaatacctggggctgagctctgcacagttggggactcggagaggattagagccatccctgttctcaaggaggctacagtccaggctctgacaaagagtaaattggtaactgtgacaaagaccagcatgtgagatgggccaaaagggaggcacagataaagcaaagtggaatttagagatttgaaagagtatatcaagctgagcagtcacagaaagctcatggaggaagtgccatttgaaatgggctttgaatggtatgggtgggatgcaagaggttgggtgttcaaaggttgctatgggccgggcgcggtggcttacgcctgtaatcccagcactttgggaggccgaggtaggagaatcacctgaggtcaggagttcaagactagcctggccaacatggtgaaaccccatctctactaaaaatacaaaaattagccaggcgtgatggcaggtgcctataatcccagctacttgggaggctgaggcaagagaatcacttgaacctgggaggcagaggttgcagtgagctgagatcgagccactgcactctagcctgggccacagagtgagattccatgtcaaaaaaacaaaacaacaacaacaaaaacaaaagctgctatggaggaggggaacctccagtcctcttcgtccaccctcactgatgattttttttcttttttttgagacggagtctcgtcaagcgattctcctgcctcagcctcccgagtagctgagattacaggcatgcaccaccacgcctggctaattttgtatttttagtagaaacggggtttctccatgttagtcaggctggactcgaactccccacctcaggtgatctgcctgcctcggtctcccaaagtgctgggattacaggtgtgagccaccgcgcctggccagcattctcaaatttaacatgtctaaaagagaacacctgacgcctccccacctattcaacccagatctgttcttctccatcttccctatctcagtaactggtaccgcatttgctcaggtgcgggggatcgggcaggcttcctccctactcctcatcctgtgtccagtccctcagcaagcgttgtccttgtgctttgagacgtatctaggaattgaccactcctcaccatctccagtgccaacacccagtccagcccctgccgcctctcatccagcagggcttcctgggctgccaactggtctaccaacttctagtcttaacccccaaccaactcttttccaaccagcacttagagtatcccttaaaacacaaatccaagctctctctggctcagtaccatctcccccagagtaaaagtcaaagtcttgacaaagtccccagtttctacgaggagtcccagcaaagccatgtggtcccctatctttagacgttgcctctccattctccctttcctcgctctgccccagccacactgccctccttgctcctccacacatgctctacctcagggcctttgcacttgctgtgtgctctgcctggacacgcttcctctgacattcactttgccagctccttcctattactcaagtctctgctcagatgcacccttctccgggaggcttttcctgataatttttttaaaaaacatttgtttggccgggcgcggtggctcacgcctgtaatcccagcactttgggagccgaggcaggtggatcacgaggtcaggagatcaggaccatcctggctaacacggtgaaaccccgtctctactaaaaatacaaaaaattagccgggtgtggtggcgggtgcctgtagtcccagctcctcgggaggctgaggcaggagaatagggtgaacccgggaggcggaggttgcagtgagccgagacagcgccactgagcaagactccgtctcaaaaaaaaaaaaaattcatttgtctgtctcccttgattggatgtaagatccatttagatacatgataggcactcaaagaatatttgttggatgaaagaaggaacaaatatatggccaggcgccgtggctcatgcctgtaatcccagcactttgggaggccgaggtgggcggatcacctaaggtcaggagttggagaccagcttgggcaacatggcaaaacctcatctctacaaaaaatacaaaaattagccgggcatggtggcatgtgcctattgtcccaggtacttgggaggctgaggtaggagaattgcttgaacccgggaggcggaggctgcagtgagcggagatcacaccactgcactccagcctgggtgacaagagcgagactccatttcaaaaaaaaagaaggaacaaatagaaaagatgatgaaatgttaataaatgagcaagccaagcatactgctttcattacacagctgcatctctcaagagacatgggacatgcttggagaaacttgtctttgcagccagcgcccgctcaccagtctgggctctctgcgctgcctgactctagtaggcatctgaagtgatggctggcaggcagcctcttcgtcagcagtggattgcattttgggtagaagagcctgaatgctgggtccatacaactgtgactgcattcccagcagaaggagatggttttgtttagatgtgccctctgtctagtccagggactctggcagtggtaggaagagcctttctgtgggaagacatggctgcttgcaaagctggtttgttctttccttcattcaaagaaatattttggcgatcctactttgtattcggcactgtgtaagctgctggcagtgttacagtgaaaaagacacatgtggtccctgccttcagggaactcagtctagaggtggaaatggagaaatactgggaggggcacttgctcagcttggagtggggtcaattctcaaaggaaatgacatcacctcatctgagatccaaaggccaagtagggactagaccacaaaagggtgcagcaaaggtagagaaaacagacaggagagaagagggaacgtgtgtggagagccctggaggaaaaagatcatggcttgttggagaactgaatgaagttcatatggctggggcttgagtaccaaatgcagggacaggcaagagatgacacccccatggagaaaactgcttccaaacacttgatttaaagcatccaatcctctctgacattgtcctcaaaggaactgccatcaaggaggtccccaaagccttccgtttgttgtaccctctttgtgccttgtgggagcaggtggaatgtcaccagaaaagccactctgaaagtgagtaggagtctgtggctagccacaggcgctcagaaaccctgagcttgaggtgtctctcttgccaagtggtggaatcctggaatctagagtgggctttgttaagaaacaaacaaacaaacaaacaaaaaacagttaagcttgtcaaatggcctgttggttggcagagctgtttcattttctgggaggggggttggaggggaaggttcctttgaggcttttgacagcaccagctaagtggttttcttctcctcctattcctttttctccatattctcctcttcctcctctatcttcaattttttttttaacctagtgcaagattcttcttcagtaccactgcccacattcctggttgctggagggagcctggccttcggaacgctcctctgcattgccattgttctgaggtgagatgggtcccaggggatggccctgtggtgttctcatatttcttatctagctttcctttgcccattctgaaatttatggtgcatttattcattcatttatccattcatcaaatgaatgcacacaccacaacacacacaacacctactattatgccaagccgtgttttaggtgctgcaggagacaatgctgggcaggacagatacagtctcaggaagaagtcagacacgaagaggtaatcactactgtggtaagagctacaaaaagcatgccatggtgaggagaactgacctggcattaaggaggaagaggaattggtctgagaaagaagagggttctttttttttgagtcagcatctcactctgtcacccaggctggagtgctgtggtgcaatctcgcctcacaggacaacctctgcctcctaggttcaagtgatcctcccacctcagcctctggaatagctgggactgcaggtgcacaccaccctgcctagctaatttttctattttttgttgagatgaggtttcatgttgcccaggctggtctcaaactcccagggtcaagtgatccgcctgccttggcctcccaatgtgttgggattacaggtgtgaactaccatgcccggcccaaagagggttcttaggagagaagcccagcatgtaatatggttgacagcgtgtgcatgcacgtgtctgtgaagggggcgcagcacggttggggcaatatggggcaggaagagtggacaggtaggctggcaccaggtcataaaaggccttgaaagaggtgggaggattttaggccttctcttgaggctaaggagtgtctgttggagtttttttctttttctttttctttctctttcttttcttttcttttttttttttttttgagacagagtcttgctctgtcgcccaggctggagtgcagtggtgcgatctcagctcactgcaaccccaccttctgggttcacaccattctcctgcctcagcctcctgagtagctgggaccacaggtgcccgctaccatgcccggctaatattttgtgtttttagtagagacagggtttcaccgtgtcagccaggatggtctcgatctcctgacctcgtgatccgcctgcctcagcctcccaaagtgctgggattacaggcgtgagccaccgcgcccagcctgtggagttttaagaagaacctgggccaggcgctgtggctcacgcttgtaattccatcactttgggaggctgaggcaggtggatcacctgaggtcaggagttcgagaccagcctggccaaaatgataaaaccctgtctctactaaaaatacaaaaatttgctgggcatggtagtgcttgactgtaatcccagctactcgggaaactgaggcaggagaatcacttgaacctgggaagcggaggttgcagtgagccaagattgcgccactgcaatccagcctgggtgacagaatgagactcatctcaaacaaagaaaaccaaaaagtcactctcaatgcagtttggagactggatggggtgagtgaaaatggatgcagtagcccagggtctgggcaagagataataataaactgttttaggatggtggcaatgggttggagagccatgaatagattcttttttttttttttttgagatggagtttcgcttttgttgcccaggctggagtgcagtggtgcaatctcagctcactgcaacttccgcctcccgggttcaagcgattcttgtgcctcagcctcctgagtagctgggattgcaggtgaatgtcactacgcccggctaattttttgtattttcagtagaaatgggatttcatcatgttggccaggctggtcttgatctcctgacctcagatgatccgcccgcctccgcctcccaaagtgctgggattacaggcgtgagccactgcacccggcctcaagatatattttagaggtagaattgacaaggcttgacaacagattagatgaggaggatgaaggagagggaggagtccgggatgaccctcccatttctggcttcagcagttgggcagatgatactgtcattcactaagactggaaacacctgaggatagacaagtctcagtgaaaagtggtgattccactttgggacccacttgagtttgagatgccccgagaacctcaagcggacacgcttggcaggcaacacagatcgtcaccagcaagtagatggcaataagagtcattgggtgggggttggggatagggctgaaccctgtggggatccaaggtgaaaagttctgtagagaaggaagtgttgggaaaggggctgagaggaaccacaagattctggtgttgtaagaacgagagggagggagtgtgcattagacactgaagaaacacagtaggtgttggaattacaacatgaatatgacctttcctcccttccgagaaccacatactcaaatgatgaaaataccatgtgaaggtattttcatggtagctaacgcctgtaatcccaacactttgggaggccgaggcaggtggatcacttcatgtcaggagttcaagaccagcctgaccaacatggtgaaactccgtctctactaaaaacacaaaaattagctgggcatagtggcacatgcctgtaatctcagctacttgggaggctgaagcaggagaattgcttgaacccaggaggcagaggttgcagtgagccaagattgcaccactgcactccagcctggacaacagagcaagactccgtctcaaaaaaaaaaaaaaaaaaaaaagaaaagaaaagaagaaagaaagtaacattggagaagcaccacacagttaaatccaaggcgcccaagcaggacctccttaggaatattccatgtatcaatccaggaacttaaaggtcacctttaaatgctctgccctagtgttcttttccagccatggttaggaaatactcattcaggctgagttgcaccctggctgctgtctcatcatgcccatttcatcccaatcatcttcgctccatttggtcattggttttgtcattcatttccaagtctgcagaaaagtcagccaatagtgccttcagtgaacaagcaataatgaaatttttcggtgttcacaattttactgcaggaaccggctttttttcataagctgaaaccctaaaagatgtcaggctgggtcttctaggcagtggttaatcgcgatgatctacaagtggaggagacattgcactctgtcctttctacatgtagagagctttctacacgttagctcatcagaccctgccagtagccctgacctagcttgactaccaagtgtggtgtgggttgaaagattagcaagatgactactcaaattgggttcagggttgttttcactttttttctttttctttttctttttctttttttttttttttttgagacggagtctcgctttgtcgcccaggctggagtgcagtggcgcgatcttggctcactgcaacctccgcctcccgggttcacgccattctcccgcctcagcctcccgagtaggtgggactacaggcgcccaccaccacgcctggctaattttttgtatttttttttagtagagacggggtttcaccgtgttagccaggatggtttcgatctcctgacctcgtgatccacccgccttggcctcccaaagtgctgggattacaggcgtgagccaccgtgcccggccttcactttgctttttcaatgaagtagattacaagccgtctgaagggtgcgtgcaagataagattcttaatgagtagaggtagctccttggaggatgcaaagcctgttatattttttggccagtgaggggccatgtcagcatccacgggttcacctcctgcctaccaaaggattccttgcctcaccctaggtataccctcctgtgttctggctctgtgtctacgttagggcttcaacagacttttctcataacccaccacaggccctatagagtagagtagatatgatatacatttgacgggaggaaactgaagctaaaagagatggtgcgataacagctagtaagaataggccaggcgcggtggctcacgcctgtgatcccagcactttgggaggccaaggcaagtggatcacctgaggtcaggagttcgagaccagcctggccaacgtggagaaaccctgtctctactaaaaatacaaaaattagctgggcatggtggtgcacacctgtaatcccagctacttgggaggctgaggtaggagaatcgcttgaacccgggaggcagaggttgcagtgagccgagatcgcgccactgcactccagcctgggcagcagaaggagactccatctcaaaaaaaaaaaaaagatgaagaagaaggccaagaatcaaaccaaaaactcctgctatttctatagggccttaagggtcatctagtcaaactctttcattttataaatgaggaaacagcccccaaaggtaaaatgacttgcccaaggacaagcaagaacacacaccctgagagtccctgcccatggtccccacctgctattggctaagagctgggcccagctggtcccattggcccaccactggcccttaacatgcagcaccatcttggtgtgttgtaatggctaatagaggagcattaggttgggaacagacctggtttgctattctgctgatgatgcttggacactggctggttgctaaacaaccagagtccctgcaggcacagacagggccagtgccctgtgctgagaacatgccaggaatttattttctagcctagtgagtttccattttcttctgtataaggcaaatttgtttggaaagaggccagttatttcaagtgatgaagaagccttctattccccaaatcccctctgtctagcaaagagtataaacttagaaatactgtggggctctgggctgccaaaatggctgaaccatggttaccatgggatggccacatttacagtaggtgaagtgtgagaggttgacttcatcctgccagtgtatactatatttttttgtatggccctaaatctttttccagcaatatcagtgatttttttctttgttttttattactcattctttttttctgaatcatagatgattttttaaaatttaaatatgctatcgaaaaggcttgccatcttacaggggccaattcctcccaccctattctctgtcccccactgattctctgtattttaggttatcaggcactgggaaaatagaattctcctagtagagaattatttttctgcatatttatctagaatgagcttacatcattaagtgaggacttcctatgtgtatgcctatgacttaaacatcatttcgttttgaatgtagtgtatcattccggtattttaaaatcagagcttttgctacctccacagctgggggacgggcagagggactttcatggtgttccgggccatggaggtggctgggtgcagtgggcactgtctgtggcctttggggtaaaaggggtggcaacttggtttctacatatctttctaaaaaagagtgagagttttgagcattttaaaaaacttcttttagctacagaatcttttctttaaatgaaactttttgaagcccaaatatgtaaaatagataaaaggtggaggtcaaggtgcaaaagaaggcagcagagagctcatctgtttcttctttctgcccaccctgtgtcctctccagcccccaggccctgctcacacccatccaggccagctctggacaccctcaggttggctggtttcaaagtcctctttgagtttagtgattttcagaaaagaattcatactcgccttagaatatttcaaaaggaaagctcacctttctttgttacccattcagttactttgaaaaaaaaactgaggacagagattgcttccatattaggtcaatagggacttaaaaaatatatacatacacacatacatatgtatgtgatatgtgattattactggtgatttgctaaataatgacaaatggaaaaaaatatatgtcatccaaagagagccactgttaattttcaaaatgtaaatgtgattgaagtctaacaaacatacagaaaagttcccacatcatgtgtacagcgccatgaagtgtacacacccatgtcattataatgagatgcacgtggcaagtcaagatgccaagacaccaggttgcagcagagaaagaggtttaatcagagggtcaccaaaggaggagatgggaggaaacctctgtagggtccagccgtacggagcttagcgggtgttctccccgtgtgtggagacgagagattgtaataaataaagacacaagacaaagagataaagagaaagcacctgggcctgcgggaccactactatcaagatgcagagaccggtagtggccccgaacgtctgggctcgctgatattttttgcatacaagacgaggaggcagggtaaggaaggtaaatcttctaagtgattgacaaggtgaagcaagtcatgtgattacaggatcgggggcccttcccttttaggtagctgaagcagagagcaggcagcatatgtcagggttttcttctctgcacttataagaaagatcaaagacttttaagactttcactatttcttctactgctatctactatgagcttcgaagaggaaccaggagtgcgggaggagcatgaaagtggacaaggagcatgacccttgaagcacagcaccacagggaggggtttaggcctctggatgactgcgggcaggcctggataatatccagccttccacaagaagctggtggaggacagtgttccctgactcctccaaggaaaggagactcccttttgccggtctgctaagtaacaggtgccttcccagacactggcgttaccgcttgaccaaggagcgctccagcggcccttatgccggcatgacagagggttcacctcttgccttctaggtcacttctcccaatgtcccttcagcacctgaccctatacccgccggttattcctaggttatattagtaatggaacaaagagtaatattaaaagctaatgattaataatgtttataataatgattgataattgttcatgatcatctctgtatctaatttgtattatgactattcttattctattttctttattatactgaaacagtttgtgccttcagtgtcttgcctcggcacctaggtaatcctctgcccacacctcaaatccatctccccaaggaatttggggctagggttgtaaaaatgttggactgggccaaagtgtggagatggttgactggttgcagggtgtagggtgaggtcctgggacaaggagatgaagaagctgtcttctcatgccaatcccgttcctctgtgagggtcttcaaactggttgccggaattaggggtccgtaaaacatcttaagtgatccttaaacaaaagtcttaggatcctaatgtcagaaatcctatctacagaaacaacggggatgcagatggtcagtgtctagggctacgtgactttttgcaataaggaaatgggccaaagtgcagcctgattactgcttcattataactattaatatatttctgtccagaacccagcatgcaatttttgtcaaccctgtggagatggttttacaatcaacacccagatcaagaacacttaatatttagacaaatctcctgagtctttttcctctgcctagtttcttgtttgtttttacacagccatgattattctgtatcctcagctctgcatcctgcctttcacacttagcactataacacaggcattctttcacattagtacaaattcttgtaaatctcagacttttttttttttttttgagacggagtttcattcttattgcccaggctggaatgcaatggtgcgatctcagctcactgcagcctccgcctcctgggttcaagcagttctcctgcctcggtctcctgagtagctgggattacaggcgcctgctaccatgcctggctaatttttgtattttttaatagaggtggggtttcacaatgttggtcaggctggtctcgaactcctgacctcgttatctgcccgcctaggcctcccaaagtgctgggattacaggcgtgagccaccgtgcctggccataaatctcactttcattagctgtagtattaggtggatataccaatttctcttaatcaacctcctattactcctaattggtggcacccaaacattaccaattatttgggtgttattttgcttttatttaattaattaattaatttatttatttattgagacacatcactctgtcacccaggctggagtgcagtggcacaatctcagcacactgcaacctctgcttcctgggttcaagcaattctcctgcgtcagcctcccaagtagctgggattacaggcatgcgccacgacacccggctaattcttttttagtagagacagggttttgccacattggccaggctggtcttgaactcctgacctcaagtaatccacccaccttggcctcccaaagtgctgggattacaggcatgagccaccacacccggccttattttgcttttataaaaaacactgtgttgaacatctttgtgcataaagggtttttttttttttatagctatgttctttcttttcccagaagtagaattcctgggtcagagagtctgaattctttgaaatccagagtgtaatgattctctcctcagtcctttcttacaggagaactccattcaatgactcagcatagctccagtcagcagccctgctgggctctcttcctgtgtggtgtccacatggtgaagccctaaataatattctgcagattgtttatttcatttggataccaagctaaaagccagtggcagatttggagccaactattaattatttatcataacaaggacaggaataacctgtcgatataaaaagaaacccaaggaaaatccccaaatcttgtttttgacattggtttcccctcctctttcccagcccttcctggagtaactgatcttccatggaattgagggaggccaccttgttcccactttggggttaggaggcatgtcagtcacaaagtgggaagcaagagggaggggctgaggcttggggcactggccaccctggcacagttgaagggcccctttaggaaggggacgtgactgtgcttttgaagatccatgtcaccatttcatctttctttgagctgtcaagtgacttttctcagttactgagccctggctttgggcccagagtggagcactgtgaaccaagctgtgatcagaaagatgtctatctccttcctgtgtagcattgactttcctgtcagatgagtcaaattgtgcccagtggtgccgacagttgagtctgtgggaactcaccagcatggtgggagtggaccgagaggcgtagggagaactggggaggtcagcaacattaggagcaagaggaacaggaaggcagttgagggagcagtgggacccttttcctgctattacatggcggttgcaaattatctgcctcctgccagccttactttgaccgagaggcccattttctttccctactaaaagaatgctttctttttttattttctttccttttctttttttttatttttgagacagagtttcactcttgttgcccaggctgaagtgcaatggcacgatctcagctcactgcaacctctgcctcccgtgttcaagcgattctcctgcctcagcctcccaagtatctgggattacaggtgcctgccactacgcctggctaatttttgtatttttagtagagacggggtttcaccacgttggccaggctggtcttgaactcctgacctcaggtgatccgcccgcctcggcctcccaatgtgtggggattacaggcgtgagccactgcgcccagcctatttttcttttttttaagtaaatggatttgggactgatgatgtgtacctaatgaacagcctctgcaatgggacaattaagggactgttaagtgactttttggtgcctcagtttcttcacttgtaaattggaccaacaatacacatctatttccttgggagtgttttggaaactcaccaactcttcagagtatggtgaactccctggtgataaaaacagtcgggtcgggtgtgccggctcatacctgtaatcccagcactttgggaggccgaggcgggcggattgctcgagcccaggaattcaagaccagcctgagcaacatggcaaaaccctgtctctatgagaaatacaaaaatcagtcggatgtagtggcacacacctgtagccccagctactcaggaggctgaggtggaagaatcacctgagcccaaggaggttgaggctgctgtgagctgagatcacgccatagcactccagcctgggtaacagagcaagatcctgtctcaaaacaaacaaatgaacaaaaaacaaaaagacagctgatagttattgctcctttgagccgaaacctgggcgcgccaggccaccagggcagccagctgttggtgttttccactgtgggcttgtcacagggggagctaaaaatctgtgtggtttgtctttgtgtgtttgtgtgaaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgataaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggctagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgtgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaatatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctgggtaacatagtgagacaccatctctattatgaacaataacagttaagaaaaaaaaaggcaggcaggcggttatggtggttccctcccatcccaccacataaagtttctgagacttgagaacagcaaaatgctgttaaagggaaatattaagaatgagaatctgcagtaagggtgattctgtgcccacagttcttcaattctttataccgttttacccacatgtggtgttaccaaagccgggcagaaccatgctagcggaagatgtgaaatccagatagctcattattgccaagagctaggcagctttgatctccaaattgttattgctttcatttttattgtaatggaattgctttgttttgtttttttgtttttgtattgaagagggttgttttccctttatttttcataagctaatgtaaatgaagaaaaaatgtcttctctgggctgtaggcctggctcagcgtacacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggcacttccctgctgtcttgggagaaaggaaactggttgccgcggcaggttgtggaatctgttgctggaaccaggctggaagcccacctggtagtgaacagggcccagtggggcaggctgggcatgttgtggtctatgggtttgtttcctggagaatgttcaggaatgtcttcccagctgctttggtgctgagctctattatctcacagcacgtccagaaggctaacccaggtggggaggatgctgacaccagctccaggtggagttggtggtcttaatttggagatgcaggggcaacctgtgaccctttgaggcaagagccctgcacccagctgtcccgtgcagccgtgggcaggggctgcacacggaggggcaggcgggccagttcagggtccgtgccaggccctcctcagtgccctgtgaaggcctcctgtcctccgtgcggctgggcaccagcaccagggagtttctatggcaaccttagtgattattaaggaacactgtcagttttatgaacatatgctcaaatgaaattctactttaggaggaaaggattggaacagcatgtcacaaggctgttaattaacagagagaccttattggatggagatcacatctgttaaatagaatacctcaactctacgttgttttcttggagataaataatagtttcaagtttttgtttgtttgttttacctaattacctgaaagcaaataccaaaggctgatgtctgtatatggggcaaagggtcagtatatttttcagtgtttttttttctaccagctattttgcatttaaagtgaacattgtgtttggaataaatactcttaaaaaata

SEQ ID NO: 107 - DNA, 59899 bp, Homo sapiens
actggggtggcgcgctacctctgcggagaaggatctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgaggtgaggaggggccgggtgctgggtcgcgtagctggagttagagtgtcggtggtttcggacgggctatctggcactcgaggagacctcccttccccctgagagcagcgcccggaacttgtcagcccagcctggaaatccccacattccttccccttcctgctcccggacctccgaattctacttccacaactttgtcacctcgattatcgcagccctgagtacaaacttcacccaggcgcacgcacgcacccctcttaacgcccgccccgcagaacgcccttcaagaacaaacccccctttttgttaccagatcccacgtttttcccaatccccttttcatctcccctgaaattctattcgctccgcacttgtcttcattctcgaggtggatttcccttccccaaagccgttttttcatcttgaaatcgtaacgtttcagctttgttgaaagttcacaatgcttataaacactattaacgtttctttccttcttttgatcttttctattaataattatcattcctaacgaattccacatctcactgtatcccaaggagaacaaatcagtttttaaaattttacctcctccgacctaaacttttgaagatagtgcaggaagcaagggtctgttcttcagtggatgaacagcattttatttcataatccgaaactgaaaaaaaaaaaaaatcacaggttaaaaataagacgtcaccttttttttttttttttttttttgccttcagaaggaaacgcattttggcttagtttgtgaagtatttcaacaattatactgccttaaaataactagttattagaatgccagggtgaattttctgaaagattgtggtatttgcttttgacagtgctgtaaacaaaccctttaaactgtgtatgactgccagcttcaagttggaacaactcttaatttgaaattacggactcagatcatcagtttagctgtgtgccattatgttaatttcttaaattcatgttaattcctatttggaagtatttttgaactatgaactgaaatattacatttatagaaccaacttgctattaaattgtgctttccaactatttctctttagggataatcttgaacgtttgtttttaatcttgagtgaaagaaaaaaattacaggaaggagaaagtgtcaaaaaggacagactgtagtgggatttttttcttattttaagtatgtattgacaataccagtttaattttctcacaggcaatttagattattataaatactgctgccacctaatttaatataatatagtcttacgtaactaaaaatgttgttctcactcttatttgtgaattgcagtattttcaatttatttaaatttgtttccaaggctttgcacttcagttcagtgttagggcgaaagttaaatacatgtgaagtaggtgttaaaatgtcccctttatagagaaggaaacaggagtctcgctgaaaactagatctgtgtgactccaaatcctgtgctctgaatcattttgtcatgttgacacgtttctcataaaaaccccagtgccacaatttggtttgggaacttaagggcaacccataaatcctctacagtggcagggagggattccccgctccctcctttcagagctgctcattttaatgggagtcagaattctctggccctaatacatttgcagcttggctcctagagaagcatggaatgttctcacagcttctccgtttctttgattgcaaaggcagaatgatcagagttgaggttcctattgtgctttattattttacacagcaaatactaagcaattactacctgctgtacgaactcacaaaggtgcaggagatgtaatcaggaccttcaaagagtttataataattggattgacaaacttatacgaaaaaaactacaaggatgcaaagcagttttaattaaatgcagagtgatgcagaaaatcctgtagatattaaaattagggaatgatcgtttaaggattggagtgagcatttaaggattggaatgagcaaaggatttaccagaagttggccttgaaacctgggtaggatttggataaagggaaaaatgaagacagcccattaataatagcgaatggaggacaaaatgtagaatggagaatatagaacataatataggactagcttgtggaaaggatcagcagtaactaaggtctattaattaaaacaggcaatatatttagtgcttatgttgtgccagttgctgttttgagcactttgcccatattaaggcatttaatcttcataatattatgaagtaggtctaataataataggataaaatcctctttttacacatagggaaacccaggcacaagaaggttaattaatttgcccagctaagtggtagatctaaaggtcatacatagacagcctggcttcagaatctgacctcttaaccatgatacatcctgcgtctccatacagtacgcttgagcgacagcgagtagatagaaaataagatcataccagaaagtctataaaaacccacccttaattgtccaccaggtgcctcaaactatggtagattctgaggatatcaagatatgtgaaacaattactgtgcagtgttctgagtcctgttagggaatgatgtaagagtacactgacagcaaagatgtttgaagtggggggaaattccatataagagatgatacttcaaaagcagtttgtagtgcacagcagagtcaggaaagacattggaataatatatgtagaagcacagactgaaagaacaaggtatgttagaggaagtctagtggtttgctgagtctacagggatggttagtagggagtgatgaaagataagaccgaattataaatggcatggtgtggtcaagcaaaatgaggagcttaagtatttgctttgcagtttggaaactacaagaataatttcagcattattggagtaaaaaagccagattgcttgcaattgcaagcagttctctctagaagtatagtagtaaggtagcttgagggaggagtctgaggaaaggatttttttttttttttagaatagagaaacttgagtattggaaaagatagattggataggcacatcaaagccaaaattttaggttcttaaatagttagaatatttggcattattattcaccctttaaaaagctgttgaggagaagaatgacaggtttaaagttgtgttgtagagagagtgatccaccaacaatgttcagaatgcttggtggggaggaaagagactggaagcaggaacacagttgaaattattgaggtgatcaatgtccaaattaggttagtttgtggtagagagtaaaaagaagagatgggtgggaaagatattatgggagagaagacaggataagatttgtaactgagaaaagctaaaatgtactgcatagatgagagaaacgatggactccattgacttaggcagttgaagaggatgagttgtttgtagatagggaaaaatggtaagtccttgtgactttttaaaaagtgtgtgggcattcatcccattactgggcatatacccaaaggattataaatcatgctgctataaagacatacatgcacacgtatgtttattgcagcactattcacaatagcaaagacttggaaccaattcaaatgtccatcaatgatagactggattaagaaaatgtggcacatatacaccatggaatactatgcagccgtaaaaaaggatgagttcatgtcctttgtagggacatggatgaagctagaaaccatcattctgagcaaactgttgcaaggacagaaaaccaaacaccgcatgttctcactcataggtgagaattgaacaatgagaacgcttggacacagggtggagaacatcacacaccagggcctgtcatggggtagggggaggggggagggatagcattaggagatatacctaatgtaaatgactagttaacgggtgcagcacaccaacatggcacatgtatcatatgtaacctgcatgttgtgcacatgtaccctagaacttaaagtataataaacaaaaaaagtgggtgggcatttatgtgtatatgtgttcatgagcatgtacctatggtgtattgtttttagacctcttaaattgataagactcagagacagaatatctaagaagatgaaatgtaactggaattaaaagaaagatccaagccaaaattcttgaaattattttgtttgaaggtagtagttgaagtcatgtcttcaaagaagttggtatttaaaaagaaaagtcgatgcccagtactttatctttgggtaccttcatagcctggagataaaagctagcagagaattcagtaaaggagacaagaaagaggataaaggaaagaattcaactacattatctggttacatagaaaccaggatataggagaaattcaagaaccagggatggtcaacaatgtgaaaggcttcagaaacacttgtgatatatatagtcaaaatggctacagtctcttcttcttcttttttttttaaactttgcggctatctagtgtatcttagtaagatttaataagaaattagctgattgatcgtgaataagagagctacattggctgaaaaatggctatagtatatagatgattgttttaaagctgtgtgtatacatatccagagcaggagattcattcctttcagcactgtaaatctgttgccctgttacatttggaatgttctgcctccaaagtttcattttcttttaagcaatcagcttcaccctttgctctaaggttgattgatctgctcagtctttttttgtttggatgttctgttttatgtattacccccaaccccaccccctagtgcaaagtgagttaatcagagctatgtttcagatagcatagctctggttagactggcatgctctgggattttgtcattggtaatcttcacttgacaattagagtcaaagatgatgtagagttcatatgtgtgctattttctctatctaggaacccctacccttattttaagactgggcgctcctggcccctgtctgaattgggtattttctgtgctcctgtggcactttgtgcatattctgcatctctaaactttggacttcttaaaggcaagaactatttatatggcttcaattatgtttgtaacggaataaaaattgaataaaagcttgagcttttatttcttaagcaatggtgagaacatggatgttcatcaaagtgctctgtaaaccttttcatttggctaaaatagtctaattttaaaaggccctaaggtcataagcatattctatgtgtttttcaatatgcttataattttgcttttgcatttaggtccttaatctggagagagagtgtatgcttatacatgcatgtgcacgtgcatgagtgtgtgtctttttgtctgatgaaatggggttcttttttttcttttttgcttatggagccagttgtcccaatactatttattgaatagtcctttattttcccagcaaatgagcaaccttttaaaaaatcagatactaaattcttatatacacttgagtgtgttttgttttgtaccattgatttagttgtctattcatttgccaatcagtgctatgtttactttacctttagactgccctttttttttttttctgcgagactttttttttttttgagacagagcctcgcactgttacccaggctggagtacaatggcaagatcttggcttcttagcttgctgcagcctctataagcccaggctcaagtggttgtcccacctcagcttcctgagtagctgggattacaggcatggtccaccatgcccggctgatttttttttttattttttttttattttttatagagatggggttttgccatgttgcttaggctggtcttgaactcctgggctcaagcaatctacctacctcggcctcccaaagtgctgggattacagccgtgagccactgcacccagccttctgttacattttctaattagttattactggtatgtaggagagcttttttttttttttttggagatggagttttgctcttgttgcctgggctggagtgcagtggcgacatcccggctcactgcaacctccgcctactgggttcaagtgattctcctgcctcagcctcccaagtagctgagattacaggtgtgcgccaccactcccggctaattttgtattgttattagagacagggtttctctatgttggtcaggctggtctcgaactcccaacctcaggtgatctgcctatctcggcctcccaaagtgctgggattataggcgtgagccaccgcgccagctggagagctattttttgatgatgttttgtttgactgttatgttaaactctaaatagtcctattattttttgatgatgttttgtttgactactgtgttaaattctcaatagtcctaatagtttgtcatgtgattctcactctttcttgatagatgatcatatcattcacaatttattttccatttttagatcttatttattatatttttgcttaagccctttagagcagtggtgaataactgatgacttcaagcatcttgtctgaatcttgacattaataggaacgcttctaatttttacctttaaacctatagatgcttattataggtttctttcttccttttttttttttttttggaggcagagcctcactctgtcgcccaggctggagtgcagtggtgcattctcggctcactgcaacctctgcctcccgggttcgagcaattcttctgcctcagcctcccaagtagctgggactataggtgcccaccaccacgaccagctaattttcatatttttagtagagacagcgtttcaccatattggccaggctggtctcaaactcctgaccttgtgatccacctgcctcggcctcccaaagtgctgggattacaggcgtaagccaccatgcctggccttgtaggtttcttatagtagtacctgtggcagcaacagcaagagctgcactaataataacagctgttaaccttttattgagtagttacaatgagccaaatgattctaagcactttatgtataatgagttatttaatcatcataacattcctagatgggtaggtggtggtggtaccccatgtttacagataaaggaagtaaaagtgaaggctatttaaaaacttgcctaagatgttaaaatatagggactgaaatttgaacacaagcaatctggttctagagtccctgtatcatctttgttatccttcaccaaggtaaggatggtctctttcagtcttagttttctgacactttgttgttatttttaagttttagatgaacagttgttgaatgttatcagatgcttttcaaacatctgttggaatgaccctgtcattttcctttggtctgttaatatagtaattagcagtatcttttctcattttgaactgtgcttattttaggctaaatacttgttagcattcacactttggttttgttttcaaatctatttagacttttctctaaccatactacaaaaaaatgttaaaggcagtttttcaggcccaaggaaaatgataccagatggaaatacggatctatacaaaggaattaaaagctctagaaatggtaaccacacgagtaaatatgtgccagtctcactctgtcacccaggctggaatgcagtagtgcaaccacaactcactgcagcctcgacctccaaggctcaagcagtcctctcacctcagcctcctgagtagctgggacaacaggcatgcaccaccacagctgtctaactttttattttttgtagaggcgagagtcttactatattgcccaacctgatcttaaacttctgggcttaagtgatcctcctgccttggcctcccagagtgatgggatttcaggtgggagctaccaatgtgaagttttaatatatgcaaaagtaaaatatatgctaaaatagcacaaaggtctggggggagaaatggaagtatactattatatactatgcctgaggtgacataatattacttgaagatagattgtgaaaagttaaagatgtacactataaacctaaagcaaccaataagaaaacaaagaattatagcttattagctaacaaggaaaagagaataaaaaataattaagaaaaataaatgcagaaaagtaaacaggaacaaagaacagtcaagaagaaaacaaatatgaagctgatagctttaaacctaatcatatcacaaattatattaaatgtaaatggtctgaacacccaattggaaagcagagattatcagattggatacaaccacatgctgcctaccccctaaagatgccacttaaatatgaagaaacatacagattaaacaaaaaagaatgggagaggatatgtcatgataacactaatcaaagtaagacagaattggctatagtaatatcaaagtagatttcagagaatgttaccagtggtaaagaagggcatttcctaatgataaaagggtcaatttatcaaaaggatctaccaaataacatagtttcaaaacacaacagggtaaaaactgcaaggagaagtaaatccacagttatattcagggatttcaatatccctttttgaacaatgatagaagtagtagtcagaaaatcagtaaggatatggaagatttgaacactatcaaccaaattcacgtaatgaccatttatgtaacactctaccagcagcagcagtgctttttaagtgcacacagaatattgatttcaagatttataaggctaaagtcatcacgacagtgtggtggtagcatataaataagcaaattgatcagtggaacaaatagagtaggagtcatcctaccttctgttttcataaagtactgttagaacacagccacccctgtttgtttatgtattttctatggttgcttttgtgtcgtaacagtagattggtagctccaatagagaccttatggctcacaaacctagaatatttacctcctacctcatacatgaaaagcttgcccaccctggaattgagagtagccaaatagacccacacctgtgaacaactgatttttaagaaagacgcaaaggcaattcacttgagaaaggataattttttcagcaaatagttttgaaacaattatccgtatatacaaaatgaactcaaatttcagcttgacaccacacataaatattaacttgaaataactgagacctaaatgaccctaaaactataaaacttgtaggaaaaaacctttttgactttatttttattttttatatttttttttttttgagaaggagtctcattttgtcacccaggctggagtgcagtggtgctatctctgctcacttgcagcctcctctgcctcccgggttcaagcagttctcttgcctcagcttcctgtgtagctgggattacagatgtgcaccaccacacccggctaatttttaaaatattttagtagagacagggtttcaccatatacccaggctggtctcgaacttctgaactcaggtgatctacccacttcggcctcccaaagtgatgggattacaagtgtgagctactgcgtcgggccctttatgattttagattaagcaaagacttcttagatacatcaaaaacacaaattgatgaattgaactttattaaaattaaacctcctattcgtcaaaagatactgttaaaagaatgaaaagacaagcatacaagaaaataatgcgtaaatccattttctaataaaggccagaatatcttcttagaactttcaaaacttaatgagaaaacaggaaacccagttgatcaatatgtttgaacagacacatcatcaaagaagatatagccaagcacacacctgccgtagggcctagccattccactcttcacttaccttctattttggggacacacactatgtgttagtttcctaggggctactgtaatagagcatccctttgttacagtatcccttacctgaaatacttagtaacagaagtatattggattttggatttttttttttcagtttgtgttgtatttgcattatatacttaaagttaagcatcccaaatcctaaaatctgaaatccaaaatgccagagctcaaaacgttttggaattagagcatttcagtttttagatttgggatgttcaacctgtaccacaaattgggtggctcaaaacaacaaatttattctctcaaggttttggaggctagaagtccttttgagactttggatagaatcttcctttgcctctcctagcttctggtggtagccatcgtcgttgagattccttagcttacagctgcataactccaatctctgcctgtgtattcacatggtattcttcctggctctgtctctttaaagacaccagtcatattgtactaaaggcctattatactccactataacatccaattaaatctgcccatagagtaacattttgtgctactggggttaagacttcaacatattttttggggggaacagttcagcccataacaaacaaaaagaaaattaatttaattatattgtatttagaacaggggttggcaaactatagcccataagccaaatccagcttgcagccatttttataaataaagttgcatgggaatatacctatgcccacttatttacatattgtgtatggctgcttttgcactttaataacggagttaactaattgcaagagagaacttaaagcccacgaaatctaaaatatttattatctggccctttacagaaaatgtttgctagcctattttagaaggtgttaagtgttgtagaaaaaaaaaaaatcagtaaaggggtataagaaacacagggtggttagggaagatctctatgaggaggtgaatttgagcaaaggctacaaggaattactctctatatattaacttatgaagatgtccactatgtagtgttaagtgaaaaaggttataaaacatttctcacttacatgatcccatctttgtaaaatagaaaagtgtgtatatttatacaatgtaaagttatataatacatgtataaaaaattttgcaagaatatccaccaaaatgttcatggtagttatctcttggtgggattatagtgcactttcacatggcattttttcagtttcttttcattagacatttaaaaaatatttttataaatttaattccttatgtgttattaagttatatcaaaggcttaatgtgtatgaaacaataatggaagattcaactccttgcctaagtttgaagttacttgttgtatttcaaagaggagcactagtacttaagctagaatttaagtgaacaaatcttaaaatggatttttatctctggttacatagaatagttgttagcaggcttaatttagtgctagtagaagaagaaatatgtgattgttaaagaactccgtctgtcataaatgttcctgtcatgtttctgtgacattacatagacgtcagggaagtttgcattaggtgtgggtgagccaataatgtttgcaagcgtatatcaaatcatagcactagggctgggcgcggtggctcatgcctgtaatcccaacactttgggagtctgaggtgggcagatccctttgagctcagcctgggcaacatggcaaaacactatctgtactaaaaataaaaaaattagctaggcatgatggtgccatctctagtcccagctactcgggaggctgaggtgggagaattacctgagcctgggaagttcaagctgcagtgagctgtaattgtgctactgcactgcagcctggtgatgggagtgagacattgtctcaaaaaaaaaaaaaaaaagcactagaatatttgaatactcttatacaagtgtttatgggtttattttattctgaagctcagaacatatctaaagtaggatactttctgcaaacccaaaagcctaagagcagatggggatttttaaagtacacatataataaaattatcaaagccagccttctgaacaagactctcctctctttacagtgaaacccaatggaaaaagcatgacatttagaagtagaagacttagcttcaaatccctactccttcacttactaattttgtgatttgggtaagtaattgatcttgtctgaattttttgtttttttattttacaaagttccaataaataatccctgccctactcacctgattctttaggatattaggagactaaagtgaaataatttatgtgacaacattttgtgtaatgtaaaataatatcctagtgttaattgttatgaactcataattgatactaatggaagagaacagagtggataatttaaaaactaatttaataattagttaattttgtgtaggtattaccaacttctggcagtttattcacagtaacactgtactgtgaaagatatatagaaattttcttcatcttgatccccacgcaacttattaattcaacaagcattattttgccttctatttggcaattttagttcatatactgttctacaattgtaatagtaatgttaccatagtaacaaagtttatattgacattctttttcacatgcaatgtaaatctaaatatattcgtgctttttatttcatccttaggttaagttagaaaatgaaaaaaaaatcacaatccataggtgacaaaaataatttataaagagcctaaccattaaatatttatccattgtaactctactgctttttctctcacttgagaaaacatatggaaatgaaagtaaatgagaatgaacaactatagggataatcttgaatttattctattttaaataaatcatttatgaactttgtttctctaacattaaaagtagcaatacttgttatacatcatctagctcctttcggcacactaccatgttatatcaccatagttgaggaatgattacagcttttggttttcagaaataatctttcctgtatttatggttactagttaggttttggcttcatagaagcttctcaagttacctgcaaatttcaaggaaggttagtgtatgcaatgtatggttataatatatgcatagaaaactctgcaagaggtgaggtaatagtgctattaatataattttaaattaaatattagtatcaacagaaggaaaggagggaaaaaataagcaaactactgtcaattctgtcaatttttttttttatttttttgagatggagtctcgctctgtcacccaggctggagtgcaatggcacgatcttggctcgctgcaacctccgcctcccaggttcaagtgattctcctacctcagcctcctgagtagctgggactataggtgtgcgccaccatgcccggctaatttttgtatttttattagagacggggcttcatcatattggttaggctcgtcttgaactcctgaccttgtcatccgcctgccttggcttcccaaagtgctgggattacaggcatgagccaccgcacccggccataattctgtcaatttttaagcaagccccaagtgaagttaactgtattgcatataatattttatatagtgttactgtgtcttcatctcttagatttggactatgaaatcaagtcccataatagatgtttcttcatcacctctccattacaatcttttaaaaattaggaaagattactttctaaatgtgaaatgtggaatctacctttgcctagttcgctttgcttgtgttccatggtactactcaaacaaatctaattgctttgaagtaatcataaattctttcatggacctcttgttctggagcagctttgttgcaagaatatagtacatttggcttggcacagtggctcacacctgtaattccagcactttgggtggccaaagaaggaggattgcttcagaccaggagtttgggacctgcctgtgcaacatagtgagacccccatctttacagaaaaatttttaaaaaattagctgggcatgctggcaagctgttacatgattagggagtgcataaaatcaagttagtatgtatatttaataaaacaatattgtgttccaagtgcagaactaggaagccatttctcatcaagaagagttaatagttttatttagaagaaaaaaattacacattaagtattttgtctttaataattttagcttttattttaggttcagggagttcatgtacaggttacatgagtatattgtgtgatgctgaggtttggagtacgattgaactgtcacccagttggtgagcatagtacccaatagtttgaaccttaagtatttatttattttatttattttttgagacggagtttcactctgtcgcccagcctggagtgcagtggcgccatctccgttcactgcaacctccgcctcccgggttcaagtgattctcctgcctcagcctcccaagtagctgggattacaggtgcccaccaccacgcccagctactttttgtatttttagtatggacggggtttcaccatgtaggccaggctggtctggaactcctgacctcagatgatccacccacctcggcctccctgagtgctgggattacaggcgtgagccactgcacctagctgacattaagtattttttaatttaaatttattttttgcataagtactaaagattcacatggtcaacattgcaaggctgcagagtatatggtggagcgtctccctaccaccctgatctctcaaataccctgtcacagccagtatttgaacttttatcctcctagagatactgtgcatatataaaaaaacgaatgtgtgttttgttttcttgtatattgttttgcccacaaataatagcaaatgcgttgttctgtaccttaacaatgtaacaatgtattttagataactttatgtttctgtacatatagagcttcctcattttttttaaatggctacaagtatttacatttacatggttttggtataccatcatttaactagtgtcccatcataatcaggttgtttcagccttttactgttaaaaacaatgcagtgaataactttgtacatgtgttgttttattcatatctgtaggataaaataaagtagaatcattagaatcaaatgtgtgtgttttaattttgattgatattgccgaactggctctctgccttgtttgggtagagcttttttctttgtttttaagtgaggtctaatttacaaacaacaaaactgaccatttttaaagtgttcaatgtattgggaagcttatgccaatttacactataacctgtagtgtgtgacgatactttcgttgcttagtctcacaacaccctgttgatactttttgggtttttatatttttgccaacactaatatgtaagaatggtattgggataatttttggtttgtttaccttttgttacatactgcaaaacagaactcataagtgtacagctcagtgaatttatcactgtccagatcaagatacagaacatgctcagcacccagaatgtccccttttatacccttcctcacaaaaaacaactgctctgacctctgtcaccaaacaccgtagacttttgcctctttttgaacttctgtaaaataaatcatgcagagcgtactttcttgccttttttctcttttaaaatttttttgtagagtcagggtctcactattttgtgcaggctggcctcttaactcctggcctcaagcaattcttccccctcagcctcccaaagtgctgatatgacaggtgtgggccactgcacccaacctgtctgatttctttcattctgtattatatatgagattcatccatgatgcatgtatctgttgttatttttcattgctgtgattcaattacttgaatataccataatttatcctagtgttaatagatatttggttgattttatttttcatctattttgaataaaacttctgtaaacattcttgtagatgtctttggaggtattaagcactcgtttcttttggttataccttatctgggcagattttgtttgttttaaggtctaatttataaacaataaaattcaccattttttagttacaacttgataggaaacccatgagtctaacatttctgcgtttcttatcagcaaaaaccctgatggctgccttttttctgaactttgttttgagacggagtctcgctctgtcacctaggctggagtgcagtggtgtgacctcggctcactgcagcctccgcctcccaggttcaagcagttctctgcctcagcctcctgagtagctgggattacaggcggccgccaccacgcctggctaatttttgtatttttattagggacagggtttcaccatgttggtcaggctggtcttgaactcctgacctcatgattcactcgcctcagcctcccaaagtgctgggattataggcgtgagccaccatgcccagccaacttaccttttaaagaatgttggaaggtagactctcagagccgtggagcaaaggacaggcttacttacagtcttcaaagatacagataatgtctccctctagagtaaatggcagacatgcttcctgcatatttttcaagtttagggttacttaagatctgtctttctttcctgtgaagcagcctgttcaggtgtcatctgacttcacaatgccctgtgacagttgggactcaagcagctggcgcaagaaaatgctgatactctgactactgttatgagtaatacagtcctttgcttctgacgcaaaaatgtcatgccttttgccagtatccatgacactgtggtaggctgacttgttagcttgaaagtaaggtaaaatctcagtgcctttgaaacagttgacacagaattcagtgaattttgacaaatgtagtctttttttttttttaaatagaatttcgctttgttgcccaggctggagtgcagtggtgccatctcagctcactgcagcccctgccttccgggttcaaacagctctcctgcctcaagcctcatgagtagctgggactgcaggcatacaccaccacacctggcgtgtgtgtgtgtgtgtgtgtctgtgtgtgtcggggtctcgctctgttgcccatgctggagtccagtggcatgatctgggcttactgcaacctctgtttcacgggttcaaacagttctcctgcctcagcctcccgagtagctggcatcacagacacccgccaccacgccaagctactttttgtatttttaatagagatggggtttcaccatgttggccaggctcgtctcgaactcctgacctcaagtgatctgcccacctcggcctcccaaagtgctgggattacaggcgtgagccatcgcgtcctgccaaatgtatagagtcttatagtcaccaccacaatcaagtcatagagtatttttatcaccccagatttcctttatgcccttttacgtgtgccttctctacctcagccctaggcaaccctggatctgctttctgtcaccttagttttgccgtatcaagaatttctgaggcacatgcctgtaatcccagtgctttgggaggctgaggcaggaggattgctcgagcccaggagtttgagacagcctgggcaacatagtgagacccccatctcttaaaaaaaaaaagaatttcctgtaaatagagttatacaatgtataacctgttgtgtctggcttcgtttattcagtgtaatgcttttgagattcattcatactactgcatgtatcaccagttcatactcttttttttttgtttgctgagtagtattctattatatgtctctaccattgtttgaatgtatgtttatacattcagcagttggtggacatttggattgtttccagtttgggacttatgaatgaagctgctgtgaacatttgagtataagtcttattgtgggcatatgtttttattttggggagtacgctctttggagtggaaataccaagtcttatggtgtgcttttaacttggtaacgaactatcaaattgtttaccagagtgtctgtatcattttgcgttcctatctgagtagttctaatttatatctctcattttgagtgaggttgaaagtatcttttcacatgcttgatttacttgtatttccttttctataaactattcaaatatgtttgcctgttctattaggtgttagaattttttagtgatttgtaggcattctttatatatcgggaaaatttttggccatgctatgaattacaaacatttttttccatttgtcaggtatcttttaaggatacatattatggtgagttttgccatgtagaaatttgtcagtctgaagttcttaatctcacagttatttactaatataagacttcacataagaaagaaacaagatatctcttttaattaaccttaaagtataaattatgttttctagcagtgttttccatagccataacttcagtgggaataaagaaaaataatgtgaagacttaagttttctacattctcataagaattttaccaccttttagaaacacagctacagcatggaaacaagattgtgtcttaaattatgtgtatataagagaaaaaatattaaaagtaatattacatgtgtctgttgcagaaatatccgcgcaagatgttgacgttgcagacttggctagtgcaagccttgtttattttcctcaccactgaatctacaggtaaggttcatgaaataccctatcttctaacttcacaaattaggtttatatatttttatattattatataattaagcttatgtttaattattatgttcatatattctttctaggataatcgagagaataatatcttaaattgattttaataaaaatattcttgataatctgtttttgtataatttgagttgtaacagtcatcttacatgctaagtcagtaatttaagtcagtaatcttaaatgctgtatatcaatactaacaataactttaaaatggggaaggaaagaagtgtgtgggtttttttttttttcttcagtaaatgaataggagaaaatttgttaaatcttgttaaattttacgtcattcatactacatgctcttcaggtattgaagggctgctttcctgtgtctgtaagtccttgtccccaaattacagttacccagatatctaatcattctataggatctggtttttaaccctgtgcatgctgattaccctactgattcttctcttagttgcctgtattacatttaaaatagaatactggctggacatggtggctcacacctgtaatcccagaaccttgggaggcataggcaggaaaataacttgagtccaggaattcagtctgggcaacaaagcaaggccccatctctacaatttttttttttaattagccaagtattagtccattctcacactgctataaagaaatacctgagactgggtaatttataaagaaaaggtttaattgattcacagttctgtaggctgtgcggaagcatggtggcatctgcttctggggaggctttgggaagtttccagtcatggcagaagacaaagggggagtgaggcatctcacatagcgagaacaggaggaagagagagagaaagggaaggtgctacaaacttttaaatgaccagagctcacaataactcattcctcatccaccatctcgaggcagtaccaagtgagaaatccacccctatgatttaatcacctctccaccaggccccacctccaacactggggattatgatacgacatgagatttgggtggggacacagattcaaaccatatcatgcctctagtcccaactactcaggaggctgagccaggagaatcatgagccctggacctcgaggtcacagtgagccatggtcacgccattgcactctatcctgggtaacagagcaagaccctgtctcgtaaaaatatttatgtgtacgtgtgtgtgtgtgtgtgtgtgtgtgtatgtgtgtgtgtgtgtgtgtatgaataatactatcccagctgtcccccttactagctgtaggaccttggtcagtcattttctgtacctcaatttcctgatctatgaaatggtgataataaaggccactacctcctagggttattagtgaggattaaagaagttaatatagaggccaggcatggtggctcatgccagtaatccaagcactttgggaggccgagatgggtggatcatttgaggttaggagttcaagactagcctggccaacatggtaaaaccccgtatctactaaaaatacaaaaattagccaggcggtagtgccgcacgcctgtaatccccactactcaggaggctgaggcaggagaatcgcttgagcctgggaggcggaggttgcagtgagccaagattgcaccactgcactccagtctgggtgacagagtgaaaccctgtttccaaaaaaaaaaatctgagcttggtagcacatgcctgaaagtctcagctacttgggaggctgaggtgggagagtcacttgaacccgggaggcaaaggttgcggtgtgtggagattgtgccactgcactccagcctagggtggcagactgagaccctatctcaaaaaacaaccaaaaataagttaatatagaggaaatatttggacagtgtttggcctacagtaagcattataaaaatgatagttactgcatatttattataaaggttattgttgtctttgaataaaagtttctttatgaaaaaaataaacgtaatataccaaaaccaatctgactacagtggcactcatacttactttgatctgaacatcatttttataaagttacgtaactatgtggtagctgagatatacccttgtttcatgttgagctagtgatcagtgaaaattctcaggtggtttttacatgagttactcttaaactagttctccctcacccaatgtatatttcttattacctaaataggatatatttcctctgttgctaatttcattttatcagttttagcctggtgttctactctttcagcataattttaaatcccaacattttcatccgaagtgttggcagttgtttgtagtcctgtcctctgctaatttgataagcatgtgtgtctgtcttttcccaagttgttgattaaaatgttgaaaataacaggactgcattagctacctgttgctgcctcacaaatactccaaatcttcaaggcttaaaatgataataatacctctcatgatttgtataggacaagactatagataggcaggcacaatcagacgtattcatctttgctgtacaatgtctggggcctcagctgcaatattcagactgggggctggagtcatcttcagactccttcgcttatatgtctgttgttaatggtatctgcaggctgagggctttgctggggccattgtccaaaacaccatacgtggcctctttttatggccctggctttcttacaatgtgtggctgggttctaagggcagatatcccgggagagagaaagaaagctaattggagtctgtattcttttaatgatctagcctctgaagtctcatagcacactccattggctggagtggacacaaggcacccatacagatctgatgtggttgggggaaatgcagtccccacctcttcatgaaaagagtatgcgtgacatcgtaagaaaaacgtgggatgggataaatatgtaggtgtggccattcttaaaatacagtcttctccaaggattgagggcatgcacttcagcatattctacttaagactatcctctaattgacttttttcttaagtcagtttttttatatatgggtaatcaaatataaatttgagtatgaacctataaaagtagcaaaatatcagcaatttcataatgttcattgtaatatcggttatagtatattctttttttttttgctttttttctttttttttgagatggaatctcgtttcgttgcctaggctggagtgcagtggcacaatctcagctcactgcaacctctgccccccaggttcaagcaattctcctgcctcagcctcctgagtagctggaattacaggtgcaggtcaccacgcccgggtaatttttgtatttttagtagagacgggatttcaccatgttggtcaggctggtctagaactcctcatctcaggtgatccatccacctcggcctcccaaagtgctgggattacagacgtgagtcactgcgtccaacccagttatagtgtattctaattcacatttcttcatcttgccctataaacattcaaaataactttatcagatacctttcttaattaaaatactttctttttacaatttaatctcagcctggtagccctgtaaaatgggattaatttgacatgggatggtattattgaagctgtgtctcactttgaaaaacggaacatttgccccttttttttcgagactgaatctcactctgtcgctcaggctggagtgcagtggtgtgatcttggctcactgcaagctccgcctcctgggttcacaccattctcctgcctcagcctcccaagtagctgggactacaggcgcccgccaccacgcccggctaattttttgtatttttagtagagacagggtttcactatgttagccacgatggccttgatctcctgacctcgtgatccacccacctcggcctcccaaagtgctgggattacaggtgtgagccactgcgcccagcccatttgcccatttttaatatttctcttattctgtgtgattaaaaattattcatactgagtctctaattatatctttttagaactctagagtatatttcatatttaacatccctatgattactttagagaaagtataacaagtgattttgccaaagaataaagtgatgtctagggaattgtaaggtctgacccagtatcagagagtaacttagtagagattctccactggatgaaggaccatgctattggaaattgagagtaatatatgcactaagatttacagtaggcatttataaataacagcaagatgatataaacagaccacattataagtttgaaacaaagaaatacacattccagctctgggttttacaggctttgtgagaggtcctgggattccatttggggatacaattttgactgcaaaaactgtttttaattttttctgggctcactgcagccttgacctcttgggctcaagcaatcctcctgcctcagcacacgaccctcacccccaagtagctgggactacaggcgtgtgccaccatgcctggctaatatttatattttttttgtagagatggggttttgccatgttgcccaggctagtaatttttaatctcaaaaacacttcatgggtaactacccaggaaccccacagcaaataggattcattgaggaaagccaccttaaaattgtggacattgaagctagagaaaaagaataaaatcatgtcaaatagttgggacttttatcttggtagtaggtagccactaaataatttaaagtagacaaatgtcctaattattttagaacagtaactgacagtagtatgtaagataaactggaaggaggtcagactgatatagtatcctgtgcttcagcagtcaaagtagcattggaaagaagatgttgatatgcttattaagcatatagaaccaatacagtgcactattgttaagttggaggttagaggaggctaattggagatgttggaagatgactacagagtatctgtcctggatgtctggatgggagtggtgctgttagcagaggcagagaaataagaataaaaaataataagtttgaaaagattatgatacataatagttttggacatgctcatttaaaaatagctatgggatatctcaggtagatatatgtctaatgggctattgaaagcatgggggtttagtgctagagatagggattgagatgtcatcaatgtggagtaggtgataggtaaagcatgtagttgtgtttaattctcttttacccaatctgattctttgtgttttgttttgtttgttttgttttgttttgttttttgagactctgtctcactctgtctcccaagctggagtgcagtggcgtgatctcactgcaacctccacttcctgggttcaggtgattctcatgcctcagcctcccaagcagctgggattacaggtgcccaccatgacacccagctaatttttgtatttttagtagagactgggttttagcatgttggttaggctgattctttgtttttaaataggggatcctatcccatgcatttattttcactctgttgtccagggtggagtgcagtggcttactacatccttgaccccttgggctcaagccatcatcccacttcagcctcccgaatagctgggactataggcgtgcaccaccatgctcggctaattttttttgtttttagtacagatggcatctccctatgttgcccaagctggtttcaaactcctgagctcgagcgatcctcttgcctcggcctcccaaaagtgctgagattatagacgcaaaccatcatacccagggccatgcatttattcttaaaactaaactatttggccatcttgttctattcttcctgttttgtattggtcccttgctgtttcctttgttgtctgagttttgatgtgtggacaatgtatactgtctgtgaccccaactgtactccacaacagcattcaggactgtagaggagaccaccactgcctgttttctggagagtttagtttagacctgggatctaaatggagggacaggatacgttgtggggcaagtatgaatcatgctgcaggcagtctgtgtttcttaaagaaatagtttataccatgggctataaagcatgaatgggtttttcttaattcagctctattatctttataatttgtatatttctttacaaattcaggcattaaattctaaccatattaattttcagttgtgtattgtctttttctgtgtctttagggatattttagtgacggttgagggactctacattgagtgctaccagctagatatcattttgtaccagaaaaattcagtccatttatatattttctattgttcctttttaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggctgtaagttttgtttttgtcttatttcagactttgtcatgactattgaactgcatttttaatgttgtcctttcatctttataaaatgtagtaacttgtggacttagtgacttggacatgtttggtttttaaaaaataagcttagaagtaggaaccacaagtctcctgtctttcctgaaagtcaagcagtttcactttactagagaaatatttgacatgagaccccccccaccacaggaaagtattgttgaattgacataatgatggtaattctcagtatcccttaattgctgagaaaatgcacgtgtaaagcagctacctgaagaaagcgaacaaatactggagtaaatcctttttttttttttggtgacagagtctcgctctgtcacccaggctggagtgcagtggcatcatctcagctcactgccctcccgggttcaagcaatcctcctgcctcagcctcccaagtagctgggactacaggcatgagccaccacgcccggctaatttttcatatttttagtagaaatggggtttcgccatgttggccaggctggtctcaaactcctgacctcaggtgatccacttgcctcgggctcccaaactgctgggattacaggcgtgagccactgtgcctggccttggagtaacaaagtaaacaaaataaacttactatgatccaaaagtgggttatctaatttgtggatcacccagactttactgttttggcatttgcttttcttccaacgagtttgggaaagcaataagaagagaaatataaatgaatcattttggcttctacttagttgcctcttacaaacatatgtatatattacttttaaaaatatacttaatggagaaatcagttgatatttttttccagttataaatgaaagttgattttacatagaaaattaatgtgaaacaaaccagttgatgacagttaggatggatgtatatatattacttcctgaaaagaagtgtaagagttgggatagaaaagaaattgtcatcagcctttcattgtgtccatactttttgcttgggtttgatttttttcatctaatttagatcgcaaatgccttgggtagtatataaattgcataatatttgtggatataaagctttctgaaagatgctaattaatcccttttagtgcctccagaaaaacctaaaaatttgagttgcattgtgaacgaggggaagaaaatgaggtgtgagtgggatggtggaagggaaacacacttggagacaaacttcactttaaaatctgaatggtacgttattttaaatttgtttcatgttagatttattaaagttagtcatttttgctggaatttttattttaccaagtaataatattaaatgctattttaaaacatttaattttttattctgtaacatttcaaatatatgtaaaagtagaggccaggcgcggtggctcatgcctgtaatcccccaggcgcggcggcccatgcctgtaactccagcacttacggaggctgaggtgggcagataacttgaggtcaggagttcgagaccagcctggccaaccagagcaaaaccctgtctctaccaaaactacaaaaattagccaggcatggtggcgggtgcctgtaatcccagtgactcggaggttgaggcaggagaatcacttaaatccaggaggcggaggttgcagtgagcccggattgcaccactacactccagcctgggtaacagagtgagactccatctcaaaaaaaataaataaataaaaaataaaagtagaaagaatagtagaatacccatacatacccatcactcagcttcaacactggtcagctcatgaccagtcttatttcaaaggtactctttgcctatattgtcttgaagagagaatcgcgggcatcatatttcatccaaagatatttcagtatgcgtctctaaaagatgaggacattttaaaaaaaagcataacaacataccactgttacactcagatataaaatattacattttcagttagtgttgatttcccctatgtctcatgaatatgcctatatgtataattttttttacatttgtttcagtcaagattcgaataagctccatactttgtgaatttatgtcttgtctcttaaattataggttctatttgttcttttttcttacatttcagttgttaaactgttatacattgtacattgtttaacatattcccttgtctttttttttttttttttttttttttttttttttttgagatggagtcttgctctgtcacctaggctggagtacagtggcatgatctctgctcactgcaacctccgcttcccaggttcaagcaattctcctgcctcagcctcctgagtagctgggattacaggcatgtgccaccatgcccagctaatttttttctatttttaatagagagggtttcaccatgttggtcaggctggtcttgaactcctgacctcgtgatctggctgcctctgcctcccagagtgcttagatgatagacgtggccaccgcgcctggcccccttgtctttttctttccaaaaaattgcttttagatctacagatttcatcagatttgggtttgattttttttttttccccaaaaaaatattttgtaggagtgatgtgtacttctgtcaggaaagaccagataatgtttcactgtttttcttttttctgatactaagattgagcagtggtttcgggtgttgtcagccttattcctttatttactaagtttcccatttgttttttccaaacagaaaagttgaaagagttttacagtgaacactcttgcataccctagattctacaattaacattttactatctttgctttatcacctatttatctatgcatccttctctccatctctcaatctatctcttttttatgtatttcatagtgagttgcagtcattaatatacctcacccttaatcacttcagtatttcatagtgagttacagtcattaatatacctcattcttaatcacttcagtatttacatgaactagagttcagtattatgtttttaaataaaatttacatatagtgaaaacacaaatcttagtgtatcattcagtgagttttgacaagtacagacacctgtgtaactcaatcagtatcaagacatagaacatgactaacacacctaaaaagttccttcctgctccttcagtcaatcccagcaagtgccccaccccatgagcaactacctgtctgatattcttcaccatagattattttttcctgttacagaatgtctcatataaatgggattatatagtatatactcttctgtgaaaagttttataactcaacagaatgtttccgaaatttaatcatgttgttttcccactagtatttcccttacagctttgagcagtcatcagtgattataatttgtatataaattacaaaactatggtattctgtgttttgttttagctgaaatacttaaagaaaaacttgcctttatcaactgtggtttaccctgaagtacagttcagataggagaagcaagataggtttaatatttttccttaattaccagttttataattagttgattccctagtatcctccaaaggtagaataatgagggcttttctttctcattataaatttatatttaaacatatttgatatgttttaactcattatggattgtcccatctttgatcagtggcagtttactcaaattggctcattcatccttttttttttttttttttgagacagagttttgctcttttgaccaggctgtagtgaagtggcgtgatctcggctcactgcctcccgagtggctgggattataggcacccaccaccccgcccggctcattcatcgtcttgacacaacttccttagcctttgatagctctctgatataacatgcttttacagggtcatcatgtatttcctcacccagacctggaatcaaccttttcccaaaactctctggtttcatttagtgtgaaataatatttacagactacaatctgggtgctacaggaattcatcactactggtttgtcatagtttttagattttttagattttttcagtcgaaagagctaggacatgttttgtggtttgagatataatactatcttttaaaaatacaaattcatactgatattttcagtttaaaattagggctataggtttttacataattatatttacctgacgtctacatcttctttcttatgaactgaaaaacatagttgacaacaacactaacataattattcatttgctttatcctacggttaatacagcagctgcagaataataacaacagtattagcaccaacaaaatgattaccaagaatgattttaagattgtttttctctgtgaaggatgtgtaatagtcagattactgtgttttaatgttacttggaatagttcttttctatgtggttatactacatactcagtacacaagttcatatgtttcattttgcttttaatttttaggaatttttcttaataattatataaaacaatccaaaaagtcaaatctattaatagtattaaggcttgttcagaaaagtctatattctattcctgaatcctctaccttatttccttctccttagaggctaaccatttttgttttggttcaatttggggtttggtttatcctatttttaaaaacagtgttgtatatgaatatttttaattgaggcataatttatataattgtaaataaatatagtaatattacttgaaactttccatggtgatagaaatcagaaagtagttgcctaagtttgactagaaagaggctaagagattttagccctaagactaaaggctaaggggtaatagaaattcttacccctaacctcctgtcaccttctagcatattgtgcttaaagaaatttgtggtacagtaagggttctgttttaggaaaaagaaaaaacagcactgggatcacaaggaaatagataatttttggagaggagtaagtggggatggagcataaaattttaaagcacaatatttttagactacaaatttgaaaataattttatgttttaagatatagatcaaagttaattttaaagaaaggtttatttttaagaaattttgttagtgaccagcagttatattgcaaagtttgctacaacaatctaggtctcatcaaactctttgcaagtaatttttttcactctaattttttcagatgtgtttttaatgactgattcttcaattttttgtatttagggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaaggtagttataaacctgaatttgagagtttatttgacactgtagtcgtttacaaattaaagtagtttttatatttagattttttaagattttaatgtagatttttagattttaattaatgtagtttttagattttacttttttagattttaattaatgtagattttagattttaattaatgtagaaacaagcatttatcttagtgatttttatgaagtcattttatcaataatatcaaatagaatttggaaaaagaaaaatatccataatccaaccacacttaacagctgttttcactttgaatgttttctgttctcaaacatcttacaccattgtaattacagtatgtatgttccatttttattcttttttaaaaatttgatatcataaatatttgtcttttgacatatgaacctgaagagattaacaaatgtaaattaacaaggagaactgaagattctttagaaatctttttttttccattataaggtatatagcatagcataattttcagagaaattagttcatttggtaaggataaattattgtaaaataaaggaaggacaatataaagagtatatttgagtttgtatatgaaattggaaaacataataaaccttaggatttattttatttttcagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccaggtaaattgaaagttaccgtttattcaaatagtccttctttcaaccctctaatcttaaaaagtttcagtcattttctaaatgtctttaagtttctggttatgtgaaatattttgcttgataacctcttctgggttgttatttcaaacaaggggaatcaggaagatatccagatagaaaatacagctttgctaaatacagtagcctttaagtaaaacatgaaaatgatatagggtgataggaaatggcttttttttttttttcttctagagacagggtctccatttgcccaggccgctggctcactgcaattttgaactcgagcttaagtgatcctcctgccttagtctcactacaggtgtgcaccaccacacctggctttttaaaattattattattttttgtggagatggagtctcgccgtgttgcccaggatggtctcaaactcctggccttaagcgattctcctaccttggcctcccaaaatgctgggattacagatgtgagctaccactaccagcctagaaatggcatttttgatgggtgttacaaagaatacaagtaataaagcaaattaagtagaggagcaaaaataaagagattataaggataaggtagctagtgtagggattggtgtgctgcagtccaccaaaatcagcctgtgacttgtttttgtaaataaagttttactggaacacagccacactcatttctttacatattgtctctattctacagtggaagagttgagtagttgcaaaaagagtctctggcccacaagcctaaaatattagtaaatattttatctacctttttatagaaagtttgccaaccactgaggtagaggaagggattgatagggagcttgtaagactgaaaatgatagtatacccaaagatgatgctaccagcaaaagaaatacttggagcttttaaaaaggctatcaccatagcattcagctatccatactcttctctgttttgattccatttatcacaaacagtatgtctttgcttttgttgctctggtcacagtgagcttgttagggaattgggctaatgactttactacttctctccttaccccacttatctaaagtgctcagaatacaatcagaaaaagcaataaaacaaaattggattaatgcttcatgttgtacagagaatatacatacctgaagttcttcaaaatgtggtattaagtatagaatcttaattcagtgctacaaaaaagactgatgtttattttgtatctaatactaaattatcagagtaatatgaccagttatttatctgtatttaatctcctctttttttctgaaagccaagtttaaaagccaggaaaacttttgtttttcttgattgggctggatatcttccttttgcctgtccacatctacgctctacccttctctttgttgtgtcatgctgacctgtatagatttcatctgtgggtttccattctttctagcttccttgtgactgtggttaatggaaggaagggactaggcaggagagaagacagaagaaaagtgaaattggcatgttgattttccctgcttccttccaggaactggctgtctttttttttttttttgagatggagtttagctcttgttgcccaggctggagtgtaatggcatgatcttggcttactgcaacttccacctccctagttcaagcgattcttctgcctcagactcccgagtagctgggattacaggtgtgtgccaccatgcccagctaatttttgtgtttttagtagagatggggtttcaccatgttggccaggttggtctcgaactccagacctcaggtgatccacctacttcagtctcccaaagtgctgggattacaagcgtgagccaccgcacccagccggctgtctttcaacttagggtcactacctgtcaagacagccctctctagctgaccggcttctttcaggttctggtacttcccctcatccctttgggcctagaggtagaaacagctctaagccccagagtactaactgcactgtctaaggattccatatactctgcatgtagtccctttatgaagccctccttgaattattctaaatggagtgtgccatctgtttcctgcagaaatcctaagttatattacaggccctgtggaagaaataaagggaaaaaaggaaagataatagatgtttccatacttctaaaaccaaataactttactgatttggactgctttttaacttacacttatttctctccagaggttgagtttaatgtattagtcttgtgtcaataaaatagtttcaagaggctgaggcaatagaatcacttgaacctgggaggcggaggttgcagtgagctgagatcgcgccattgcaccattgagctccagcctgggcgacagagggagactctgtctcaaaaataaatagtttctaggctgagcgcagtggctcacatctgtaatcctggcactttgggaggccgaggcaagtggattgcttgaggtcaggagttacagaccagcccggccaacatggtgaatcttgttgatactaaaaaagtacagaaattagctgagagtggtggcgggcacctgtaatcccagccactcaggaggctgaggcaggagaatcgcttgaacctgggagaggtagaggttgtgttgagccaagatcgcaccactgcactccaacctgggcaacagagcaaggctgtgcctcaaaaaaaaaagtttctgaattttaacacaatttagaagaccttactaattgaggttttctgttgtttggtttgctttgtttcagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagtaagtacataagtatatgaagaagtaaagctattggaattccagatgtgaactggttctggttttaataatatagcctcattgcttcttagtttgtgatcattttattcaaactgcagtattttaacgttttaatttttaaggacattaagatgtaaaattgaatatggatcattgatagtataagtctatttgatacctaattaaattatcatggaggccagatgcggtggctcacacctgtaatcccagtactttgggaggccgaggtgggcggatcacaaggtcaggagtttgagaccagcctggccaatatggtgaaaccccttctctattaaaaatacaaaaattagccgggcgtggtggtgggcgcctgtagtcccagctactcgggaggctgaggcaggagaatcgcttgaacccaggaggtggaggttgcagtgagccaaggtcacgccactgcacttcagcctgggtgacagaacgagactccgtctcaaaaaaaaaaaaaattcatcatggaatggtgacttagatacatctatcagaaaaccgttaactgttgataagtctagaacattttattcaaggagacttgtccagagatactcctaactagagaatcatatcctgaatcattaaaaccacactgtctagcaaactacaccttagatccccactatcaaaaatatacttgtattataccttttattcattttttttctaatagcacttgataagcccctgggaagcggttgatcctggaattttggttggttagtttttattttccttttttctcctatagataatatatatgatatagaataaaaaaggcacaaaaagagtgtacagtctaaagtaagatcctcactgcaaagcatctgatgttactaagttcaagaaataatcccgtggcatagatttttcattttgagaccttcctatcacagactcatctcttagttatcaatggcagtagctgtggctgaaaaaatcccctaccacctatatccctttacttccagctcttctagaggtttaggtcatgtgacttgagaacatcaaaggcagaaaagtacccttctgccctaagatttctctcataaatgctgagaaagaaatcaattttgctattgctgctgtgggagtcctcagccagattgctttgtcttgaccaggaattcttaaaatgagatacatggggaggagttcatgaaatagtttaaaatgtaggtaaaatattgtggttagtgcctgtgtgcatttttaatggacaagtgtacataatctttgtcaaatcaatgcgtgaatgaagtctctgggttccctttatgttaggaaatatttccagctcataatttttttttaataatttcatgttctttattctgtttgagtgctgcactgtactcatgtgaatttatctattttaacttctgtaccagcagcctttttcccagccttcctggtctgcctgtcctatcctttctgttttgctgtctgtaattgcctcttcatgattaacatatcagtacttaaatttttttttttttttttttggaaatagtgcctcactctattgcccaggctggagtgcagtggcatgaacacggctcgctgcagcctctacctccaaggctgaagcgatcctcatgcctcagcccccaacatagctgggactataggcacgtgtcaccatgcccagcaaatttttgtatttttttgtggagacaaggttttgtcatggtgcccaggctggtcttgaactactgaactgaagtgaaccacatccctcggcctcccaaagtgctgggatcgcaggcacgagccaccacacccagccttactgcttagattttattcaactcctgtcttattctactgactaccatatcttgttattatattcataaaaattttgagaaatcagttaatgccattgatttttttaagacaaactttttacaaaaagcttaacaatgataagtaaaaatgaaatgtcagttgatattacttattgctaaaaaattaaaaattatatgctacatttaatggctattataagttttgaaaaattaatactacaggtatttttaaaaccgaatttaattactggtatttaacaatttatgttttggctgggtatggtggccaaaccccagctacttgggttgctgaggtgggaggatcacctgagcctaggagctgaaggttatagtgcactatagtcatccactgcactccagcctgggcaacagagcgagacactgtctctggaaaaaaaccactatgttttatggattgctttttcagatggttagtgattatcacaacaatactgtgaatttgtttttattacatcccatcactctcaatcatccttatataaagtaataaacttattttagtacatttatcttaatttgttttattattcttgtgaatatttaggagtaagcaatgtgtttaaatagattttccagtttgattttcagcgataagtagtatcaacttatgtttatttcatttttattttttactgttaaaaactttattttaaaaagtttttttctttaaaaaatcatattaactaatttttcaaaatttttataaatataattagaagacctggtatttaatagaataagagaggagttgaataaaatctaagcagtgatgtgttgatcatgaagaggcaattacagatgacaaaacagaagtgaggacaggcagaccaggaaggctgggaaaaggctgctggtacaggagattcaagtagataaatacagtgccagcacacaaacagaataaagaacatgaagttataagaaagagtgatgcctctttagttgttgctcagaatacatttttacctttacaattttgaggttagaaaagagttccagtataattgatcaggctatcaccctgactaaaggaagagccaggtgttttgtgctgggttgggaaaatgctggtataaagaggtagagacaccatgcaattggagggcaagagtattaagaacaaagtaaaagaataatttgcagaattttattttactgttaaaacctttttattttaaggagtttatgtcttttctttaggaccatctaaagcaccaagtttctggtataaaatagatccatcccatactcaaggctacagaactgtacaactcgtgtggaaggtaaaaaatcacatttatattttatctcttataaatctttttttttttttttgaaaccgagtctcgctccattgccaggcaggagtgtagtggcgtgatcttggctcactgcaacctctgcctcccaggttcaagtgattctcctgcctcagcctcctgagtagctgggactacaggtgtgcgccaccacgccccgctaatttttgtatttttagcagagacagggtttcaccacggtggccaggatgatcttgatctcttgacctcatgttctgcctgcctcggcctcccaaagtactgggattacaggcatgagccaccgcgcccagcccttataaatacattttgtatggtattatgaatggaggtcttttaaatagataaatttttattcattttaatagcaaagcatttgattactatttttactaaatagaaaggtaatgctttatatgtattaatattatatagaagtcaggttcataaactacaaataataccttataggtatttaagtacagttctgtgaaagtataagttctataagaagaggaatgttgtttttgtactttggaattttccagagtaactcagaaaataataaaagtttgtgataatcaaaatgtatgctggtaagtgcatgagtagatcatactaaaaaagaaggtagaaaaatactcaagcataaaataaataatttagacctacatagccacagtgcagaattgatacagaaccaaaagctaacggaatgatgctacttacccttttttagttgaggtcatgcttttactcttcatttagtatgtactagttttattttagaaccaaatttaaaatggagattgtgaatcctttccagttaaatatttagagatttgacataatggcatgatttgtgaatatgaagaaaaactgattttttattcaagatttatgagattatttttaaaaataaactattttattacagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaaggtttgtatctgtgagatggagcctgactcttgggtggaaaaatggtggttaggtatggacagggctcccataaaaaacacaagttatctaagactgtctcctcagtatcagggataatcacttgtttattttttaattttttaaattttataaataatgattttctttttttcagagactgggtctcgccaggttgctcaggctggtctcgaactcctgagctcaagcgatctcccctggcctcccaaagtgctgggattaacaggcatatgccaccaaacccagctagtgatcgcatttttaggaatcagtcagcagacaaatttcatcaggatgcaagaacatttccatcactacatgctcacttaaacttcacagtaagctacttcattcatttaagcatattctgattacttacctggtttttaaaatattatttcaagattttgagaactttgtatacatatgactgaaacgtttatctgtagctttattcgtagctttcaaagaagaaaaattgcaattacaaaccgaaagcatttgaagaatttagggaaagcaaatttttttttttctttttgagacagtcttgctctgtcgcctaggctggagtgcaatggcacgatctcagcctctgcctcctggcttcaagcgattcttgtgcaccagcctcccaagtagctggaattaaaggcacgcaccacaatgcctggctaattttgtatttttagtagagacggggtttcaccgtgttggccaggctggtttcgaactcctgatgtcaagtgatccacctgccttggcctcgtaaaatgttggaattacaggaatgagccacagtgcccagcggggaagcaaaatctaagtttaaaaattgactactttacctgtaagttataataaagtgcttttaggcaaggaagtatatgctacaaaaattgataaatcacatgttttggaaatgactgtaaaatatggaaatttcaaatttgttaatatttattatttcaatattcaaactttgttttaaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagaggtatacctggctagaaacatctaaattgatatcctttttctaactctttaggcagctttttcttttgcttatagtgttttggtccgttgaaacgacttccaatttatcatagcctcactacttactagatgtgtgactttcagcaagtcatacttaacctctctgaattacagtctctttatgaacagagtggggttaatactttcttctttttgtaccccaatatgattttatcgtcaagggaaaactcctaaaactatagagtatagagaaatataagagtccaacctttgctgctgattagttatatgttctctgtacctcatccttcacatgagaaaatagtttcctagagcatctggatgacttgtgtaatgtcttagaaccatcagatagaggaagcagaactagaactcagatttccttatgtctttcaattggaagtagtaacaaaggacagaagtaatgaatcgtagcgctccagtctgtgtgttatggtgctgcttaagtggttataaagtgatacaacaactttgaagagaaaaaaactcagtttatagtcttttgttgataattaataattagaattcagctgtgaataatatggttaattagagaaaagccctaagcagagagattcctgccataaagtttttgagctttagtcataatacaggctgtttggacttacatgttattagtgtacagttttaataagcttggttatctagtttactgactttatcaaattaaaaacatggtggagcttaggaagtcctgaaacaggctggaaataactatagaaacttcttaaaaaaaaataaatacagggtctcactctgttgcctaggctagagtatggtggcatgatcatggctgactgcagccttcaactcccaggctgaagtgacccttctgcctcatcctctggagtatctgggactacaggcacatgctgccacactcagctaattttatttttttgtagagagggaatctcactgtgttgcaaaggctgatctccaacacctggcctcaagcgattcttttacctcaaactcccaaagtgctggtattacaggcgtgaaccactgctcagagccaatagaaactttttaaagcagcagccgatgcggtggctcacgcctgtaattccagcactttgggaggctgaggcgggcaaatcacctgaggtcgggagttcgagaccagcctgaccaatgtggataaactccgtctctactaaaacaaaatcagctaggcgtggtggcacatgcctgtaatcccagccatttgggaggctgaggctggagaatctcttgaacccgggaggcggaggttgcagtgagccaagatcatgccattgcactccagcctgaacaacaagaacgaaactccatctcaaaaaaaatagaagctagcataagttgtggagacattaagtttgggtaggtagtcgtatgttgctcagtaaccctgaaagcatcacattagagtagaatataaaaattgttcattttttggtaatattgaatcattaagaaaaggtaaaatctgtttaagaaggtaaaggagcatgtaacttcatgagtaatagttaaggaatatacattcttattgaaggtataaatttcaataaaacattttctaatatgtacagataatatactgtataaataagaaaaattttagtggtgcatgctaaaaaagataaaaataaaggaagtttgttttggtttttgtttttttgagacagagtctcactctgtcgcccaggctggagtgcagtggtgcgatctcggctcactgcaagctccgcctcctgggttcaagtgattctcctgccacagcctcccaagcatctgggactacaggtgcccaccaccatgcccagctaatttttgtattttcagtaaaggggggtttcaccatgttggccatgctggtctcaaactcctaacctcaagtgatcctcccaccttaacctcccaaagtgctgggattacagacgtgagccacagcgcctggccgaggaaattttttaagatacccttttttccaactcgcaaactaggaccgttagtgctttcccctaggtcttactgctttagtcgtcttgctccttaggctgttctctcttgtaggtaagacatacaaaaattgtcagactctataaaatccagagtaatttgagatcattgttttataaattctaaatgtaaataccatcattgttcttaacaatgtattttttatccactgcattggcaatacttttacagacagttttacctgattaagcttgaatccagtacacaaaagacaatgcttacttagaaaactgcagttttaaaagaaaattaagtggtcatgaaattataatgtaaaaataaattacggtattaacttgactttttcattatggaaaaacatgcttaatctgctattcttgctttagggaacttagcagagagcaaatgctatttgataacagttactccagtatatgctgatggaccaggaagccctgaatccataaaggcataccttaaacaagctcgtaagtccaaactcacttctttgaaaaaaaaagtttagggctttgtattaacagaaacattttatcgcttttaaataaagatgtatctcattatgttcaaatgattttatgacaaggaaattttactagattgtaaatgattttcagttagcaaatgtgttcactctgttacagcaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactggtaataaaactgtatcagttattaagaatcagttattttttccttaagcttttaagtactaatttaagtctgttcttcttatacatcttatagtatattggcctcaggagacacctgagaatttgccttatggttactttcatggatttattgaaaaagtattgtgttgtgctttagaacataaaattatgtcagaacattataaaagttgttttccaacaaaaatacttcgcttcttttttaacactttcacaatgccaaatataggccaaataagcaaaagcattgaatagttgaatgaagcacagttcttatttcttccagctgtgaatgtggattcttcccacacagaatatacattgtcctctttgactagtgacacattgtacatggtacgaatggcagcatacacagatgaaggtgggaaggatggtccagaattcacttttactaccccaaagtttggtaagaaataatgaagtttggttttttttctttctcaaacttaggttagaaatgaacttagtttatgtgctaaaattgtgttaaaaagtacatctttggattcatgatgatttttatattatctggctttggttggtggtttctttatagaaagtgttattcctcacctttttggtattttattaactgcttctgactatattcagctgtactaaaaatcctaaaagaatttgtgtatctttccatgtgggttcatttttttcactggtttgggtgtgttctttccttctctatcctcatttctttcttttattgagagattacttgaaggactagtccactttacagtcttcacttccgtacctcccactcagtatttaacatactgaaattaggggtcctaccccacccctgcactgaaacctctctggtgtcactcagaagacctcttgatcatcatatgtactgcatgctttttagttttcatcttttttctactttttttttttggaggcagggtcttactctgttgcccaggctacagtggagtgcaatggcatgaacatggcacactgcagccttgacctcctgggctcaagtgatcctcctacctcagtttctcaagtagctgggaccagtgccaccacatccagctaattttttttatagagatggctggtctcaaactcctgggctcaagtgatccttctgccttggcctcctaaagtgctgggattatagacataagccactgcctccagccttttctgcatttgactctgttggccttccatccttgaaactccctcctcccttgggttttctaaccatactttttctgctagcacagtctcctgagtctccttgttctttggtgttttcttcttcttctcctttttttgctttttttttttttttttttttttttgagacagagtctcgctctgtcacccaggctggagtgcagtggtgcgatctcagctcactgcaacctccacctcccaggttcaagtgattctcctacctcagcctcccacgtagctggggtagaggtgcccactaccatgcctggctaattttttgtatttttgtagagacggggtttcaccatgttggctgggatggtctcgacctcctgacctcaggtgatccacctgcctcggcctcccaaagtgctgggattacaggcatgagccaccgcacccggcctcttgaccctgttttcttacttgcctattcaaactctgtccatggctttagccatcttctctttccttcccaaatacattttccctccctcgttctatgccaaagccataaatttaaatgtgattacaataaatgtatttgtatatttttctctcacataagctgagtgtcaagtcctgttgattgtgcgtaccctttcatcatcattttcttcaactgcaagctcctcatgctaacttctcttttcttagtgcattgcccccagtgaggtcttcacctcatcatctggctcttctgtatcttccctaaagcaaacttaaccaacattctttcttgctccccctacattttgaatcattatagaaaattaccttattttaccataattgtaacccccacccccaagtgccagcctagttaatgataagtagtaaattccatgtgccttgttggttgaatgcttgctgaatgagggaataaatgaatgagtgactacataaaataaatgataaaagttcctgagctttgctgttagggtcagtaatgaatatagtttctgggataaggttggtcccatgtggtggtatgttaataggtatgttatttaaaataaaactttataccataatcttgagaaaaattaaaaaataaacttaaaaatgtatattttatgtatttctgtggagaccagccatctctacagagctttgtatatatgtatgtgtgtgtgtacacacacacataaaagcccatatgtatattttttgtttgtttgtttttgagacagagtcttgctctgtctcccaggctggagtgcagtggtgcagtcatagctcactgcaacctcaaattcctgggctcaagcaatcctcctgcctcagcctcccaagtaactaagactgctggtaggcaccaccatgcctggctagttaaaacaatttttttggtagagatgggatctcgctgtgttgcccaggctggttttgaactcctggcctcagtcctcctgccttagcctcccagagtgccggattacaggtatgagccaccatgctcagcctaaaatttttttattacataggtgttcattatagggaatttagactgtacagtaaaatgtagagaggaagaaaaattagtcctagtcccttaccccaaaataacatatttgtgtatccttttagtgtcttctttgtatatatttttttcctaaaattaaattatacttagtattattttataacctaccttttttcaattctctatctgtagtctcatggatccattatggcttcttcacatggcttgagtcttgccaacgaggaccttacagcttagttgaagaaattttgcataagtaaatcagaaaaaggagaacctgtggactatgtagacagtaaatagagtaggaatttaaatataccagtagtggataattttaccttcaaaggttttatgaagaagaaaatacttgagccttgagttagtatgtggacaaataggaagaaggtggcatcttagagagcagcatgagcaaaggcacaggcttgaaaacataaaagcagatgtttaataaagcaaagtttctgcctaaattagatttggcattttatatatatatacacacatacatacccatatcaatatatatatacacacatatatcaatatatacacacataaatatatatacatacacccatatatatatatatatgatgcttagcatttaagagttaatatttgccaacccatagtttattctcaagcatttaactgatttcttgatttctactgagcttcataggatgttagttacttacaaagggatatgtgtggtggaaggataaaattaagtgaatagtatatggctgcaatattactttcatacattttttactgtaaaagactaagtaaaattcaaaattaatcaggacagtcatttaaaaaatctccaatgttaattatcccaattagtgattaatttgatgaacaagtcctcttttaaatgcagatgaggatttgtgtggtatttagggatcttaggcttgtttactttttagtttattcctactcgtgccactcctcatgcccattgagcagctcctaaagttcttagccctgtaccagctatatcctccttttgaaaaatggtaaataactcttaaaacttctgagagttgcatttttattttttagaaggttaaatgtgtagttcaattatgtttttatagcttttccattttacccagtatttatatttgttctgacataatttctctgttatacagtattagaactcagagataaacttttactaagattctaccaaatgcagatcataaatgttacaaatggttatgtttgaaagctctaacccagtagattacccgatacactgatcatttttatcccccaaccaacatatattttatgctatgcggccaggttaatgtataagacataaatggttgggatgtgatttaccaaagagagaagagggtaaaaatcatcaagtctgaagagaccttgaaaaataattaggattgtattttatcttttcaacagtaagtctggttgggaagttgtattatgtcttcttagttcatatgtcaacattatttcccatcacacctctttttttttttttttttttttttttaagctcaaggagaaattgaagccatagtcgtgcctgtttgcttagcattcctattgacaactcttctgggagtgctgttctgctttaataagcgagacctgtaagtaactttattcatatttttgcattttcccccagctttattgagctgaatttacatgcaataaaatttatccattttaagtgtacagtttgatgaatttttgtaattacatacagatgtataactaccaccataatcacaatatagaacattttcatcacttttataaagcttccttgttctcctttgtaatctgtcttcttctcagcccaaccccaggcagtcattgatctgcttttctgtaactgtagttttgccttttctagaatttttatttatctatctattttgagacagagtttcactcttgttgcccaggatggagtgcagtggtgcgatctcagttcactacaacctctgcctccctggttcagactcctgcctcagccttcaaagtagctaggattacaggcgcccaccaccacacccagctaattttttgtatttttagtagagatggggtatcaccatgttggccaggctggtctcgaactcctgacctcaggggatccaccctcagcctcccaaagtgctgggattacaggtgtgagccacggccaagaattttatataaatagaatcacatagcgtgtagtcttttgcgtatgtcttttacataatatttttgagattcatccatgatgttgcatatacttctccctttttttttttttgagatggagtctcactctgttcccttactggagtacagtggcatgatcttggctcactgcaacctctacctcctgagttcaggtgattctcctgcctcagcctcttgagtaactgggattacaggcacttgccaccatgcccagctaatttttgtatttacagttgagacggagtttcatcatgttggccaggctggtctcgaactccggacctcaagtgatccacccaccttggcttcccaaaagtgctgggattacaggcatgagtcaccacacctggcctacctttttcctttttattgctgaacagtattctgtagtatggatatatcaaaacttagactgatctgttatggaagtttaggttgtttctaatttttagctattataaataatgttgctatgaatattcacatacaaaactgtgcgagcatatgttttcctttatcttgaacaaataataggagtgagagtgctgggtcatatggtaagtatatgttcaactttataagaaactgccaaactttttcagagtggctacaccatcttggattgcctccagcagtgttccatattatcaccaacacttagtgctgtcagacttctttcattctagtgggtgtgtagtactatatcgttttaattttcatttctccgatgactagtaatggatcttttcatgtgtcacttacatattttcttttgtgatgtgtctattgaaatcttttacccattttcaaattgggttattttgtttataattgagctataagagtgctttatatgttctggttacaacattgttaaatacgttttgcaaacttttgtcccagtctgtgctttgtttttttgtcttaactgtggctttagaaaagcagaagttttacgcctgtaatcccaccactttgggaggtcaaggcgggcggctcacaaggtcaggagattgaggccatcctggctaacacagtggctaacatctctactaaaaatacaaaaacttagccgggcatggtggcacacgtcagtaatcccagctactcgggaggctgaggcaggagaattgcttgaacccaggaggcatgggttgcagtgagccaagatcacatcactgcactccaacctgggtgacagagtgtctgaaaaaaaaaaaaaaaaaaaaaaaaaaaagcataagttttttattttgatgaagttcattttatcagttttttttctgtggttcctgagttttgtgtcctgccaaacacagtatcaaaatattttctcatgttttcttccataagttcaatagtttcagctcttagtctatgatccatttcaggttatttttgtgcatggtgtgaggtcagggtcaaggttcattttgttccttcagatgtctaattccattgtcatttattttgaaaagagtgtcttttccccattgaattgctttggtacctttgccaaaagcaattgtctttataagtctgtatctatttccatactctcacttctgtttcataaatgtatatatgtccgttcttatgccaataccacattgccttgatgagtatagctctatagtaaattttgaaaataggtagaattcttccagtgtgttctttttttaaagaagttattttggctaggttctttgccttttcatatacattttaattcagcttgtcaacttttttaaaactatagttttgattgggattttattgaatctataggtcagatttaattgaatctataggagagaactgcagtctttttttttttttttttttgatttaattcctcagctaaaacagcggaagaggtgatttattatatggttgttacactcggccacaaataaacacagaaatagtccagaatgtcacaggtccagggcagaggaccaacatgggcattttgtttttgagcaaggtgggtctcagaggtgatcggcgatcagagggcgatgaagttctagatccattgagacaagctctagacagtagcatgcagtcccacaacttgtaccagcatccccagcgtctggcattccatgtttctgctcctgtggcctccacggtgcaacaagctagcggtttacttggacctctgcctcatctttcttcttttgcgcttcagcctgcgcattcgcttcttcctccacttggctctcatggcgccgaggtttccaaaaaaatggcgctaaggccgagagagaactgcagtcttaacgctactgagtctttcaatccgtgaacctggtttatttctttatttatttgggttttgtttaatttacttttgcagtgttttgtagttttcagtagacaggccttgcataactttttttgaattcatgacaaaagtattttttgttattataaatgaaatgtttaaaaatattttctaattcttagtatatagaaatgcaattgattttttaaaatatattcatcatgtatactgagactttgataaattcatttattagtagctttttggatccttaggattttctagatacacaatcatgcttcttgggagtaattatagttgttctaatctttatgcttttagttctttttattgtcttaatgcactggctaagacctctagtacatatagtacatctagaccatataagagcattgctttgttcctaattttagaggtgaaagtatttagtctttcaccatcacatgtgatgttagctgtaggttgaagtttttgctttgtggggtttttttgttttgagactgagttctactcttgttgcccaggctggagtgcagtggcacaatcttggctcactgcaacccccaccttctgggttcaagcaattctcctgcctcagccacccgagtagctgggattacaggcatgcaccaccatgcctggctaatttttttgtatttttagtttagtagagatgggggtttcaccatgttggccaggctggtcttgaactcctgacctcaggtaatccacccacctcagcctcccaaagtgttgggattacaggtgtgagccaccgcgcccagccgctttgtgtttttttttcccctttactactacttgcaggggggaagttcttatttctgttttgccttgctagcaatttttatcatgaatgggtgtcacaatttggtcaaatgctttttctgaatctattgagatgatcatatggtttttctccttccttccatgaatatggtgcattttattgatttttcatataacatctttgcattccttggattttgctgcattcagtttaatactgtttgcatctgtgttcatgagtgaagttagtctgtctttatgtgccttatctgtctggttttaaaatcaggataatactggcctcataaaatgaatgggaacatgttacctcctctgttttctgaaagagtttgtatagtattaatacaattgtttccttttgcccagagttttgtgggaaggtttttaattaaaaattcaatttctttataaatatagctttctttttcttcaatctgttttggtaatttgtgtctttcaaggattcattcattggtttgtctaggttgtcagctttactactttttatattacttccaaatgttataggtatttcctacaggagagtcagtctggtaggctctcactctttgaagcaccattctcagtcacttttttaaatttgatttttatatttgaacttttttggtatcagtgggaacattaatttgttatctggattcttttaattggaataccacaacatgtggcctgggtaaagattttaagtggttttaattgcagaattttgagagtttaaaaaaaaatttgaacactgattagatttagctttgttaattcattatgaatacattataatccttatgcattttcaacagtatttttctattggttataagaaaaataatttttgtttggggtagagtaggtattttttgttcatttaggtaattggtttggtttgtaagagtctttgatgaacatgtttagaaatagggactatttattgtttattatgtgtggttttacataggccatttttcttttctcttcagaattaaaaaacacatctggcctaatgttccagatccttcaaagagtcatattgcccagtggtcacctcacactcctccaagggtaagagaaaatgcttctgagttgtttataatatacagacatgttagtaggtatattgagtatctacagttagtaggtatattgagtatctacaaatgtaccaaaagataagatattcaagctgaatcaaaaagtaaatgaagataaaacagtacataactgaaaattttaatcaaaatttaatatgtatgacatattttaggggttttatcaccatcatagtatatttgttctgatattttaaattgtttagtacacattacagatgtttggttgaacttgcaaactgaaaacttgaggtgctgaaactgctatgtgatggtaactacctcaagcattttgggttgagtattaaaaccaagttcaacagtttatcattttagcactgatgaaatgatctctgggaacctactctaaactctgaattttaaatatgccccaaaggggaactcatttatatttattatcctccggtagtccttaaattttatattaacagattaaaatgtattatgtatttttatattctacaaaatctctgtcattcaggtttgattttccttaatgttttctagttttctgtccagttaatcctaggctgcctagtctaggcatgaaatattaaatactacttgtagaccattagcttatcaaaatgtaacaccaacaatattgatttagactacttagactcattttatagtatctgcattttgggtagttgacagtgacttagtgacataatacaggttatttctgtaccactgagagttactgggaagtttcagagatgcattagctctgtggctttaactaatacttgccatatacaattttttctcttccttagcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaattttttttctgtatgtggttactatcatctgactatgcatatttgtaacagcatttatcattagtggtgttagctaaataagcatcttagtgtaaatgagatgcttcgtgtgggttttgtgacattttaaatgacataatggaatgtgatttaaaagaaaaccagtacactatcttggtcttaataacatagaatggagatggcaaatttatccactagttttccagatttactatttaatagctgaggtctgaaatcgtagcatcctccctcctagtggacattaaaaaaaaaaaaaaaaaaaaaaacctacttggttgtcaagagcccaagtatggaggtgctgcgccatcttgtggcctgtctgtgcccaccctgcactctgctggagtctccatccttgttgcagtgagacttgaagttcaagattgatacatggcatcctcctgctacttcttgaggttactaagtagtatatgaaactaatcagtcagcaagtccacctggaaggaaaagaaaatctcaactattaatgtgccttcacattgtgattttgtctaaaaaaatgtagtgagtcaaaaaacccacaagccagccaacagtaactccttcacatatataccagagtttatagaaataacatgtcagctttgggctatgtgctcctttgtttaaaatcttctatttggttatggcttgtataggctcaagcctgatttctttaaggtgtggtggctcatcttatcctaatgtgtatgatagatacagtccatcctgctttggaaaagattatgtaactccttgagagcatactctttctctagcccaaaggcagtgagagagttttcttgttcaggattgcttaactttccatttaagctttttctttttaaattaatacaaacttctacactttcaaaatacgaaatatattacaactgcgtataggctcttccatacttaagtccagtgcttgggcaagttaatggagtgaaagactacaagcaaagaggaactgaggtagaaaaagaagaatgtgtgaaagcagcaggaagctcagccaactcgaaagcagggtgaacagcttgagtcctgttgctgctgatcggggttggctcttggacaacttagtaagatcatggaaaggctgcttgggttctccatagaaaagttctgtctccatcaagggaggaaaatgtacctttcaactcaaaattcaatatttgtttttaaatatagctattttccccaaccgctaaagattttcaacagatacgaagccagagcttagttttagaaacctgtggacattcaaacctgattctttattccctgtgactatggttatgtcattttacatgtcaaaaaagtgtatctagaattgtcatttcttatttttgagctttttttagtgagaattatcccctcacttaaatggctttttatttaaacatctgtgcattctgtatgaaattgtagtctttctgggataacatggtgagctatatggtggtaatccacacacacaaaaataaaagccaaaaaaaaaccaaaa

SEQ ID NO: 108 - DNA, 21115 bp, Homo sapiens
ccgggccgcgcttcctctcgccaggcctgcgagcttcctcccagcggagccctgggcgagccgaggttggccgccgccgccgccgagcccgctgccgccctcccgctcctgccccacccgcgccttgcccgggggcttctgccggggtggggtccgagccgggcgaccgcccggctgcgccgccgtcggggccgtaacccggcccgccgtccctcccgccccagccagcctctggccgccggagcccgcggggcgtggagcgcgaggagccccgcggccccgatcgagcgtccggggcggcccccggcagccagcgcgacgttccaaaatcgaacctcagtggcggcgctcggaagcggaactctgccggggccgcgccggctacattgtttcctccccccgactccctcccgcccccttcccccgcctttcttccctccgcgacccgggccgtgcgtccgtccccctgcctctgcctggcggtccctcctcccctctccttgcacccatacctctttgtaccgcaccccctggggacccctgcgcccctcccctcccccctgaccgcatggaccgtcccgcaggccgctgatgccgcccgcggcgaggtggcccggaccgcagtgccccaagagaggtgagtgcctggccgtcccggagtgtcccctggagggaagagggtggaggtcgcgcgtctagtctctgttgctgccactgtcgcgtccactcccattcccctcttctcccacttctcccttctctcctttactcccttgcacgggttcgaattctcccaggagccactgtcagaacccaaattggaagggagtgcatgagggaggtactgccctgcagctccacggactcgtcttctcgggtcatcccgagtccccccctctgtggagctcagagtaggaggtggctggagtctggaggaagaggatccgtatgggccaggtccctagagagagtgctggactcccctgcccttccctgtacagggcctccccgcaggtgccctggcttgcttggttctgacccctccctcattaccccaccatgaccctgcgggctgcaagcaagcccagggcccagccacctcgggtgagcagttagaagcccaggtcctaggactgagcctgtcacccttggcctctcagaagaccaggcctaagccaagggatctttgggtgggaaactgggcaggccttctgcccggggggaggtaacggagcattagcaccatgcccccaccttctggcaccctgggcagcccattctcctaggctctttgtggcccagaccaggtgtcaggaaggggtgtgtccagccagcagattttttggagcttaactaccagttcacttccccgcccattttgtacacccgggaaccgaggctcaaagggagaagttgctaccccaggcctctagtggagttaggctggctgtcctttcatccccagctatacagggctggatggctgtgggtggaaggaaaccaggcaggcaccttcacccactggggacacaggcccccagcccggccccagagggaccttgttggttgagcacgtgcttccctgcagagggctggagggagtgaaagggcttccggctccagctgtggctgggtcagctagcaggagatgtggggaatgtgtggtgtatggccatctgtgtggtgtggcaggaaggtccggtcctggccccggctctgagttgaaacaacctggtggtcagtcctgacccagcactcgccacacctatggcccagctggcacaggagcagccaagttcaggatataaatggggtcacatgggaaccgtggaagctctgtctccactggcagcaggctacagactggggacatgggagcattgtgagagtggggacacccagggggcctgtttcaagctcctagtaccctggcggttccagtgtctttcttggttgtggccacagcaggaacagggcaaggacagcaggggtgaggttgaggcctggcaggatcctctggcccaggagagcaggcattgccctggtgggtgctgagcagtgtctgggctcccttggagctgctggcagttttgtcctgctgggtccctgctcacgatttagggtttttttgttttttcacttttttttctggctgtcctgacatgcacagtggaggggacccagatgtcctgggcctgtgagactcccctcacatggccccacacccagccctaacttcctttccagcctgagggactggggctggagcctgacatggttagctccctcccaccccagtcagcctttttaatttttattttattttattttatttttttaccaactgtgagctgtgaaggtgtgatccagggtcccagggcctttgaagaaaggagtctggcttctggctggcacgtgtgcagggatgtgcttttcattggtgagcttggtgccctccaccctctcagaagcagctgctcttctctctgcattgggtcaggggcaaggaaaaagcagaaaatgttcccattcaccaccgcaggggggccagaccccaaaaggctgagccacacagagtggccctcggcaagggttggaaatttcggggacagaatgcagcttcctccaaacaagtataggtaggggttgagacccaggatccacagtgtgacatggctgccccccaaagggggcagacccacctgggtgcggttctgggctccatcttttgaaggattttaaaaccttgacaggtcatcttcaaagagccagggatgttgactgagtctgggaaagagaaagtagggacagattctcatatgtctgagggactgtcccaaatgagaaaggcatcccatggcagaaattgtcccagacacgtgggccagagctagggagcaggtgggtcccagggaagtgaatctgagctcattatagggaaaccatgaatgtactcattttcttgatttagaaaataacaaaacagcgctacaggaaatttagaaaatgaaacaaaaatcacccactatttcttcagcaggcagtgactgtgttagcattttggagttcactgccagtcttttccccatccttttccttcattgtcgttgtcactggagtgtgtgtgccgtgacaccttttttcatttaatactgcgtctgtgggcattttctcatggtgctacgcggtctaagtaacgttgcttctaaaaagctacagaacattctaggctggcctgctgcagcgccatcacccatacactggagcgtgtgcatttttcccctctgttgctgttgtggttgtcgttactatgagtcccaaaagcagccagggtgttggagggcacaagcaacttggcacccaactgaatgtgggttccaggcccagacatgccacttaggcccagggtagagggaccttagacaggtcactgacctgctgagcctcgttgatataaataacaggatggtaacacctacttcagaggaaggtgtaaggacagtgtcaactaactaaccaagggactctaaagtgcctggcacagccctttcttcactccctctgtgagtaggattggcattgttgaaggagtgcccactgctggctgcctcaacctgtggggaaggtgcctgagccacgggccaatgttgactgaccactcacctggcaaagaggtggtctccgcctgaggagcccctgtgaaaccccctggccctgaggttctagaatactatggccagtgcccttgcctgccttcccttctccccattaccatatgattggctggcctaggacatggggctggccctgggaagatgggctgctggttagggtccgggacctgactccacccattccccttccggtctcccagcatcagagctaaatagacaaggcctcttctctctctctctctctcttttttttttttgtgtgtgtgtgtgtgtgtgtgtgtgtgtgagatggagttttgctcttgttgcccagtctggagtgcaatggcgcgatcttggctcaccacaacctccggctcccggtttaagcgattctcctgcctcagccttccaagttgggattagaggcatgtgccatcacgcctggctaattttgtatttttagtagcgatggggtttctccgtgttggtcaggctggtctcaaactcctgacctcaggtgatccacccacctcggcctcctgaagtgctgggattataggcgtgagccactgcgcctcttctgtaagagcctggctgcctcctgcctcccagctctggctaggtcagcccagcttggcattttcccagaggaaatagaggcctgcttagcctgagacttagacaaggaacccaggcatcctgagccccagcccaagaacagccatgccagcctcatcttcgcaccctgttccagtagccaaggaagggaaagaagctgggagattaagggtagggggattctggagcctcccagagcttcccaggagggagttggacacatcgggaaactcatgttagcctccccctcctcagcaggtgttccccaggtctaacctgagtgtgtatcactgtgacacacctgcttcctcttgttctacttttgtggagaccagggtaactgggagtgccctcctacagccaccccgtgggcagtagcaggacaccagtctcctcctggcaaccctgggcctaagagactgtagccccagatgaccctagggtggcccaggactaacctaaggaaggggtcctcccccaggtggcccattcagtgcagaggtcccttgggcacacgacttcagactccagctgccaaactttggcctgtggagtatctcctcctccctggtcttagtgtaagggaagtgggcatgacaactgccctcctgtcccacagcttgggatgggatgaggtcacagggtggggtccgccccaagatgctggcctggcctggctcagatgagagccctttgggtgtttctcagtttcccccgcccttggttggggacaggatgggtggaggagcaggccacccccaacgcccggcagggagcactgcctcccttccccctctcctctgggtcccttcatccaagggctggaaatagaatccgctaagtaatgattaaagtcaaattcagacctaaaaataaagagctggtgaaggaagagctggtgctccctgcatggctgaggggagaagtgagcagggagaggctggctttgggtggctgagcccctgctcctcgggatcagaagtactccaccagttgggggggtgctcttttatctgccatgatgtggcccattaagtgtagacggcaccactcagggcagactggcaggacccattagaaaaaaaatcccatttttcccatggggaaactgaggcccagaaaggagaagtggtttgtcaagcgactatttgagagctcccctcagcaggcccccagggactggagggccctgtgcagcccagcctgccctttctgcctgctcagtttctcttcctggttttgaggtgctaagatgaagtcagcttctcatcacacactagctgtgcacacaccctccaaccgcagcttccctccacccctccttctgtggtctgggcccagagtcgaaggaacaagtagaagagaggctgcttggtgcccccctggctgtcctgatcatggcatggttgtaagcctcgtgggcaggcgaaaacctgggcatcatctgccccccttggaccctggctgctgcttctcagcccagcctgacacctggtcctcatgcagactcgcgcatctatctatctgcagcttgtgctgtccgtgctgcagggagacaggagggaaggatgaagagcaaaccctgagagcgcctctgctggcgggtagaggagacgaggagtcagtgaggggaggcctgtggttctcacttcctggcagagctggtaggagctctgaagctggggctctgcgtgggctggggcagcctggagggcctcctggaggggaaggtcctgtgaaagttgagaagtgtttgaagaagaagcgtggtaggaggagaggtccttgtttgaagcttctgccctctctagggctgctggctcttttctgtgtgtccctcgacaggctcttggcctctctgagaggctggggtatgcagacaagcaagaagtgggcacagaagtacctctgcttcccagagcagaacagccaagctctgggcagacctcccctcggtgccccccacctgtccattttcagggtgtcgtctgtcctgcacaaggaaaggtgggaagaaaggtcccctaaccaaggttcagacaactctgagctcaagtacccacacagctagttcctcctctgtcagagatcaccagtccttgccctatggggtgtttgaaggattaagtaactaatgcagtgccccaaacccggttgggtcagtcagctgtaattcccgtgttctcattctgcagcccatcctgctggaggagtgtactggtaacacccccatctcccttaagtagtagcaagtctgtcctttgtgttgatccccacagctttaccttctgagctgtgtgttctgcagatcctggttctgaagtggggagaccagaaatctgggggccgaagttttagacagcttatgggcctccagccgtcagtctccccacctagaatgtggccaggagacttccgggtgagggacaagaacatgactttgaagggtccattgaaggctagtgctgagaggctatatgcaaatgcaggcaaatgaagatgcaaagaccacatcctgtgctaagggggtgggggagcagaggcctgggttagggccctggggaggcccagagtccccattgcccagcgcacataggtaattaggctcctgagcggtaattagaaacctttctgggccaggaatggcagcctcaagccgcagcggtgcctggggagtaggctccccattagcctgctctaaccccagcccccacctctcccaaaccactagacgggatttccggtcccactgaaccattgggggcaggggaaaaaaagccagtgtgttgctataatttggtatttatccattaaatccgcccttctccttaggtcagggtgctgacgggagccccgggatgggggtagggcagcgtgccctggagccagagcaggcattcttctgttccttcgtaaccgccccgggaggtgtaggcatctccaagaccctggcgcccaattctgctgctgctcaccctgagacacctgtgcagtgggggtgctgagggaccaccagcgcaggctgcgggggtcagtggaagccctcgggcacccttccttgcctgatgtgtggtggggaatgtcacagtgcctcagcctggtgtcctctgcagaaccagaggtggagctgattttattgctgccaaacttgcccaactgctggtgggtgccccgccctcctcaggtgcactgccctttggaggggcgggcccaaatctgaaacttaattctgcctgtatctgtactatgacctgtaggccctgctcggaggttccctgggcccccatcctgaaccttcttcagtcttcattaactcgctctgtaccacagtttgcagtcttaatcctggtttacttcaaggcgcccctctctcagtcactttcccctaaaatccttctagctcctgctcccctcacccatcttcctggaagccttcccgggtggcccctgtctcacaatctattgaggcactgaacataccaggccatggctgaccatccagtaaccaggaggacaggagccgggtctgcattttgtggtggttcccagcatccagccctggcttgtgcacagaggagaggtgtgtgagtggtgaccttgggtccccaaaggcaggacctcttgagtcctttccttctccacccggatatcctggcctaccaagcatggctctgggcacacaggaaggcttctaaaacactggctcaaagaatgagaaggcaaggtggaccttgctgttgcctgttttgcctccagtggctgtccccatcccccagagcatccagctaggtcctgtggcagcaccagaatctccgggggccagggccctgagttcccccaggtcttttgtgcacttcccttttcagtgggtatttttagctgggcgtaaacagttactgaaggctcccacgccccattaggcagcagagttttggcaagggggaagggcaagggagccccttgacctcccctggccctcagcacgtgcctggccttgggggtctacagctgcttccagggtaggaaaagggcagcctgggagtttctgggctcccagttctttctccccactccttgtcagcctgggctcacaagaaaggctgcctgaggctgcagccactgacctcagcgcttgggcacaatgccagcctgttcccgggaccccagcacaagggctgctgggagccgggtttagggcaggaagtcagagtgaagcactggtcctgccacatcccaagccccttgtcccctagccctgcgggaatggggtgacagctgctgtccctttggggttaactatagtcctattggttatgagacctcggtgtggtacagccagcctggcgtcccctttttttcattcgttcattcattcattcattcagcactcatttactgagcagccgctttgggcccagcccatgcagacgtgagtcagaccctcactttccccctgcagagctcccagtccaccctaaaccacaggccacaaccagtgaggttctcactggagcacggggatgtgtgagaggccttggaggcctcggcagccaacacagctggggacccaaggaattctccagagagaggtgatttacaaaaagtttcttatttccagttttaagggggaaggtaatagatgcatgtggctttaaaaaaataataataatttttttaaaagcccaaaaggacaaaatagcaaatgaacagtaaaaagtaagtttctcttgaacttgatctcactttcccttctcatcctagaggcaacctctgttaccagtttcctctgtctttccaaagataatcgaggcatatttgagtttagggaggtgttgcattaatacctctttaaaaacacaacttgtagtattccatagagaacctgcacctggctttttttttcacagccttttattttgagtatttgaaacctaccaaaaagttgaagtaatagtataatgaatattcatatatccttcatgcagatttgccagttcttaacattttgccacatttactctatctcttcttttatctacatagacatatgtgtgtatgtattttttgctgatttgagtgttagttgtaggcattgcatctttcaccctaagaactttagcgtgtatctcttatataatcacaatgtcatgatcacacttaagaaaattgacattaattccatattatctactatgtccatttcccctctccccaagtgatttttatagctgtccccccgaccaccccttgatatagaattcaattcaagatcatttattgaatcttgtcatgtttctctagtgtcctgttcaatctagaacattctccagccctttttttgttttgctcttttatgacattgacatgaagagtccgggccagttgttctggatttgtctgattgcttctccctggttggagtcaggtggaacagctctggcaggaacgcccccccgggcaatgcagagtcctcctccaggaggcacttagtgtccatgcgtcaccttgctggtgatgcttcactggatcacttggttccggggttgtccgcacgtctccctgtagtgcaggtgctccttcctgtttccaattagcctgtgggatgggacttggaagctgtgtctgttctgctcccctggcaactttttcttcaatgacttgagctggtgttttgccattttccatactctatcatggggagtgttcagtatcggcatctagagatctcccctggccccatcacagctagagctatgctgtcccctttcagggacatcttgtaatttatccacccagcccccaactgatggacataaaggctgtctccccatcatctcctgctactacagacagcactgcagggactgtcctgctgtgtttttttaaggcatgggtactccagaagcagttgctcagctgcacccccaaggttgagtggaagtccctcggtaaaggaggaggagagagtgtgaagggaatggcaaggcggggagggagacagggcacaggtgtcctggcaacagcagatgggaaacaggtctggctaaggtaccagaagccaacaagtcccagaaaggtcaagtgactttcccaaggtcacacagcaagttgatggcagagctgggtacaggactcagagcatctgacacccaggacgatgttcctgcactgttccatagagtagcccgactcttaagtttaaataaccccaggaaggaccccctctctgtgcctgacccccgctgggttgtagaggcctaagtttgcagtagctcctcccagccactctggctgtcagcctctgacctgcagtgggagggtctcaccttctggagatgttttaaggaggggaccccggcctaggcactagctgggaagccactgagccatcttgtctgcggccactgacgtcagtgcttgggcacaatgccagcctgttcccgggaccccagcacaagggctactgggagccgggtttggggcaggaagtcagcgtgaagcactggtcctgccacatcccaagccccttgtcccctagctctgtgggggtggggtgacagctgctatcgctttggggttaactatagtccctttggggttaactatagtcccattggttatgggacctcagtgtgatgtagccaggctggattcccccttttgtttgttcatttattcattcattcaggggtctcatgaccccaccagggaggagccgtccaagagagttagcagctcccacttgcaagatgtctgtggcaaggcaggcactgttctggtgctgagagctcaactccagtcctcacagcagcccccagagccaaggagtatcaccagtccattgcacagatggggaagctgggttctagagtcacagccagcagagtaaaggtgatgagtttagccctcttccctgtttccagaccctctgaggccttcagagcccagctccttgaggcagcccaccccgaccgctcctaggcttacccttccctgagcaccgcccctgtgcccctcatagctgcttctgcctcctccctcctccctcctctcccttgcccctaggctagtgtggtccccatggcaactcctggggcctgtccggcagggaggcacggggctatggggagggctggctcagcagctcaggagtttgacacctgagggggacagaatgctcactcaaggtgtggccctagggacccccgccttgcccctgtgggcctcacttggggttctcatctgcaaaatggggataataatagcttctctgtctcagagttgttagaggatgtgatgagccataacgtgccaaggacagggcctggcacagaataagtgctcagaaaacagggcctgttattatttttattattataatcaaggcagtggggaggcggcggtggcagtagctgtaggccaggaagggagtgtttgcaaactgacagctggaagggtgactaacagcgcagcagcctccgcgcccccctgtggtggcagggagtttggggaggaagggggaggcatggggatgtggaatgctagcagggcccctattcagaaggacctaaaggttgggggcccagccagccctagtgggaccctaattcaagctctgtcacccctaactagctatgtgacttcaggcaaattgttcaaccagttgagcctcagtttccgcttctgtgaaatgggggtaagagggttagaagagctcacaatcctccttccctccccgccacccccacccccacagcttacagtccacaggaggcaggggcaaggggtcctcaccacccccaccctcacagcttacagtccacaggaggcaggggcaaggggtccccgccacccccaccctcacagcttacagtccacaggaggcaggggcaaggggtccccgccacccccacccccacagcttacagtccacaggaggcaggggtaaggggtccccgccacccccacccccacagcttacagtccacaggaggcaggggcaaggggtccccgccacccccaccctcacagcttacagtccacaggaggcaggggcaagggatggttcctgtacttagtggtgactgagtcatgtggatggaggcaggtttcaggctcatcctccttgggcctcagtgtccctgcctaaacagcaggattgatggcctggcctctggggatagaaagggccctgtattctgggaggaacggaagctctttcatccaggggatggggcaggggcgcaccagacatttccaagttcagggtttcattccagcccctcctcagccagcttgcaggagatacctgtcctccccttcagggtaagcaagacttagaagggttgagtcactcaccccaagtcgcacagtcaacagagccaggtattaagcccaggcctgactatagagccaggtgtgcggcctggaagtgttggttctccctggccgtctcctccccagctccttctgctctccatgatcacatgcccccctgctgaggccccatcgcccttggagtcaaaccctggttcctcacattggcagtggaagtccccctgctgcctggcagagtttatgccaggcccacttgaaaccatcccctacagtgtcccctgagcagcggtgctcaaggtggactctggaagtgtgtggggtcctagagccccagatgggcagggtctgccttcccgcttccctcaccatcggcttccacctgggccagtttctcatactatgccagtcccctgcctgacacctttgctcagactgctgcatcaacctggggtgccttccctggcccgccctctgcctgtgtaagccctgcaatcttcagggctcagccccagagctccctcctccagggagcctgtctgagctctgcagtccgtgcctacttcacacccccagcactttgcactaaaatgtcttctcccgcgccactgcactccagcctgggcaacagagcaagactccgtcgcaataataacaataataataaaataaaatgtctccttccactggggtaggtagcaatatttgtgactgtcagcctagcccccagacctcatccactgtatcaaagagcccagcaaagaggctcatggaggagtttctcttctaacacactgtgaccacgaagatgccactggccctttctcaccctcagtttcctcacccgtagaaaggaaacagtagttccagcccctctgcttcctgagacaggtccaagggggctctgggctgggattacaaagtatgtgtgtgcagacgggtgggttgctgctctcagggaatggggttggctagggtagcttttttggggagtcaactttattgaagtaaatatacggttgacccttgaacaacacaggggttgagggcatcaacctcctccctgcagtcaaaaaatcatatattaacttttgactcctcaaaaacttaactactaatagcctattgttgtcagaaagccttgtagataaagttgattgacactcattttgtttgttatatatattatatactgtattcttacaataaagtaagctagtgaaaataaaataagaaaatcatatggccgggtgcagtggctcacacctgtaatctcagcacattgggaggctggggcaggcggatcacttgaggccaggagttcaagaccagcatggccaatatggtgaaaccctgtatctactaaaaatacaaaaattggtctgctgtgttggcgcacgcctatgatcccagctactcaggtggtcaaggcatgagaatcacttgaacctgggaggcggaggtagttgcagtaagccgtgagtcaccccaccactgcgttccagcctgggcgacagagtcttgctgtctcaaaaaaaaaaagaaagaaaatcataaggaagaggaaatatatctactattctttaagtcgaaggggatcattatgaaggtcttcatccttcacattgagtaggctgaggaggaagaggaagagttggtcttgccgtcacagaggtggcagaggtggaggcggaggaggtggaaaggaaggcagaaaaggcaggcacactcagtgtaacttactgaaaaacatccagccacgtgtggtggcgcatgcctgtggtaatcgctacttaggaggctgaggcaggaggattggctgaacccaggggtttgaggctgctgtgagctatgatcacgtcactgcactcctgcctgggcaacagagtgagaccctttctcaaaaaaaaaaaaaaaagaaaagaaaaagaaaaaatccatgtgtaactggacctgcgcagttcagacccgagttgttcaagtgtgcactatacaccaaaaagtgtgccgatcgcaatggtacagctcagtgaattgtcacagagtggacccacttcatgattgggctcagacagtctgaaaaccaaccccagaggtccccttgcattccttccagtctccctgtcccaagagcagctatcctgacagcatggattagtttggccagattttgaactttattcaaatggaattacataatatgtactttcctgtgtctggcttcttggttaacattttatttatttatttatttattcattcatttagaggcagggtctcactctgtcgcccaggctggagtgcagtggtgtgaccttggctcactgtagccttgacctccccaggctcaagcgatcctcccacctcagcctcctgagtagctgggagtacaagcacgcagtaccacccccggctaatttttgtatctttagtagagaccgggtttcgccatgttgccgagactggtcttgaactcctcctgggtttaagccatctgtctgcctcagcttcccaaagtgctgagattacaggtgtgagccactgtgcctagccatcattatgttttgaaatttatcgggattggccaggcacggtgactggcacctgtaatcccagcattttgggaggccgaggtgggtggatcacctgaggtcaggagttcgagaccagcctggccaacatggtgaaaccccatctctactgaaaatacaaaaattagctggttgtggtggtgcatgcctgtaatcccagctactcaggaggtggaggttgcaatgagccgagattgtgctactgcactccagcctgggtgacagagccagactccatctcaaaaaaagaaaagaaaagaaattcatcagtgttatttaatggttggagtttgtgttggagtttatttaatggttggtgtttactgctgtacgtagtcccttttgtgaatatgccactgtttatccattttcctctggatcggcatctgggcagctcccagtttgaggtttattacaaagcatgccacttgtagccctcctgtgcctgtctaggcagacacatgtcctgtgtcctctcggtgtgtacctagaagtggggttggtatatgtttagagatgctacctgggcgggattttgcaggtgaaggacccaaggacccacagagcataagggactttctcagatcacatagccccttctcagagctgctccggggcccctttccccacagaacagtagctggaaccaggcctggggctgacggtcaggtgtccattgtcccactagccccctttgctcctttctatcagtcctggaaggccccctgtggccttagggttggtggctccctctgcccctgggggtcctcagccctcatgctcctctacccagtaccgtcagcctgccaggactggagagaatggcccatgtgtcaaatcccagcgcaggacactcttggcacctgttcatgcccagtgaggagccagatctcagcagttggggggcatttcttcacacccctcctcagtcttcatgctcttccccacagctctaatggtaccaagtgacaggttggctttactgtgactcggggacgccagagctcctgagaagatgtcagcaatacaggtaccacaggggtgagggtctgggacatgcaagcattcccaccagccccagcggggtgcttagcagaggagagaggatgcagcttagatcaacccactcccctttttcccagcactcagtcaggtacaggcctggggaagtgggggagtctcaacaggaagggacccagggctcgttctccgggcagagcacctcacccaggctcacagaggccagctcagaggctgtgaccacgagggtgcgccagcaggtggctggagggggcccaggctgcacccgcccacgtgtcacctgccttgcaggccgcctggccatccggtacagaatgtattgccaagtacaacttccacggcactgccgagcaggacctgcccttctgcaaaggagacgtgctcaccattgtggccgtcaccaaggtaatcaggtgacgcccaccccaccatcccactgctgggccttccctctgcagggggaggtgggcctgagagcatgtctgggctgccctctccccaggaccccaactggtacaaagccaaaaacaaggtgggccgtgagggcatcatcccagccaactacgtccagaagcgggagggcgtgaaggcgggtaccaaactcagcctcatgccgtgagtaccacgaggaggggttggggagggaaggggccttggtcctcctgaaggagcatcaggagcaagcagggaggccagagtgaggggcttgggtgttggggagggcctcaggaggaggtgcagggtgcgggtgcgggacctcacagagcagggctgggggcagaggcaggagggtggcaaagaagggacagggagcagaagaagagggcctcaaatgcctgactgagcgagtgcgagccacgggtgccaagcagagggaaccccttcagaaaggggagccagggtcagtacctttgggccaccatgacctccagccctgctgctccccagttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggaggtgagctggggggtacagagccttgctcccaccctcacacaccctaaacccatctggggccctggcttctagctccagccccactgcttctgcgtggtgaccagccatgtggggcaacttctgtgagcccttgtttcctcacaccttggtggagcagctgctgcgtgccaggactcacctctgaccccacagtgccaccatgaggaggggagccttatcctcattttatagaccaggagttgaaggttcagagcagttaggggacccacctgaggtcccacagatataatttggtgccaggactagaatctgagtctgtctgatcccagagctaactttcctccagccactcacagacctgcatgctcagaagcgtgtgcagaaacatgagccatgcgccttgatcgccagggcccctgaggctctcgcacctgcacggacatgcccacaggtccctgcagcttcccaggccagctctgccagccctggccaggccacacctggcatccggtagccacaggaagcctcccgtgtccctctgtattcactcttatctccctcccctactggcctggcttggcctgtggcaggtgagggtggggtcctgggcactcctggctagaggctggtttcaggactgagccatgggttgccctctgcatcagatacccatggggcccagagtggtagcagcagctgagtgtccagcaaccgcatgtagggtggcatgggaaatgggccatacgtcataatctgggacttccctaacccctgccctaccagaaatggggagccctccccactcagtgactccaggctaggcggggctggcctctgccgccctctggtggtcaggcctggacggtgcatatggggcaccttgggctgtctctgagcaccctgccccccacaccctgcagcactacacctcagacgcagatggactctgtacgcgcctcattaaaccaaaggtcatggagggcacagtggcggcccaggatgagttctaccgcagtgagtgcaccccaccccagacctcttgcccacccacctcctcccacgcaggcttcctggcactgccccatccaggaacctccagagaaccccagtgcctgatagtccagtcagcctctgtcatcccagccatgtccctagtggcctccaggccctcactggcccctccccacaggcggctgggccctgaacatgaaggagctgaagctgctgcagaccatcgggaagggggagttcggaggtgagctgggccgggccccctgggggggttctgagggactccgaacttgggaacaagaccacctctctgcccccagacgtgatgctgggcgattaccgagggaacaaagtcgccgtcaagtgcattaagaacgacgccactgcccaggccttcctggctgaagcctcagtcatgacgtgagtgggggcggggtaggggggaggttggcctaggttaggagtgaggcaccagcttcccctttctgaccactctcgtcctgccccaggcaactgcggcatagcaacctggtgcagctcctgggcgtgatcgtggaggagaagggcgggctctacatcgtcactgagtacatggccaaggtgggcacctgccgagacccggcactcaggccttccaactgccccgaaacccccactgtgctctagggcccctgctccctcagtcccccgaccccaagtgagcttttaggtcaccagggctgggcttttgtcctggtttaccattcattgactgtaacattggacaaatcatgtcacctccaagcctcagcatcacatctgggaaatggagataataacaacttagagatttgtgagagtcaagggataaggcatgaataacacagagcagtgtccggcatggatgttctggcccctccccactccttccctgtctcacacctccctggagtgtcaacacccacccggccccagcgtgctgtgtgagagggctgcagggcacgtctgacctcggcctggtctgtccttcctgcccccaggggagccttgtggactacctgcggtctaggggtcggtcagtgctgggcggagactgtctcctcaagttctcgctgtgagtgaagcagcctcttggatgggtagggtttgaggggtaccctgccctgctatgggagccccagtctgaggggacatgtggctggcctacccccagagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaaggtggggctggcctcccctggggcctacagaggtgggcaggagtcctgggtcactccccaccctggagtcccaggatctgacgctgcttcttccatccacatggcagaaattctccactaagtctgacgtgtggagtttcggaatccttctctgggaaatctactcctttgggcgagtgccttatccaagaattgtgagtatgggtactgggatcagggtggctcttggagcaccggaggggttggcaggggcgtgagcctccttgggccctgcctccccaatcaaggcctagaagcctcaggcctgccctggggagctcacaggccactctccgggcctgggtctgcggcaaagctgatgggcatccctgagaggctgctgggtaggtgtcctctctgaggccagggcctggactgactcctgcctccccctggccacagcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgccgcccgcctcggcgcttcctccaccgag

SEQ ID NO: 109 - DNA, 144259 bp, Homo sapiens
attctccgcggcgcggcggcgagtgctggctgcggtaccctcccgctcgcttgtccgtctgcgcgcccgcgatgtgaccagccgactgggggcgggctggcggctctgcctgcggcagcgcatcggtttttctcctggcaggtccctaattgagccgtgattcccttggagccagagacacccaccaggggctcggagcgccgcgctccggggctggaggcagctgcagcgctcgggtccgcgcggccgggtgcagtagcctcagtcccagccgccgcctcgctgagtcgtgtgccctggcgaatgcccggcgcccggcacagctgagccaaggcgactggtgcagagcggcggcgcctggtcctgcacttgccgctgctgccgggctgtgccggggcggcggcgctgcgcgccggagtttgcagaggctgcctccgagcgccgtccgccaggaagactccctgcctcctgagtcccagtaagttgactgtagtttctgaagttggagggagccgtgggaaggagaggttcgtttttatcttcttgtgggaagccgagggtggcacctcttgttaacagagttccagctcgaggagggagtgcggggtgccaagaaggggacaaggcagctggaaggtctggagtccagggctggctgacctcagcatctcacgaatgtgccagttggaaatatgctgggagaggacaggtactcctagggcatttcgactgctgcgtgctaattattcattccaagctccttgactctgtgtttacgttggggtgaaggggctgggcagggtcttgtcacctccatcctaattcctctggggagtgtggccagcactgcgatggatctttgggcgagccatttctttcaggcctgcaggcttcccgcgcatcccgctttactcttcccctaggcagaagttgccaaccttttcataattggagcctagtcctttagggaaaaaacaacttatatgtcgacccggtgttttatgccctaaggcaaataaaacgagctctgggcgtgtgaattcatacactttaagaatgtaggcaagtctcaagaaataggattcagataatgacacttggatttcaccctgattgtcctgcacctcttatgtaagcctcccggctggataactttatctctgcagtggctgcagctgtggccctccattccatttgtttaaagtccaattgaacagtatttactgaaaatgctgacatgatatagcggcctgaagtctgaaacagagtgcactcttcaaattggagtgtcttctcctaatagggagcatgggaggaacaacccactatatttttcaaggcagctccaggaattagacccataaatcatgttttaaaatagcatgcattgtgcagagagcatgcagaggaccgctttttgaacacatcccctttgttttagaaaaagtggaaattgttcatgccagacaattgttgagtctaaaagttaagtgtactgatgggcctaattatcttaataaacaaagagcatgatttataggtagctgcagtgccctactttgaaggatagaaatctttaacctttctttctcagctgttcccgagagattccttttaagcagagctatggattatcatcattgatgtttaatacctgagttggttaaacttgtaaaaggaatagtactttgaagtaccatgcagtactgctgtgtgactgttacacagcgaatattataaataagaggaatatttggagtattgggtatagatgtcattagtttaacaaaataggtcatattaagactttcctgctaaatatatatacacatacataaatgtttaatttggacttgaaattattgtttaaaccaaagctcaggggtatgttttaatgtaagatttatttacataatctttgaagagagaagtgcatttatttatggtatttcagcatgcagaacaagatgaactagttataggcaccttatttaaagtgtaaagggtttttttttaggaatactaagaaaatacacaaaatgttatttcagaagttgaaaagttagtcacatcaacacattgcggtttgtgagagcatccagtgcttatctctagaagagattacatccaagcatggaatctcaaacagattgacccattaagccctattgcagcctggttaggaggacaggctatggagccaggctgccagctctggtaccatctgtttgaatctaggcaagtaacccaaagtctgtgcctcagtgtcttcatctgtacaatggggatgacagtagtagtacctaccccactgaacagtagtgagaattaaatgagttcatagacatagagctgttgggccagtatctggcatattaagcttgttctgggaaaaattttcattgttatgaaaggaaatgcatctttggactctatggacattgaattgctgctatggacattgaattgctgctgatgaatattaacagaagcagttcatgtgtataataggagagaaggtataaacatttattgtgcactgtctagcgatacagacaccaactggtatttaacactgtcttgctcaattccccaccacagtcctttgaggtaagtggcttcatctctactttagagatgagaaaatgggagctcagtgagatcaaatagtagaaattggagctggcatttaacccacgtctgtctgtgttgaaactgtgttctttttgaccctgctgcctcaacttgcaaatgaagtagttgcattattatcctcaatttatacatgaagaaatctaagcttaaggattaaagtatgcaaagtgcttaacagcacccacaacagaaatgatcataattattgttaaataacttgcccatgcttccatacctcctaatgtgtggtagaggtgccaggtctttcaatttgaagtggattctgttgctttattatttttctattcatgcattcagagagtcaaaaaagaaaaattggtgtgatgttagagtttacactggagggtggtggtctccatttggtttcctgcctgcacgtgtagctgcagcaatctacacagtcaaggaaaccaccacggcagcagtaatcaatccacaaacagcgtcatccctggatatgcattcagtcccagctggagaactcccttgggcagagagaggccttgcactttgcctcatattaaactgcatgttcagaaaaagaaataatttatacttaccattaaataagcatgcttccttcaagccttagtaccccatgtcatgggaagcagattccggggtgctgtgtgagcagtacttcctttaaggtttccatagcttgttagacttctcagctgggttccagaggtggggaatgattgagaggtcatggcatttttgtggctgtgttaggttatcacccaaatactagatagtgttctcgccttttgtaagtcttatttctagagattaaaatctaattgccgtatagggcacatagaccacagactgctcacagtctgatttaatttaaatcacagactgatttaatgtttaatgaaatctcttagctaatgtatgctaacactgaatggtgcttcaatataaatgctcaaagttggctttaaaaaaaaaatcaaaactcttcgagagttctactcttcctgtaggctgcctccatgtgcctggggacacaataccatagttgcaaagtgcccaaaagagcccctgccattgactgagtcatctcacatctctgaattatcttctgtttcaacttgaaccctccttttcagagaacagatattcccttttgcttacttaatagttaatttcaagtgttcccctgctctgggttggttattctatagtaaaagtctcccctgatcacttttgtgacttgaatgaggttcatgatttattattaactaactcctcagaatatacatatagttgtttcatttctcatctatgttatctgttatctatttagtggcttatctgtgtcacttttaaatctctgaataattttcttctgacatccatcaaaagatacatgtaaaagaaatgcaaactaattttaatatggatataaatgaatgaagaccattgacagtcatatgtactgttttgaattttcttcactttgggcttgaggagttgggagctgatagttccagagctcctgcctcatgcattgtgagaggcacattgggaggttatacaagttatacacgcaagcagttcatgtgcagccccgcagagacagcccctgagggctcgctcattgctgagttcaagggcaggggttaagtatgaggggaaaacagctctgtacataatttatatgaccacatttctagtccttactggttatctttctggataagaattggaatgaatagcttaaagggagcacttactgtgtgttggctgccatgttaagaactgcccttcatcctcactgtgaccttgtgtggtagtactttattatcctcttttgtggaagtgacaactgaggcctagaaaagtcagggcacttgtccacggtgacactagtgagcttcagagtaaagagtggagcccagaactgtgcaaggaggcccgtgatacttatagaacgttctgctgccactgatttttgagcctttgtgatagctaaactctattgcatggatttatatattacataatatagatggactatattatgcttttcagaagaatcctatactatcttgcttggtccccaggtgaaggaatggtgggaagacacatgcctaccttcttagccactgccaggagcaggaattgacagcacaggaaatatcatctccattatctttgtagaagaagagcttaagcttagttcacgcaatgagctcaaaaaagaaaaccacatgtctgctttgtgaaataggaagcataaagccttcaactggtagtagagcacagtggggaggcatgttaactttatctgtgtttagtgtcacatacttgcatcattctcactaaaaaaaaaggagaagtgtggagacctgacattttcttgggtgatttaaaagaaaaataagtttatttaaatctaaagaagtatcagcagtgaactgtcatgggagaaccacattactacagcagtgtcatctgtcatcccatgagactatggttttcaaaggaaacgaacacttatgtctaaccagtaaggcttaaacgtgttatcttatagtaagaacattgcatcaaatcgtccatgtctgtatcatagcctttctaactccagtcaaaatggagggtaaaaggacaattttaaaaccatctcgtaatattttcaaaacccttcccctgagccctgccccctctattttttctcgatttcatactggtgccaatatttgttcaataagttaattcatatcatcccctggagtttgaattataaaggaattattgtgattataatattttggcatatcctgttgatctctcatttgcccccatccttgatgttataggactgtatgatttttttaacctgagaagtgattaaaaacgttttaaaaatttagtctcctaaatgtagactgtttattgcagaagacagggaaattggcctgactgggggcatttgctaaaaatgcagagctcctgaaatcctgtgaaccttatggagtaagcaagtaaaaaaaaaaatacggaagaagaagtagttttaaaattgctcactaggcctggtgcggtgactcacgcctgtaatctgagcactttgggaggctgaggagggtggatcacttgaggtcaggggttcgagaccagcctggccaacatggtgaaacccagtttctactaaaaatacaaaaattagctgggcatggtggtgtgcacctgtaatccaagctactcggaaggctgaggcaggagaatcacctgaacccgggaggcaaaggttgaagtgagccaggaagatcacaccactgcaccccggcctgggcaacagagtaagactttgtctcagaataaataaataaaaataaaattggtcactaacagctttgtacttccctctcccatttcacagatgtccagctgacccaatccctaggtaccgtatcatgtattcatttgcaagtaatcaggttctcttgattttctaaaagtaccaaaaggtgtgactaaatcagcattactgtcatctgccatctccgtgttgagagagccccagggttgcatatgtaagcttttatgtgaatttattctctgaggaatgaagggtgatcagataagttctcaggcatctcgtctcactgtatttgtgactccatcattactattaaagttgcttccccctacgccatcctttcaccccaaaccatacccattccttcatcatgcccattgtggtggaacatgatgaaactattgggaaacttaagtgttgagggagctcatgttctaagtcaaaggaaaaaacacataacacaatactttttttcttttcattaaaaaaaagccagtccctaacatagctatacacaagaacaccacaccttctgcattcagcagttgggaattgcaaccagagtggccttattaattttttcctggcaccttctaaggagggctgtgagcctctaattcacatgtaatcaatcactagcagcttgtctgtgttttcagtcaaatttagtgactgaagggtcactaaatatcacaagggtggtatttattcatttatacattcaccagatatatattaatatgataccaggcacattgttagatgataagacctcaaataccagaaaatccctctctctgccctcaagaatctcagattcatgagggaaggagacactgagcagcagttggaaccagtgcttaaaggatgcttggctccgtcaggggtgcctgactccaaggggatgacttttcctaacgcagccgggcttgatggagtctggaagagccagtaggagggtaccaggaggctaagggtgggagtgggcagggagaaattattctgagagagggaacagggaatatggtgaaacaaaggtaccggagaggcgggttgtggaacagctggtcattccatgtggctggtgcacattgagggtggggagtgagactggagatggagagcggaggctggagccacttttggagggtcttgtgggccatatttagttttgtagatgaatttgagtacttttttagaatgatcactctgggtatattacacagaatggatggggtaagggacagacaaagtaagctgtgcaaaaaaagcttttgaatactggtgtggatttaaagtctaaactcccactgataagcgtggggacattaaggggagaagcaaggagaggatggtgaatttaaggatgactcccaggtgtctggcttgggaattgaatccataaggctgccattggagatgataatgaatacagaggatggagcagtttgcaggagaagatgacaggttgtggatttatgcactgtgaggcaccagagggacattcaggacctgagatgcaattggcagttgtacagcctgtggttctggaattcaaaacggaggccgaactggaaatgcaggtttgcaagtcttccgtgtatttgaaattgttgttgaggttgtgatctgcctgtgagaacgtgtggactgaaaaaaaaaaaaaaaaggacgaaggccaaggtggctgtcagaagaaaaagagatggcatagtaagattaagcaagagaagtttttgacaagtgcttggacacaaagtggcagaagccagaggcaaagcagaatgagatgcttgattgaatgggaactgagtgacaaaagaaatgaaattgaaataaaaagagagcaaagggacaggtctgactgttaacttgcttccatctacacagataatggtggcttttactcctagagtttccggttctggtcaataaatattaagacctaccatgtggaaggtgggtgggaaaggggatggggggaagaaataaaataacaaggcatgaatttcgatctcaagaagcgcatggaattttcatttcttatttttttctggatctcaagaagcttatagaattatcatttcttatttttcttttccatttgtttttctccttcattgacagcaggacacaggcttcatgggagaatggaaagaatgaaagaatcattttgttggtgcatgaagtgcctcagttccccatagcgggcatatctcattttatccacaaaataaacacactgaaagagaaggtgataaatgatccattatttgacggattgtaaaaactaagcttttatcatggccataatgttattagagggtttggacctttgagccaatgcttatgtaattattaatgagactttcggctcactggattatttgatgtatgctgagtaaaatatcctataattttcacttgtcttataaaaacaggacacattatattatagactaactggagtatttggagatgatggaaataattaccgtatgttttagttaaatattatgcctttcagtcctcaaacgtttgtcctttaattttgacctaaaggtagaatcactcccgttatacatatgaggaaactgagatacagggttcagatgggtgggtggagataacacagctagtaagtggtagagcttctaggatccaaaatgaggtgtcctgggttcgtaccactccatcatgttgctgtatctttgtgaatagctactaaagaagaattagggggtgttatgtttaagagattttctttattagtctgctcaaagcaccaacagtagaagctgtatcagctacaatttctatatttgatgggccacaggttatttatgcaaatatatgtgattaagttagattgggggaaaatctgcttttttttttttttttcccacaaaatgaacatgttttgcattcattatctcaagagcactaaaaaagaatctgagtataaatataaggattcaatattttaacttataaaattattgtagataaacttatttgtgatacagtgggaatttatttttcagcaattgcaatggctgttgtctgtaagaggcattccgtgtgtacacgtacctgtgtgtgcatgtataaaaaataaaatttagcctaattaattttaaactattggttttccttttgtaatatttttgaattctccagatacattaaatgatattgcttgctttgtcttgccaaagcagctattatgttactcatttaatgccaaagtgttaaagcatttgtcttcggtaagcaatgtaaaatgatgtaggatgagcctaagggatttagtttaatgttacaacttgtattttggctcctgatagtctaaattttttatttacctaattttgctactattgaagcagatattagctgttaatatacagtaatattagaatcatgaaaagtacatagaatgttgtggctggtggaaaaactttatgatgctgcatttttttctttcacaaaaaatatctaggaggcttactaaattgcaatttccagatgaaagcaatttctagcaagtagcaaaatgctggtgctaatgcttatccctaaatctcaatttcaagcttcatggtgcctattttacattttagctttggtaggaaaagttgaatccaaaggggcttatgcctttgtgacatttggtggattgctcttttgttattggtgctgatttttaaaaataacaatacatttataaattttaaaaagttttaaaaaacgttaggcagctatcttagttctgaattatcactacacatggtgcattgtagtagccttagtccaatgtagttgaaaaattacaatataggcatgtgaaaatttaaataacaatacaaagtaatatggtattttatatttgatttttattgcactttataataatatgtgaggaaactcaaatgaggtaaaatgaagattaatttggtcatttcatgcctcatgtatcccaatttcatccaaatgcaaatatgataatccagggcatagagttagtgttctgttcaggtgatttgacactactgtatttattaatcacttccaagatgaacaattaaactgcatttcgtactcatctttctatgagtatatattttaatattatgtactaggagttttcattttctaaaaagtaattaaattttctttgtcttatttttcttattcttattgaattttattcagacatttttatgttagtgtatacttgacatgatagaacatgtctaaattagtaatctaatttgaataccataattatgtgtacagttagagcttgattgaatggagagcttttgcacatcctgtatgttctttctgttagtggatttaggaattacatgcttaatactaaagagtccaaagcctgtttatgtttatcagtaggcgcacagagcaaaatataaatatttttgccaatagaattggaaaagatatgcttccttttttaagtgttaggaattaacacgtaactgtctgtggtagttttctcttatacgaacagattgataagaaatatagacatggctgaaaactagaatggtgtcattgtattgcctaaattgttggtgttgaggttagaagtccactcctttgttttgctaaataagaaataaagatgctttaaaatattgatcataagtcctgataaatatttgtacatatttagtgttacgaatatttttcttttgctttattatgtagtggtcactttgcccaaaatgtacatcttgacctttagtatggaatgctcagtatgtccgaggtagaattgaaaccaaaacatctggagtcttattaaaaggatacaatatggataacagctttttagtcttggggctgagatatttggaagaggattgctaaatactgtggtcattgagaaaaataacactgatgtactaaacttacacttaatttaatggtttcgctaccaccattcttaacctttccaactggctgagttatttgctaatagtggcatgtcacatcctgaattatagatctttccttttaataaatattcaatagcattttcaaaatcgttctcctagatacaattcataatgaacagcgcagcgctggcaacaagcatgcttctttcagcctgttttatagccacaggctatttggcatttggacacttctcttatgtatttccacagctccacatttcctaaaaactgtcagccttatattagaattagcttttgcttctccacagttacatggagaatgaaaagaatatctctccttttctctccctgtaatatgccaaggactgtggtcagagaatcatcatttgctagtcgtatgctttttctttcttgatgttctcattagcttcagaagccatagcatgaaaggcattttgaaatgcgtccgccatcggtttggtttgatccatgttaaactttttctgtctagaactgtggttcttaaccccctagaggacatttggcaatgtctgaagacatttttggttggcacagctggggatggggatgctactggcatctggtgggtagaggccagggatgctgctatacattccacaatgcacaaaatagccctccccagggaagaattttctacctcaaaatgtctagagtgctaagcttgagaaaccctgatttagaaggtaggggatgtctgtttaatttgtattatattttttacgcaaacgaaaagtgatagttctggtgaagaaatcattgcatataatgtaatcatttattgaacacctactaggctctgagaatacaatgaagactatgacatggttcttgcctcaggggtataccctgtctttgccaaaatgattagtaaataaaatcaaactggttgatgtgatgtatgctgtgattagaggtatgcatggcatgttaagataaaaataatttagatttcatttgctaaatataagagaatatctggaagggattgttctctgactaaatgtaatatcagtcatttgtgggtaaagaatttctaatttttccttgacaattaggagtaagttttatttattgtctttttaaatttcaactggcattactgtgaaatgtcaggaaagaagggaaggtgttgacataaaaagtgttacttcaggaatttaggaaatgagtttttcatcatcttcatcgagttctagtttacatgccataaaagtctccaatttcaactgaacaattcactgatttttagtaaacgtacagagctagggaactgtcaccacaattcagctttaggacttttctatcaccccaaaaagctcccttgtgcctgtgtgcagttctcattcctgctgccagccccaggaagccaccaatctttctattgcttgctttcttttctgtctcactttctgtccttatatatttgccttttagcaaatctctggacatttcatttgagatattaatatttaccaataaaaatgtagtttctatcttctttttcaagatcagcatcaccttattttttttatattgcctgtaccatacacatgctacagtgcaggttcagggactcttagttatcggaactctcagactaataaagtgaaacatgcagcaaagaagtaaagcacatgtgtaagagtggaatgtgtgcctgtttctcagctttgtccctgtttcaatggtggtcaccccctctactacttttgtaactctgtctacaaaaataatgttatagaaagcattgaaaagctgaagtcagataaatactctcaagatgtggggaaactacaaaaggattaaatctggagaacatgcctgtttgggagctgtattctggtcaaccatttcttagccaaaccctttggggccaaatgtctttcagaattcagcttttagaaaggtaatacagtgtattcattgtatattaatgtaatacccccatgggatccaggcaacacacagtaatttttgtagcaaagtagatgaatattcacatttagttagagaaaaactaaccacatgtcagttcaggtcagtttggggaacaaactcatttcgtagcaaaataacaaactctgttttcagaaatttttgcatttcaaaattgtgggtaaaggtttgtgagactgcctcagtgtatcccaggatattgcatttcaaactattgcatttcatcttctttctagctccccaccctccaatcctctctgccatatacacacttcatttaacttagccatggatatatttgtctttctttttcacgttaacttcccatcagacttgacaaaatgccaaattagctgttcacttttggtggatgaaggccaggtacagatgtgttatggccagctaggtttgtggtttgtggttcacctctctgctgaaggcctggattgtagccatgttcatctgcaccagccccggggcccaagaagaataacatggttttgttgggtcaaaaagatacccatggagaaaaatccaaaggtagcaatggcagctgccatcccaggtagccccagactcatgctcagaagccctcacacccatcatgaaatcctgggccatgagactagactgctatagaaagagtgtcaaaccagggaggagaatccactagagtaaattttctttaaggaaagatatttagagttcaagaaagataaagacatgaagaaaactatgtggggttctgtagtggacccacacagctcagaagtaggacgccagtccaaaccaagacattaaagacttgttgcaaattattgaattttgcataatcatcttatgtaatttgcctaatggtccttagcaagcccattagtcttttaaccataaatttcacgtctgttttaatttccagatttccattggtagtacttagaaaactataactgcaggccagtgggtcttaactggtttcctgtggcactcttgagttgctatagacccatcgtgaatgtaaatgaatattttgatggatgtgtacaatttgctttcttacaaataaaatgcatactcttatagcaatattacttaagcagaatatactatagataatgggacccatttacaagcaaggggatccaatttctgcaaattataggaaagagcagagtgtagtgttgcaccagcatcagataaaacatttataggaacattcaagaatgttgtcttctaaggactcaagagcatcatcaaggcagtactaagttttcaaagagcaacgtaatgcttaaggtctacccatgggagtgaggtggtaattctggatgcttttgtagacactcagaagcgtgtaccagggactacattactactgtttattacttctttttttttttttttaaagttcttaattgattcaactgtgccaccaaaatctctgtctgaaggtgaaccatcagtatgaaattgaatcattgccatttggttgtgaaattacgaacctcgcctttcctacccacagacttctttcataggtgtcttggtgtacccccacctcctcctccagcctctgccaataactttctcacaagtcttacagcctctttgcagatatcattttctcttttacctcccagctttcaagagctaaacttgtcctgccttggtactgcacctgcctcctcttaccaagtgtcttcctgagtttgcacacattccttcttgttagtacatttcctgttgttaagaagctgacaacctcaccttattgctgccgcaccccattccacatttaatgacatcctccacccctacccctccccagctctggtgatgctttttagagggtggttctccatgttggctgtgattaacatcacctggggaagtttcacgtttactataacttatttccagggcccacccccagtaattttggttaaagtgccctgggggtggggccccaaccttggtagtttttaaatgctttccctggggatgcagccagcactgagaaccactggtgcatagggtgtaatacctgtctgttgtaggtaatgagagcaattgtggaaggggtagcagggagttttgaaaaaggatgaaaagagattaaaaaacaaacaactcttcctcatccctctgtttgctttcagcttcagctgaagagaatgagttctgctaagtggcacctatgcccacctggctggtgtgacttcttccccttaggcctgtgttctcatcagtaaattcctgacagccttgtgcccccagcaggccagaaaccattccaggcaaggcctttacttatctcatcatgaggcagcctaccaggggcctgattttcctttcttaactgggcatcctactttgcaacctcgtatttccatttttcctttttgtaaggctctgtaaaccaaagccatgcaccctccccgctcatctgctgtcagctcacttgaaactcaccagcccaaaggacacacacagcagaaccaattaaagttctcaagtagagattgttcacttcacttttcacttgcaagaaagatggatggcagagtctttgctggaaaactattgtgtagaacataattttgctgaattaaagaggggaggccactaccaaaattgagctgtcatctttttgtagttttcttttattcttaatacatctatgggcctctaaaatccctttttatatattatcaagtccaggagttgggcagagattcatttgggtagccttttttataaagtgatctttgtgaagtctcttctcaagactttctgggggtcagaatgcatgttcattttccagagggccatacgcaaggaccattggctgttccccacggctctacagtttctaaaggagctgagaacacttacaacatgagtgccttacagtactctctggacctcattgctttattattaaggaattatttcttccaaatatagtagttttatttttattagtaagtaggaaaatttaagtgaggtgattttggtgttaataacaaggattcagagctgttttaaggaaatccaatgtgaaatttacgtgaatatccagttgtacaaaaaaattaagacaaaacgcttcacttaacaaacttcttcataagaattatttaaatgccagccttctttaatggagtccgtttacagaaattctgtttattcattcattttccctgagcacagatattgcacaaagcaaataccaccctgctgttgtcctgttgcatggtaagaaatgcagcttttgtatttatcagccttacacatatagtgtgagaaccttgccaaggctggcagtggtgcaggccaataattaattaagggggcatgcagcatacatttattgagtacctagtatgtagcaggcacagggataggtagtacatatagaagcaaacaggctatctacccttacttcctagtggaaagagacaatcacataaccaagggattatcagtagtagacatttggttttagcagagagtaaaatatatatacatcgttaggagtgactgggaggctagggagggtccccctgaggaagagacatttaagctgaaatgtgaccaaaacaaccagggtttgcatgaattgagaccaccctggacagagtatatgcaggcagttgaaggaggccagaagggcagagagttgaggttgggtgcctgtactcaggatcgggaagcagcatggccaggtttatatttaggaagataactctggtagcagcacaaagggtgaattggaatccaagacagcaatgctgggaactcaaaaccaggatacttggtgagaatagaacaggcagcatgctgacttgatgctgaaatgctgggctcctcttttgtcctctgtcctctgtccaaacccagattggacctcacagccccatgagtacactagacctaatgaacttgttaaaatgcttttttaaaatgccaacttgtgtacctggtcctcatctaatgacgtggattggcatcgaagacttcattaaaacttcaaatgacctgatgcagggagttcatggaccaatctttgagaaatattgtgtctaaagactgtactttcactttaatattccatttaattctcaaaacaaccctgtaagaaaaacgtatttttcctagcttccagattaagaaacatgcccagtgtgattaagcatctggctcaaggtcacacagctggtgcatgttatggctggcaaagcaatgtgcttcttttcatagagagtcctgcctgtgtgaaaatggtaagaacaaccctgcaaaattcagaacacctttgagggttgtttcatgagtgaacatggtcaatctctcagatacaggactcaatatatcccatcttgggatagaaccagagtgttcatttttgctagcttttctcttttctgaagaagtttaatttttttttccctcaaagctagaattttaagttctaggggaaaatatatatatattgcaaagaagagcttggatcttaatattggtgtttctgggcctctttttcccataaaagaagttgaaaggtttaaggggtagcataattttatcacccatagacctagaaacccaaccattaggcctcacagaaaattgtcatgctttcagttgccatgaatcatttatttcttaagtggctcttgaaccaagagttgcaaaaatgatgttgaagatgtggaggagggttgctgagtgaaaagcacactgataattagaaatcttgcttaaaagctggcttgaaaacacatttgcttcaataaattacctgcctgcccccatctgaatgtgtgaggaaggttctagcttaatttgctcatgtggatagggtattgaacatatttatctgaaagacttaatatcataataagtttagcctggcctgacttttaggacgatgtccctcctggggtataggtagagaggaagaagatgaaaaacaaaaaaagacaagaaaacattttcctatggtggccccctgctccaccacacgctctcagctggggagaaccgcagtgagccctaccgcagcatcctctagaatgtcagcccacaccccacagcagactgcagggtgttaactgcctgtctctggcatgaacccagtttgaatgagatgccaggaagtgatggaggggctatacctccccctgaagcctggccattacgtcctgcagaattgaccagggcaaggcaggccgtttggtttacagaccacaccatgattgtcacagtgtagattgctgctttgattattttggaatgttggatgaacactccttcctgaggttattttcatcagcaacgatcaaattcagttgctactgcgtgtggctgatcgtccagagagggtgatttcttgtcacaggtttccctagggggatattgtgctgcttggtcttggtggtcagtctcacatcatttatggtgtaaggtgggctcagggccacatctgggggtatggcatacaagacatgatcatgttgtaaaggcaacgtgtctacccccttgtctgtgcctacatttgtgtctaagtgaaagaggaacctcagagacaatcttgaaaggaagacagttaactgcaattttaagaatgatggatttgcatgagggagaggctttagctttgtgataaaatgcgaaagcatttatgtgttgattacatagactgttcgtaaagtctggaaacatctatgttctagaacatattatgtgaagtaaaatgaacataccattaattatacatgggtcttcattggtttctagactttcggaccaccctcagactttttaaaattaatcatgttagattatctccccaattctagctgcatcctggattcatgtctcacccactgaaggtagatgccttacctggggcagattcaggtaaggcatacagtcagttctgttctctgtgcagctggttgtgatggtgccaagaaggctgtatgctgtcagcataccatttgctctgttttgttgttgtttttagtatatgtcttcacttattaaacatttattaaggagcaagtatttttaagtgcagtaatatgtatcgtacattaaggcctcacaattgctactttgtaggaaagaaaatctagttgaagtggtggtgtgacttgcctatatcatgcagctaagaaggttttgagttgagatttaaagagagatctgatacaaggcgtgttttgtgctttctctgtcaattctcatataatttctcctgttaaagctcactaccacaagaaatcggcattagttttgagatcagttagggattaaaagtgatttattaaatcagacccatgtccttatgacataggtaaagtggtatataccatgaacttgagaaacaattttcattattttttctatatgaggtggagaaaagcatactgctcaatgaagaacttaattttaaaagttgtaatgctgtttcatttgttgaattagttccatgacgagggatacaattttggatcaagctaatgttgctgaatctgtagagggacatcaacatttgatggttagttgacatttagaaaccccttcattctgacatgtagattctatggatttgtcatatttaacagagatcaaattatattcagaataaatgtatttcttcactgcctcattataggaaatgatattgtcattttaatattcacaaatggattttattttttgagacagagtcttgctttgtcacctgcactggactgcagtggagtgaacacagctcactgcagccttgacctcccacgctcaagcaatcctcccgcctcagcgcctcaagtagcctggaactataggtgcacaccaccatgcccagctaatttttcttttttttcttttcctttttttttttttttttttttttgcagagatgtggttttgccatgttgctcaggctggtcttgaactcctgagatcaagccatccaccttccttagcctcccaaagtgttggggttacaggtgtgagccattgcacccagcctggatttacttttattcagacagatgcctaaactaatattatccaagttttgtttctttttttttttttttgagacaaggtcttgctgtgttgctgaggctggagtgcagtgatgcagtcatagcttactacagggttgaactcctaggctcaagcaattctcccgcctcacccttccaaaagattttaggtgtgagccactgcacctggacagggtgtttttttttcttcttcttcttcttcttctttcttcatcctgtgacttaggatgcattttttaaatcccattgataaaactggtccttggactgcttgttgaagctttcatggagtttagcatttaccaagtcctactgtgaattgtttatttatatatgtatgtaatcatgtaccacataccaacatttttgtcagtgatggatcacatataaaaccgtggtcccataagattataaaatcatattgttactgtatcttttctatgttgtagtataatggccttacagtattcagtacagtaacatgctgtacaggtttgtagcctaggagcaataggctaccccatatagcctaggtatgtagtacactataccatctaggtttgtgtaagtacattgtatgatgttcgcatgatgaaattgcccagtgatgcatttctcaggatgtatccccgtcattaagtgaaacatgattctctactagatcataggagaaaagaattgtgtttagtgcatcttttggagaatcccttaggtgcctgatacaaaatgaatttttgctatatgaaactctaattcggcatgtgcaaataaccagcttgtcagtgtgccccaatatgcttccctcttccacatcttacatcttcctgtagtctttgccttactgtctcccattcaatagaggaggccaataaaacaggaaatcactcttgatgcctcttccttcaaggtctgtatgctctatctattaaatattgaatctgcttttgatttcaaatccttcggccattctcttagtttagacccttatcatctggatgacatatgttcctgtattagctagtctccattctgccagacttggctaggactatattatcaatattttccaccctcctgccagggagaattttctaacatgccaatctgctcaggtcattctttaaaatccttcattgatttttctgaacattgtctccaggtaagagatctaactccttaatgtggcatagagtcttttgcgatcagacccctggtggtcagtcagcctcatttcttgcattctgctgtgtgatctgtgttctagttatataactcagagttcctcacgtgtggcccgaggctttcataaaccactccctagagttcgtcagctgacttccctcttcaggtgtcctattctctgagaagctgatcctgattggccaaccacctcaacctaatctggtttcaatgtccctcatttgcattcccatgtgctctattacatccctttcaaaatgcctttcacactgctgtaattgctggttagtggtctctctttctcccactggactatgagcttcttgaaggccgatgtcacatcttaatatttatttcctcagtgtctagcattggatctagtctgtaggaaccaatcacttatttgtggtgttgggcaagttacatatcctatctttttaattgtcctcatctaagtaacagaatgtctcatagggttttgtgagaaataaaagagctaatatatagaaagcatcagaacagagtctggcacagaataagagctccatagatgtgttcttgttttatagtccaccccagggacatagaatactcactgaatatttgtagaatgctatcgattgataaagccaagagggagttccacaaattacctgggagagagagtagaaaaattgtgggacatgtcatggctgtattcctgtacaccaggaaaattaggtaattgtttgagattgttttaattatataaaaataccatttacattagcagcagaaactactcatggccctttgtgaagagaattatagaactattgaaatgcataaaagagctaagagtaagtggaaagatatatgcagagtttatggattgagagactcaatataggatcatctttgattttttaaattaatctataattttaatgcaatttcaatcaacatcttccttcacagatttgttttgttttttaaatgagcatgctgggagaccattctttatggactctcacgtttctgcatgtcatgcaagcagaggcactaacaacccttttgttctaaactgtcttttcaaggatgtttgtaatgtagctgtagaagataaagctgtagaagctaaagatagtgtttccctccagagcaaagggtaggtttgtttactgtacaatccaataaagataatgtctcccagcagggcaaggctccattatgaacagttcatgttccctaaactcagggttctttttttttttttcctttttgagacggagtctcgctctgtcgcccaggctggagtgcagtggtgcgatctcagctcactgcaagctccacctcctgggttcacgccattcttctgcctcagcctccctagtagctgggactacaggcacccaccaccacacctggctaattttttgtatttttagtagagacggggtttcactgtgttagccaggatggcctcgatctcctgacctcgtgatcctcccacctcagcccccaaagtgctgggattacaggcgtgagccactgcgcctggcccatcagggttctttaagtatgatacaaacccactgcatgcacagcgtctgcctgagtccctccacagtgccccctgtatttggacaccaagtagaagtgactgaacatgaaacttaatgctgttaactatcccataaataattaagtcctttgtctcagaccgaggagttttgtatcttcttccagcatctgtaaaaatgtgcaggccaacttgttaacttgtaagttgggtgaaatctcagatctttcacagttcttaaaagcattgtgataaatctccacttgtaaaaatcatttagcatattaaattacagcagtgaacaataagaatgtagtacaatgctttctcaaaaagctaaaaacaaatagatcagctattattgacaagaaagaaactgtcctttgctgatttgccttttttccttaaggatgataaatgaacctcttcaatttatctaaatcctttcactttgatattttccataacaactttcctttgctcttattagagtttagcatttctatatctttccactggcatgttaagctagcttcttttctgaaggtgggtggtggggttagtttgcttgtctgttcaaatatttgtttgctagtattaaataggcaaggcagatttatttgggctctttttttgtgacttagtactttcccactattttctagatctccttacccagctctctctgattacaccaaaagatattatagtcattttgctgtttgtctattttgtattatagtcattttgctatttgtattatagtcattttgctatttgtattatagtcattttgcaatttgtcctaaccccagccgtaaccctaaccccctaactataacaaggataaacacatcatggtgttaaatgcagtagagaaaaaaataagagaggtgaaaaaaatccgcagttaataatgattatggaatgcttattttagtgccaggaactattcttttgaagggtaatggactttgggggattaaagatcataaaaatagcattgataaccagttgtaattctaatgaactactgctgaaacacagtgttccacttgtgtctagtacatttctttcataaacatgtaaattactcaggctgcttcaaatccttttaggaaggagttgggaggtaaataatacataattaaagaagcacacccagacccaaagctctcttgagataatagatattaaggagttatttttggggaaaaaaatgaggtaattagacagtacaaaagtattttaaaattagagtaaatgttggttctgagaaatcttcagctttaaatcagtattttttccccccactgatctttgatatgtatttaggaggggcccaatgacatctcagatctcttccctttcctaaaactgtcaaaaatctttaaatcatagtggacaacatacaaaatggcttatttgggtctctggccccagcgcagggtgcctgaccagcccaggtgactgactgcagtgtagccttgcagccgagggtttgttctcctgcagccacagagccacatgcatgcgcttatccccgaaacattagctgggcttgttctgtaactttgtgcaagtcaagtcctactcagtgtgccctgtaacttgtttcttttactcagttattattgagattacagtatgttgcatctagctgtggttcattttcattgctgaatacagttctgttgtatgaatattcctcaattgacttatccactctcctgttgatagacatttgggttttatcattctgttctgttattaacacaatgcaaagaatatgcaagaatttctttaaaatgggtcagcaaactttttctgtaaatggcgaggtactaaatattttaggcgttacaagggcacatgtagtcactgttgctgctgatgcttctaaaattctttttttttttttttttttgagacagagtctcatctgttgcccaggctaaagtgcaatggtgtgatctcggctcactgcaacctccacctcctgggttcaagcgattctcctgcctcagcctccagaatagctgggattacaggcacatgccaccaagcccagctaatttttgtatttttagtagacacggggtttcaccatgttggtcaggctggtctccatctcctgacctcgggatccgcccgccttggcctcccaaagtgctgggattaccggcatgagccaccacgcctggccgcttctacagctctttaaaaatgtaaaagtaattcttagcttgtgggccatggagtaggggtcagcaaactgacccctgctctcagatatataccttagaatagaagtacttatcatcagtcatggacatgtacattttaaaaggcaatgagaaacttttttcaatgtggttatatcagtttactttctcacaagcagtacatgagagtaccccaatgcacctcctccacaccataacctgacgttatactttttaatttgcttgtctagtagatatgaaataatatcttattatgggcctcaatttgcatttccctggctgccaatgaggtggaacatcttttcctacaattatgaacaatttgtactttttctcatgagagatatttgtttgtatcttttgcctgttttttgtttgggctgtttatgtttttcttatcaatacgtaggcatttttatatattccagagactattccacttctatatgtttcaaatattttttcttttatgtcctgttattgcatccttttatgcacacacacacacacgcgcgcgcacacacacacacatttcttgccttcttccctaacagtgagagtaagaactactcatgtttgccctgaactgctttaatgtattcctgtctgaggatgaaaaaatgaactagatagatgacttctttttacagtactctcagtaataaattgatttagagtaaatattcattattaaataaggcaaaattctattatgaaatagcctgtaaaaacaagccagattggccgggcgcggtggctcacgcctgtaatcccagcactttgggaggccgaggcgggcggatcacgaggtcaggagatcgagaccatcctggctaacatggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaacaagccagattaaaagcgtaactacttgctagaagaattagaattgtgtatgaaaaagatcctaaaccaaaaaaacataattgaccaaaatgcatgctataacattaagcattcaaagacttcaaatactgacagtgtacttaggtttacctgactgtattaacgattcagttttgcatatgaaagacttactctgaccaaacaaaactcaaatttattcaacattatttttaggtctcaggcacctggagatggtagcctgtgctatacctcagctgtgtaaggatgtgtcatgtgtccttttcacataaagggaaaataagtcctcacaaaatcctatatattcctctattcctctctgttggtaaatttacttctgtggacataggtagggtaatgtactattttctttcctaagcacatttcacggtaggccagtgggctgttttggacttgcatgttgagtacaggatggactcttgttattctaggaatgggcttggttgatcacagaacacaatgcaccttttcatgattttaatgcctgagttatttaattttttgtgctacttgtcacttcactgtttagttttctttctagggtgctttttgctggattggctgtgagtcaagctggttgatgaagcttcattttgctaaatctccagaatggcttgttaatccttattttacatttcactgactactgtaccatgcagtttccttctgttcaacgaaggaagagaaaatggctatatgaagcaataatgtgatgaatttagagtctagccggaggaatcgccatttgcttctaattggcacatggagcataaaatcagagccctgatttttctaagaactattccaagtaaaggcccaacaaccatcttaactcagagctactcctagattgttttaaagtgcgttcatcaatttgaagagtatttgtatttatacatttcttgcccttcattgtatcttatttgactctgatactttctctcaaatttcttaacagtaacctttcatgttgaactgtaaaaaaagaaaacggacttcatcttaatgtatttcacatagatttccattacttttcactgtgtttttgccactctgtacattttgcttataataaagggttggttaaaggaaaatagatgtaatttttggcacttgtctgctctaatatcgtgactgacactcataatgtacatccagttctcttaaatcccataaaaagccattgggaagaaaatttttgagataatataaatataatcttacgtaagacctgtgtagccacttcttatagacagcttaggaaagaaagaagccttcaaataattaccaaagtaggaagaaaactaaaaacctctcgtattaagggtaataattgcaaaatgacacccacatagaaaaagtcccttcctttcattttcttgaaatatattgaaacaaaaagttaactaacatcatttgggtaccttttgagaactttaaaatatattattttaaaattgattttcttaagggttaaatacatggttttgaagtttttcttaaagtattttgaaagtatttaaattgattttatgtaaacttttgctactattggatgcagccttttcagcatagcaaatgcaatgtccttacttaatgaggtttctaatttttaacctcaaaatgaaatgaaaaatttgttctatttccaggaacatggagtagacatacttttccctgttcttcccactaagtacaactaaaattcctagacattgttcataaaacaaacgtaagaagactctgaaaggtagaggaaagatggcagaatatctatagacctcaaaacccaagcaacacacaatagtgagttacctggcttttcttctttttgagtcgtatttcccagagctcacatattcccttttttttttttctaagatggagtctcgctctgttgcccatgctggagtgcagtggtgccatcttggctcactacaacctccacctcccaggttcaagtgattctcctgcctcggcctcccaagtagctgggattacaggcatgcaccaccacgcctggctaatttttatattttcagtagagatggggtttcaccatgttggccaggctgatcttgaactcctgacctcaagtgatctacccgcctcagcctcccaaagtgctgggatcataggtgtaagccaccacacctgactgagatcccatatattcctgatgaagaaggcagcaagtggaaaacaccaacaggcacatacaaaaacaaataagtaaaagatgaaaatctgttttctgaaaccagaggactagaaaaggtagagcctagcaaaatggaaaacttttagataataactgttgtactctagccaagccccacagaaaaaaaaatgtggcctcaccctaccagcaaaagctgatagggaagcctaaacttccacccttgccagctctaaattgagagctggggtgtcccaaggcaccccagccctcgccactgggtagtgtcacagaaaactgagtagggagccaaggcttttatttctgctgcgtagtaacaagagcctccacctcaaccccatgtaagtagaaaccatatgcggaacctgggtttctaccctccccaactcctaacagtaatgaggagcccttttcctctccaactggggtggtgttagtggacatcatgtgggaaccagaaacactgtttctcccagccaggaagtattgttggaggcccgatggagagccaaaactcccactcctaactagcagtaagaatgcatccccctcaggtatcaggggaggtgtagtagggaacctgattctaccccagtaatcaggatgaaccagcaataataacacagtctccccattcccttctgggagtggtaacagaggaaggcaactaaaatagaaagtttaagtaagatccaaagtctcataacataatacccaaaatgtccaggtttcaatgaaaaaaaaaatcacttgtgataccaaaaaccaggaagatctcacactgaatgaagaaaaaaaaaagcagtcaacagaggccagcaccaaaatgacagggatgttagaattgtctgctaaggattttaaaacagccatcataaaaatgcatcactgaggaattctaaacatgctggatgcaaatgaaaaaatagaaacctcaggaaataaataagaaatataatgaagaacctagggggcatcttagaacagaaaaatacagtaacccaaataaaaatctcagtggatgggctggacaacagaatgcaggggacaggggaaagaatcagtaaagagagaaccatcaaaattattttgtctcaacactagagagaaaatagaatagagagcctcaaggacctgtggaactacacttgacatttaccatttgtgtcattagagacccataagaagcataggaagagggaggggctggaaaagtacttgagcaatcatagctgaagacttgccacatttaacagaagactgaaacctacagatacaaggagttgagtgtagtaggccaaataatggctcccccgccaatgatgttcatgtcttgattcccagaactagggaatcaggttccttttttctttttattttttaatgtagtaaaagggattttgcagaggtaattaatttcaggatttttttttcttttctttttttttttttttttttttgagacagagtctcactctgttgcccaggctggagcacagtggcacagtctcggctcactgcaacctctgcctgctaggttcaagtaattctcatgcctcagcctcccgagtagctgggactacaggtgtgtgccaccatgcctggctgatttttgtatttttagtagagatggggtttcgctgtgttggccaggctggtcttgaactcctgacctcaggtgttctgcctgcctcggcctcccaaagtgctgggattacaggcgtgagccaccatacccggccaaggattttgagatacagcaatatcactcctcagcatttaatcccagagaaataaagtcacattctcacaaaaacctgtgtattaatgcttatagcaaccttatttgtaatagtcaaaactggaaataacccaaatatcctttaatggatgagtggctgaacaaaccggtacatccatatcgtggaatactactccacaataaaacaaaggagctattgatatatgcagcagctagtgtgcatctccagagagccatgctgtgtgaataagcccaatcccaaatggctacatgtaacatgactccatttatataacattctttaaatgataaagtcgtacaaatagagatgagattcacgattgctaggagttaaggatgtggtagggacaggagggaagtgggtggggctacagaagggcaacatgagtaatacttggtgatggaaatgttctatatcttccttctatcagtgtgtttaccttagttgtaatgttgtaatatagtgttgcaagaagttaccagtgagggaaactgagcagtgggtacatgagatccctctttattataagtaactgcttgtgaatctataactatctaaaattttaaaatttaatttaaaaaataacttttaaaaatttcttgtagctacatcaatttgaaaacacaatgctatatcatatataaagaactttgcatgtccaagttcagaaagatgttagtacgaagttgcctcttctaaagtctgtttttttttttaatttgtttggagattgggaaggaaggcaagggattctgttttatcaatcatatatgttaaaaaatagataatatttgttaactcctaaacaccgtgtgaggtcagcattattgtaaagaagaacactgagacgcagggaggtggaatgatttgccctgatgagtagtgaggccacatttggactggacagtctggtcccaaagcctgcatcctttcttactgactatactctttggcctatctgcataggctattagtatccaagtatctttccgcagcaggacactcacctcagaagttttaagcacttttcctaggtcacagagtcatagctgtgagactgaaattcaagacttttcctatcaaaatcccatcctactcccacctgggagaagccatattccaaatggccctcagacctgatcctcaagcatattttgtttgctcacttagtgctgggcagtagattattctttttaaatttacattagcagtatatatttaaacattgtgagatatgtaaaaatccaggcttctagcttctcaggaaaaataagaaaatctgccaacactgggtgtacattctcaaattctctcaaaggagttagatataggatgtttagggactgcctcttacagcctctttagatgaggttgtttgcctcagtccttaccactacttacccagagaccacaaccaaccatcagctggtttttattgtgcaacactgttgtttttcttacagtagaggaaatgcctctacccacctagctaccaaatcatggcttttatgttttaccttttatcttaataatttgggtggttgtattcttcctgattataaactacttaaagttctatttctgaaaatctccattattagtggatttgcagttgttaaacttaagacccccatagaattgaaggtgctgaaatcactagtccatctacgaaggctagtcactaaaacgaaataggcatacatgaactagaatatatctccttcaatacttcttaaattagaaaattatgagtattgcgcagtcactgtgttcgtcattacaattgctttaacattcctttgtaaagactttctagtagttttgcggagattcaatgaggtgcttataaattgattttgtgccaggtgcagtggctcatgcctgtaatcccagcactttgggaggccttgatgggaggatcacttgagcccaggagtttgagacaagcctgggcaagatggcaaaactcaacctctacaaaaaattttaaaaattatccgggcatgggggtatgtgcctttagtcccagctactcaggaggctgaggtgggagaatcacttgaatctgggaggttgaggctatagtgagccatggtcgtgccactgtactccagcctgagcaacagagcgagaccctgtctcaaaaaaataaataaataaatgaaataaattgattttgcttcatggcatgcgatacgcataataataataataataagtatttcttctgtgtctggctttctactgaagtattttcagttctacaattcaaggcccctccacccctattggtctttctcttaaggggcccaactctgagtgtctctcctgagtctcatatgctcagtctgaaatagttgaccaagtaggaaatggaagtaaagaatttcacggaaggggaatttgccatgagggaagggttaataagttattcctgttgatcgcctttgtaatgcctagcacattctcgttacagagtagacatccagaagtgaaatgattatgtttgatgctgaactcctaagtaattcaatattgtctgaggataatagtcctgcaaattatattacagtcagaagtgtttttgtttttgtttttttccagtcgaggagtagatgactggaggctgccttgtttgcgtgagtggtgttgggatgaccttccaggctgggcatgtgattcctgaagaagtggctacttgtttggctcctatatcaatgcagaaattagtgtttgagctgataggaagtaagggggggaaatcaaggagtggaaaggctgcttgggatggaatctgtagactctttctgtctgacctctggttgctaatctatgttattgttactggaaggggaggcctgcaaaggttgagtcctggcaaggatatcaccagagcaggagatcagtgacttcttagcttataattccactgtaggtgaaactctagcatttgcaggcaagatggaagataaggaagtgggtgaaggggtgaaaaatgaaataaatattgaataaagcgcctgtactctggaaccagattgtgcgtttttagtttctgcctcactctgtcatactattgtgtaagcttgagcaaataagttatctctgaatgcttcagtttcctcatgtgtaaaatgggaataataatagtatttacctcatcgtgtaaacagccagtaagtagcagcatctctgcactggacaatttttcttttgtcaattgctctttttattcggtacctacagtgtcatctaaatagcctgtcccttagtgtatggagtcaggagactaagaagaaatttagggaaaataaggaaggataaaggaataataagcaaggatgaaggattgcctgcatttgagacccttgtcaatgtgtgttttctccaaagaaaatgtgtctcttttccaaagaaacatagatgtgtctctttggagaacttgtttccaaccttagatgatttttcagattcagtctgtgtgctaaactcaaatcttctcattttctaagtacatctgttcatgacttataatatgttaggaaggtattttgccctggtgaagaaggacttagttcttattcctacttaactaagggatagagaagaaaaaccttcaaattacaatgaaattgattgacctcaattctttttagatatttgtctacaaaatgtctttagtaataggttttaatacttttgcagttgattttactaaacagattaaaaatttaagcccacttaacctcaataaacaagtatatgaagtcacatacaactaagtacttcaaacccagaaactctggcactgaaggagataaagtagcagacaccttctgtgtattttcctacttctgtacctcaagacatttgctgtgtacatttataacaatggccatgtcggaaataatatttttgggtttatggatttttattgatctatttcatttacgtgggtttgatcccaaatgatgggatgatgttctcttatgaagaccatgccttgagggaaaggagagtgcttttaagtaagcctgttcccttctggctctctttgatagggtggtctctcccagggtttatttaggaaatgatggaacacaggtcagtctgtccttgtctctaaccaatctaaacattttgctttcagcaaaatttacatattattttcaaacctttactccacatcttgcattattgatttgattaatctctgctgtttttaaggcatatcttcttcaagacagcatttttcttttatatccaacaaattcctttcagatttctaaatgcgaaaaaaaaacttagttgtggacaaaagtacagccattctctttacacctgaagaaattaatgttttttcgataaaagtcaccatatgttaggagggtgacaattggtattcaaatgtgagtgaggaaaagaataaagactgaggcaaacaaatattaccattattgcagtgttccctgcaatctgtgggttgttatttatttacagttttgttcctgtaggcccacagaagagaaatgcaaggaggagtactcctgaagtagaagaggctgtagaaggttggaatagagagcaacaaatcccaggtcaggatgtggaagggcttacaaatcacttaggctgtctgggtcccaaactttctcagctgtaaaatgaagcagttgaacttaatggttctctagttggtgcctcttagactttaatgtacatcctgttaaatgtgcagattctgactcagtagatctggagtgaggcccagggtttgcctttctaacgagctcctggggggtgccaatgctgctggtctgcagatcacacactgtttagcaagctctgcacgatttctaagctcaagcttccattaactctacgattctatgaacgtgcagtcagctgacattttagaaaagacaggaaggtttcatgaaacatgcctaccatggtattaaccattctcattcttcataatcatcttcatcaaaaactctttaagtgcctaattatgcataacagcttcccatgctttacaaaagtatatttggtctttgccttatcagacttgacaacctaagacagagaaatatgtatagagacagtaataaatattgaggcagtaataaatattgagtaataaatgttcatccagatatagaacacattaaaattttttaaaaagtatgtacttagcatgggccctaggatatttattttcttacagcttgtcttcctttcaaaatctgagaaaccaaagaagttgccctataatttttacatgaaagtaagagatttctctttctgttttgcagataggggttggaaatgggaaggtcagtttctgaggctacttttaatgttgttgtttgctttgttttggcctcactgacttaaaaagaaatattttatcagccctgaatgcctaaccctaattaccatatgcaggtgccttggcttgactttgtgcttctcagcactgtgtgtgtacataggcttattaaattagcgtcagctcctcctacccaaggacctcaggcccatctagtcaccctcacatcatccttgggaagcaaaggaggcagagctagacattgttatctctgaatcatgggctgttaggtgataccaagaaggaaactggtatgtccaaagccttgtgataattcacatgggaagctttggatttgattctgtttcttctgtacacatttgcatttgctgaactgacctaaggacttgatctgccttggtgtgggaaaggatcagataagaagtcattgctggcattttctcttgaaagcagaacaggttctgttcccggaggccaggtcaccaaccaacagagattgtgttcaggtacctgtagtgataagccagtttgttataactgtatcacaggttagcagagtgatgtcaggatggctcatttcattgattattgtaacttagcaagagctacaagaattatcacagatctagaaaatggtcacatctaagcaagggtctctgtatcagatatttaccaacagtgagattagagacccttgtttacaccttctcaactcaagtaggcacatataatatttagtagtgactatgtgtatgctcagagatgcgggaaagcggagggagctgtgtgtgccacgctcttgggcttcagctgtgtgttatcttgtgtgtgtgcgtgaggagctgctgtggaatcaggtgcacttgggtttgaaacttggctccaccactcactggctgtgtcacttcacatttctaggcctcagtttccccatctgtaggatcagtgtaacaatagtatgaatccttgtgagcattaagtaagatgaggatatatggaatgtatagcatggtgtctgcaaatagtacttgattattagtaatcatagtaaaactcatacacgacagcatctgaaattacttgtctttaaagaagttagagattcttaattatttcacatgcaagtgtttgtacaggaggtagtgtctgggttcatgaaaatgtcacactcattttattatgaataaagcttttaaggaggcaaagcctccattaactagactcaacctcatctttcatgctaatgtcatacacaactgttttctcttttttataaaattataaagaggcaagtcagtctactcatactagaagatacaaaaccctgactattatatagcaggaagctaaacttctaaaaagccacaaatggcaatactatacattttgcattagggtcttggaatagatctatatggacacatggaattacacaggctgaattgaggacactaagtatctggttgccttctctctggcaaacgagagtggagataggtacctggttgcaggaagtaaggagatgctctttgcctacagacagtgagggaaggctaaccagcatttggaggggcagcgttctttgggaaattgaattttaagcctgctaaccatatcataagactgcaaggcctggcagaacaagagcatgaggcagctggatagaaacccaagaaaccaaaatgagcgacttaaagtggagctgtttgaaggggaaacagagccccagggaatttcctaacctcagaatgctattcactcacccttttttatagggtgtctgtggcttctggttgcctgcaaattgagccagcatggtgcagatgtgacagtggtttaaggctgtttttccccaaatttagtgtgaatcacctgggggtcttattagaatgcagagtctgattcagtagatctgaggtagggtctgagattctgccattttcagcaagtccccagatactgcagaaactgctggtctgggaccatactttaagtagcaagtgtctaatccactctctcctcaaccatttcatcctctgatcaccaccttctgtcttctatcccctgtgccttaactccaaccatttgtggcccaccagtactcaccatccagtgatcctgctaattttccttgtctgtcaccccctccagttctcctttcctagttatctagcttagattccatgatcttgtgttataattattcttttgcatccaccctcaggttctttgctgctccctcttccctcatgatcctcactggcaaaaccccaaccctgcgtaacacagctctctccccacgccacatcttcacctacactggtgagtgcggctgaaggaacacacatcactgtgctcacaggtcccactttcgtctcagtgggtccctgtgccgctattctgtccattgttctgcttttctggatcatcttcttgtgtcctgtcctcaaacctcaaatacctccctctccatcctcattctcagctaataatcttgctgcctttcctggatctgcccacatgtctgcacgtgtgcccacacctggccagtgctcccctcagtgggtgtggaagcaccaggcatgctgtagctctctgaggggtgcccaaggtgggcacatggaggggccagtggaaccagccccctctgacctgcctcccccccaccttcaggtctgtgctcagctaacattttctcagtgctgcctttcctgactccccaactcaaagcagcgcccactccccaggcagtccctacctccacagtgcctctgtggttttcttcagtgattgtcacagctatgctgctagatggtgggtttgttccccacctccactagaaagatacataggacagggaatttcatcttggtcaatatcgaaacccccacctagaatagtggctgacatatggacattctccttaaagaaagtatttggatagatactagcatgggagatgtgattgtgtttggacagaatcagaaaaagccaactaggaagaactgcatatccacacatgtatttaaaaagccactcccggtctttttgaatagacaaggctaaggaagatccctgttcagggatacttttggacctgaatatgctgaatttactagagattgttgagcccaccaggccctttggggatcaggaggggaaaggaccaacatcaaattccatctgagaatcctgtcgcttgtctcatttgatgctctcagggaggttggtagtgtgagtcaggatttaaccacccgacactgctctgcactccgtagcattgtcatactcacttgggacactagcagagctgtaaccagttctattttacaaatctgcaggctaaatatgcctaattcgctgtggtttgaggaaaagagatatatcatggctatgcctaggactccatgtgggccaatcctgatgaaaacaaccacaggacaagttggcagtggaaatgtcctaagatggcacagaatgaagttgattgccatgaaaatatgttgtgctggtcattctcaaggagtcaggcgttcagtctactgaaagtgaaggaaaggcatatctagcaatacttcttattttattttgaggagttctgcttttaataacattgtcagcatgcactaaatcattgtctctcaaggttttgagcagctgtgatgcagagggaaaagcacagggtgttttgtgcgtattggatgagataactgacctcatgcagggctgagaatacaacaggtgctttttacatgcacccactccctcatctatgccctttccaatggtccccatccacactactgtttttctgcatgatatgaaagttaagatataaatatgagagtatgtgagtatgtgtttgtgtttaagagatgccctcactctgtcgcccaggctggagtgtagtggcacaacatagatcactgcagcctcaaaatcctgggctcaagcaatcctctcacctcagcctcctaagtagctgggattataggtgtgagccactatgctcaaattattgtgttttaataagtcatcattcattttagaccagtgattttcaacatggggatgattttgctcctaaggggatatttgttgaagtctggagacatttttgtttattacaactcagggcaggaaatgctagcccctcaaaacaaagaattctccagccccaaatgtcagcaaggccagggttgaaagccctgttttagagcatgtattttacattggtgtttatagttatttcctcattggactctaaataaatgaaggagagaattgagaaggatgtgactggctgaggacacagtgggacaggaggttggaacaagttgggggacccacctatcaggtgccaggattcactgactctttacaagcacactacagtttccagcttaaaaacaagtgctttattagatatactcactagcagaaccccaaccctgcataacccagctctctccccacgccacatcttcacctacgctggtgagtgtagctgaaggagcacacatctcagtgggcccctgtgccgctggtctgttctctcttctatactggttaagcctctaaagcagatagggtggcagaagcacggaggactcaggagggcagtgagcatgatgagatgacactggacaggctgggcactgtgatggggaaattgtcacaatgccaggggcttgggttttgtcacaagggctgtggagaacaagcacggatggggccctccagagccaaactatcctgttcttttctgtactgtattcacaacctgttcatactcctcttatcccttgcgtctctctgtattgtgctacttacttgtaacttgggctcctgaactgggccttgtcatctttgcctttgtgtgccccttgtatatagcacagagatttatcagtaagtgtttattaaacagatttggtggtgttttagacaccactagcagcctctcaaaataattgtttctccacttttgaacaagtactattcccaaatacttgttcccaatgcaattgtttagagcttgaaatgcatcctcctggttttataaatgataggttttcagactggtggggaaatttcccagcacccacagtgttgttgagccataatgcttagtagcccaggatgtgggatttcccagcaaaaggccaagagaagagagtttccattgcctttcttcgttgtgtgtggactcttggcaagtgggttctttaccattctactgcctctcttggcatggaaccttctctcaccttctactgcacttttctcttggtactcatattcaggcggctcttagaccacatgggttaagagtctgggtgttcatgtcttgctggccactgtggagtctgacactggagctcatggaggaattaccaccttgcttattgtcagcttgactatttggtctttcaaatgttactttgcttttcatttcttctaagaaatagctctttcttttctcttttaaactttaccaaaaaagaaaagaaatagctctttcttttctcttttaaactttaccaaaaaagaaaagaggggagaggaggcaccagtttcccccagtggatatttctcctgagaaaattcagtctcgttatcaggttcattctttaactacccatgctttttacttccacttagcatattttcagatgtctacttagatgcacagttctacaaaaacagaattttcgatttgagattacattcctcaaactcaaatcacacttattcttggagaagtgatctttataagtgatagttttatttttaagcataagaagccatgttaacaaaaatacagcatatttaaagatgaagacattaaataatatagctaaatataacaattatcacgtctctatacaattttgtttcacctttttttttttgtgctgaaaagactttcatcttcttgaggcatacaaccaattttgtttttgcttaatccatgtgcattgcacatgggctctaggggtctgtgtttgaggtgtgcaggtgcagtgctggtgataactcctagttactgttatcattggtgggattgagttagaaggcagcaatgattaaaacgaagtatggacataatttattactacatgcaattaatgccatcatttttacttttctacatgtataaaattagggataatgtttaggtctggatgttttaagagcaggttttagcttttgctttttaacattcttttattatagtattaaagcagtaaaagctaattaaataagcctttttcagttgcttactgttggccaaatgttaaataagtaaataacaagatgatcattttactcttaattgttgcagttttaatccagttcagaattttgaaattgttttctcttgtgtttcttttccagaaaacacgagatttttctcctatttcagcagttggccacaacttcattgctgggaaaaggtgatttcaaagtatttatttatctggtttattctacattattactcattcaaactggcttttagtttaactttgcatgcatcagttgttgatttggagactctgtttgggttaagtctgcagacacacagcttctaagctgaaaaacatccagggaatgagcttgtctgatttgaatttagcaacttaggtcttctgcgatagaaaccaagacgccaatgggtatacttcctacaacatggtgtttccctttgattggtggtaagcccatccatggctgagctttgtaaagcctctgtgaagttgggctaaatgcctactctgtctcaatctctttcctcatctttgagacagggataataattggatagtctcatgggcttgatagagagattaataggatacacagtgctcactgccaccaccaccaaaaatatacgaggctgtgtttttggttatcattattcatggtattaataatctcattttgtgctgatgataaagttatgttaataattccttaataaccttgggtcatcttctgcgaacagaccaaatgtggaaaaatcattcagactaaatgaacaggttaacacaaagacattctgtcttttattttagaaattcatttactacaatggttatcagtgtttataatgaatcctggacttcgaagcactatgtccacccatttgaaagatttattttacaaacctcaagtgttatggcctgcccgactcatattcattttaaatcattatccaatgcctgtatggcctggaaaggaattcatctggtctaagttttcccaatctcttcaccaaaggaatcttgtaaaataggccactgtcttttaattaaatctttgcttcaacttactgagaaattccttctcttgccagagtaaccctttcctcttaggagagcagggagctatttcagggttattttggttcccctctgaggccacagtctttctaaatataactgcagatcctggaaatcagcctgccttttgttagttaacttaggctaaagaatcagtgcattaagacctttgattatccacattctaaaaacgccttcctctgatctcctaatatttgacaagaatctcgattcagggattagacattttctctaatgcatttccatttccactagagctgctcgccttacacacattatggcctgaaatgtagagcattttccggttgggggtaatgaagatttaactcaagaatctatatactttagaataggcatcacatgtttctgtaatagaatcacattcctcccaatttctggaaagcgttgtgtggtacttttttgtacatggctgacttcttgagttttactccatctgaccctcctatagaagctaagcttgaggtcaatgtttgtatcttattttagtacctacaacatctaataaatgcctggagcatagtaacacacagtgaatgctctaatttctttaaatgaatatatctctgacactaaagaagatagaattcatgaaaagtaatttatctcaagctgagctttttttctgactagatataagcattcttctcaacaataatgctttgcttgttattttcgccacattaaagaagtgccaccaaaaccaatttatgtcccctttccctcttctgctgagatcagaactaacatggtggctacattcttttgaaacttgtaattgtgtgtcatttccacagtggaagtagattcagacagtatctgcaccaactttagtggtaatagtagcgactttatgatgttttaatttgaaattcaaaattttaaattgtcccaacccattttcaggcttccaatgtgcctgtgccttggaaatgtatttcaaacttccatagttgttctttccagttattagaaacataagcaaagcaggctgggtgcagtgctcacgcctgtaatcccagcactctaggaggccgaggcgagcagatcacttgaggccaggagttcgagaccagcctggccaacatggtgaaaccccgtctttactaaaaatacaaaaattagccggacatggtgttgcacacccgtaatcccagctacttgggaggctgaggcacaagaattgcttgagcctaggaggcagaggtttcagtgagctaggattgccccccaaaaaagagaaacacaagcaaagagaacacagaatcagcaaccgtccagggagatgtgcactcctaagctgaattaacaaataagtgtgtttcttgagaggccagagttaacacaattagtgatgaactgcgtctttgaggagctaggggaaaataatgggattcatttttaattcaaaccaattctaagcaagagccttggctttctggagtggctttgtaatcaaaggttaccgcagggcttgtcagaacttttaacaactgtctccactgtgaaaatggtcttaagttgtaaggtgattgcagagctgaggaaatgatgactctagccagcttttgtctcgcatttgatctttggctcacaaagacgaggttaatttcagcataagctgttagctttattttttaaatcagtcaattttaatagcagcctgcttatgccctgaaaaacatccaagagcagtaagaaagagttggcctggaatataaatgttacagtataaatcttagctatctctaggccagtagtcaacaaaatactttgcagtcagtctaattaatctttcattttctttttgctatccttccttgtgtttattgtgtgtgtgtgttttctgaactataaagcatatacatagtcacgatagttggaaaatttaatactctcaaggaagaaaaaagtttccttgtgaatccattacccaaagagaaccattgttagcatcttggctggtacttttccctgagaatttttcccaggcaaacatacataatttttaaattccttttggttttgtttgcttttagagacagggtctcactttgtggcccaggctggacatagctcactgtagcctcaaacccctgagctcaagagatcctcctacttcagccttccaggtagctaggaatacaggcacgtgccaccatgcctggctacttttttttattttttgtagagatggggtctcaccatattgcccaggctgatctcaaactcctgggctcaagcgagcctcccactttggcttcccaaaatgctgggattgcaggcatgaaccaccatgcccagcctcatacttttaaactgcttatgatgaaaaattttatacacacacgagagaatcactgagtccttacatattcacagtctagattcacagagtatcaagattttgccaccatggcttcacctatcccttttttctttctccctttctctttcctcttttgaaatatcaactaagctacttttaagaggaaaagatgactcttgatattctgaggactatggaaagcaagtatttgcctgccaatttcacatattctcacttatcctttattaggaagcaaaaagtatggttttacacttcatattgtattgtactttgggaataagctgccttaaagctcaagtctattgcatgctagatgggtattgatttttcctcttaaatcaatgtttccctagggcatagttttatttattcataaagctaagatgatgtctgacaggagttacagcagtgtaaatctgtggtgcaggcacaataagaagagcttttgtaacactcaaaaatccatgttctgatgctagagggtatcctcataagcctgaaaaagtgcatttgcgatgcttgcaagtgtaaaaggaacatttcagcatatcgttaagttttactcctctgttttctatgctactttgcaaatggacctaaatacattgtgactgaagccaagccatgattgtgtctgatgcacaacgggttattggaacagcaggctggatagaatcaaagcttcagccacaatctcttgttgacaccaaatgtcagcttgctccggaaggatgtagtggccctgttgatctgtcccctgtaattttgctccctggcccaaaggatgggcacttctgcccaaggggcagttaacatgagaatgttcactttgggatacttcattcactttggaataaccctatgtacttgttggtgtgttatagtacatgtaacagctctctgtgtagctaggccatgtaagtcaagtgtaatcctaaaagtgtactcattttgttgatatatatatatgacatatgatatatatatgatatatataaacatatatatacacacatacacacacatgcatatatatacatatatatataaaatacatagtctattctgttttaaaagtgtttatgatattaaaattattgttagacttttttaacttaaagaaaatatgccctgacttttccctcaacattaactgatttttttccctatggttgaaaaatgcttctaatgggtagaatggcaccatttggaattttaaatatccagttttttattagcagtctgatcttagcacagtagaactggctggagagtcaggtgacgtaaaagctagtttcattatccactcttggctgctttgtgacctatggcgagtttctgaacttctttgggacattttgtttatattgttgtttttttcccctaatttaaacagcagtgagtttgtgagaaattggcagatttcacttcttgatttccatagacttccatacatcaggactcttccgtttgaaagtaactagttgatatttaaaaaaagaagaagaagaaaaggaagtgaaaagagaaaaaaaagaatgcagaagtgaggattatttcttcatgaagaataaggtttgttccagttttaaaagcctgtgacttctctgtgaaaacattgcagatgattagctcagctaccaggagccacacagttttcttagaaattgtgccattgaggacaccaagggggccagggaggacacagctccagttagaggctggggccttgagcgcctccccccaagagcagctggtgctctgccaggtctgtggctcccaggatgcccagatcccttgccagaggtttgggagaagccttaaaggtgctgtctcttcggatctctgctgtttcctctccactgatagctacattgggagcctcttcagaggaggcttctaggaattagaagggaaagcatataaatgccattcactacagtacctgttcactgctggtcacagttgttctcctttgcctcatcagcctcaggcatggagataacctggtggcatgtcagtgtcttcgagtttttcccattaagctccaagagcattgattgctattcacttcatgaatggatgtcttgagaagatcgtaagaactacttttgaaggaccgaggctgccgtctctgcttcagtagaaacccgaggtgcctgacatgaaaagcacactagaggacctatttgaagaagagagagttagctgtttggaatctaaccgtttatgttaaggtctgtgtgttaggttttctagttagctttagtcaagtccttcaaggtctttttttacattcttccaatataatctgctttatattctttaatagtatgtttttgctcttttagcattaattaattatgcactcctataggaagctgattaggaagtcatcctccttgaccctgtgtttggttcctttagagcaggggttttcagcctttgcaggaaccaggccacacagcaggaggtgagtggtgggccagcctcctgtcagatcaatggtggcattagattctcacagaagcatggactctatagtgaactgcacatgtgagggatctaggttgtgcactcatgatgatcttagtggaacagtttcatcccgaaaacatccccactccccctgcctgtggaaaaattgtcttccatgaaaccggtccctggtgccagaatggttggggaccactgctttagaggtcctcttggctccccaagtcaaccccggtgtggaagctaaagtaattctatcttgtaagctaatctaccatgttgacttcttattaacagttccaggaatgctctgagatctccagtttgtcttttgctccttgtgtaagagcatatacctaccataaatcctgcccttagagcagatcaaccttgacatactggtacttactataaatcctgcccttagatcaaattcctcctcatttcctctggagcatgtgtaccccttccctgggtatataatccttgggtctgggggtctaatgacgaggagatctgcttgtcatgtggctacccaagaccatgcccctgtccgtaagttccccaataaaatcaccctgtaatgacaagagggacttgtctgcctccttctttggttttttgactccttctgtgtttgggggttgctttgcctatatgaccttttcgtgaaacacctggtcattaatggagtgatactttcacagccagacacctgtcacatccaaattactaacataaggtgattttgaatgctggatttctaggatcaaccacaggttctagtacttaaaaaaaaactttaaaaaatgttttttagagactcccactccgtcttatgaaagctccatcctcaccagtggagaaagaatttccctgttgggtctttgtgtcttgcaggtggccagaggtgctcactgaggcctctcctgttcagtcgcagagagctccagaccagtctcttgagcaaggtttaatgaagctgtggctgccttccatattcctttttcatgtcatgaaaaaagatacttcttttgtgggcctgccactttaggaataaaaaccctccctcaactgcttagtaccaatattgccctaagaaggaagtacctggctctcatggccttatctgagcctcgaatagaggagacccacgcaggctggaatggccctgcccaggcccactgggagagatgactcagttccaaatagggctttcattttagatatttaaattccaagtttctcatagttattcatgactaagaaaaggggcagctctgcactattccttcactcacatatttccttcctttctcttttttcatcatcttccctttctccctttatttagtggatttttaaaataaataaaatgctgtgtggcatagcactttgccaaacaggaaactctcataattttgtaatattttctagaatagattttagaccagccatagtgaaatttaattatggtgctaatgtgcttctgaagattcctgataaaagacttgtgcccttaatcccatcgactcaagaggccgaggtgggaggatcacctgagtcctggagtttgtggctgcagtgaactatgtactccagcctgggcaaagaaaccccatctcttaaaacaaaacaaacaaaaaaaaagatttctgttgagaggataaagttaaccctgtctatggtggctttaactatgacaaatcagccagcagtaaattaaataaataattttttttctagtgtttcttataagggaagaaccaaaagattgagatttatgtgaaaaatgaaaaatatctgataatgggatagctggaaaacttagaaaattagaaatgggtttgcgatttcattcatgtgatcctttgccattacccatctgatgccccatagcccaaaggcatgctgccaatatgaatgtttacatgtattttttatagctgaatatatatagtttataaaatggatatataccattaagatgttgttagacaagtattaggccaaacaggttatgtttgcagaaaacaagtgtgaatgcaaggagtttagtgtgttcttaaacttctgctaacaaaagaacttccatttacttttacagagttaagtttgcctcctgagtatatgagaatgtggcataggccacagatagcacctcagaattgatgtcgactggtgactattgcgatgagtgtgggtgcttttatagataactgaggtgttgttagctgaagtgtcaagagtggctggattgtaattgttgactcattttaaattgctttgttttataatctcttaatataataaatatgtagtattttaaaatatgcctcaaagacaccaaaaatgatgaaaaccactgaattacgagactaaactgctccctcccatccctcccatttgctgtctatcatccttttcccatgaaagatggcttttataggttgaaagcatagaggatggctccttcttgtcattcagatctccgcttacgggctaccttctcagagaggacttccccaagcatccatggctcaggaaaccccataagacactctcacctttccttttttacgttttaaatgttccctatctggtactttggtgctagtcttttgtcagtcttcacctacaaggtgctaagaccccatctgttttgttcaccctgtgtcctgagtgcctggagctgtacctggcattgagtaggcattctttagatgttccatatgcaggctttttcctttggacctacccctgtgcctgaccttgagagcatttcatcatcattgcctagaatcaggcccttgttttggaatctgtggtactgtattctctgaatttctgtcattaaccagcctttactccctggttgcagcatctgattagtatgatgataacacaactactgtatgtcaacatgatgagcatttgtggcaagtgagtcctatcaaattttccagccacaagagagcttaagaaaggttttgagagagaaatgtgtagacatttaagtctttcctatgctggtgttaaccctcaagatcaattggccagaatgttctgctctgatggtagacctgagtaatagcatgttgtagcttccttttttagtactgttatttaatttacccccgtgagtaatgctataagaaggaaggctttaagaatacttcacttctcatcccccgacttccagcccagtagcctgagtctaatcttgttatgtctgggaatagagttactagattttctgctaatggctgtattttacatgataataaatccagtcttttctacaaagtctacttaatttatgcaaaacagatataatttggaatgtgtatgaatgaagctattctttcaagggagcagagaggctgctgtagagcctgttaaatacaattttatgggccctcatgtcaggttaacacaagcaaatgttggttctgtggtcatcaaaggtaatgcttattggatagtttcaggtaaaacaaaaaacagcttttgaatctcagagcctttgctacttactccctaatttaagctcaacttgttttcaaccatctttcacactttgaagtagtgacctcttatacattagtggcctcaaagtattagtgagactcctgctcattgattttcaataatatagagaaggtattccaaactagttctggccattaacagagcaaaggcagtaaattaaattagcagggggatatatcaaaagccttttgtacatgccataaagtctccaaaatctaatccctgagagaaatttattttgttctggaaagaatagctttcttctattctaaaatacctttcatttataaaagaatggattattgcctgtgaatggaatagcaggaattctcagtcctttaattttgccatcaacttgctgtggtttatctcaaaaaaataatcaacctgtaagaaaaacatccgtggctgctctgctctttgacttttaggtagagttaattgtatagattaatttaaaagttaggtgtactaattaatagttacacatttcagaagtccttagctcagggtatttattgatttttgtctcttttgagttttataaaaaagctagatgcctgaaaacactgaattgttttacaatgctaagttaagaatgagtaaccctgccttcttactaatggacaaaattttgattttttgatctaatgccagtggtccagtgcagaaacacaaatatttacttgcttaatttggatggataatcagattttttaattattttcagaggcagggggttaaaaaaatacttaggctttttttttttagatggagtctcactctttttgcccaggctggagtgcagtattgcaatctcggcgcactgcaacctccgcctcctgggttcaagcaatcttcctacctcagccccccacaagtagctgggattacaggtgtgcactcccacacccagctaatttttgcatttttagtagagatggggtttcaccatgttggccaggctggtctcgaactactgaccttaagtaattggcctcccaaagtgctgggattacaggcatgagccacaacacccagccccaaaatacgtaggcttttaaagcaagataagtgtgctttagggagacctttttgcagaggctgatttagctatggggagataatagactccttcgagaagctaatgaatattctagactgtctgaagaaagacacatgcacagaaaatttgacataattgcaggtagtttacagaccctctgaaagttggccaagatcctgttggcacctatctataggactccaggcaaacaaaccctgacttacttcttccaagcaggaggtatgtttaattttgtgctgtaaatactggtctttcaatttctggtagtaacataacaccccaggcatatttgaattttataaaatgctgtaatatttttatctaaacagaaacaacatttacagttggccctctgtatctctgggttccacatccatggattcaaccaacctctaattcaaagcattcaaagaaaaaaaaaaaaagaatgtttgcctctgtactgaatgtgtacaaactttatttcttgttattctctaaacaatgcagtatatcaactacttacatagcatttacaatgtattaagtattataagtaatctggacatgttttaaagtacatgggaggatgtgtatagtttatatgcaaatactatgcctatatatatacttaagtatatatacttaagtgtctggggattttggtatctgaggggggttctggaaccagtcccccagataccaaggaacaactgtatttaatccttttgcaatgaagtatatatttaagatgctgacaattattattaaagaaatagttatatagaacacttattgagttaagaagatccattttattttttgagacaggatcttgctctgttgcccaggttggaatgcaatggtataatcatacctcagtgcagcctccaactcctaggctcaaagaaccctcctgccttagcctccccaagtagctgggactacaggtgcatgccacgatgcctggctacttttttatctttcgtaaagacagggtctttctatattgctcaggctggtcacaaactcctggcctcaagtgatcctttcactttggcctcccaaagcattgtgattacaggcatgagccaccaggcctggcctgaatttctaacaccagctttaaaagatcttgctctggtgcccaggttggagtgtaatggtgtaatcatacctcagcgcagcctccaactcctgggctcaagcgatcctcctgccttagcctcctacaggcacacaccaccagctttaaaaggacccccaaatcaattctattgttaattttcagtctgtctttcccctaagtggggatgttaagaaagaaaatagtatcagtttttattaccacttgcctggcattttttaatttgtttttcccaagtattcctagtaaattttgctttattctcctttatgtacacacattgaaacctgcagaaggatggtttcttttctttgtgctgctgttgttcaaaactgctataagaatctacaggtccctttttgggtccatggtagattatggtttaacactcatttaatcttagcaggaactaagattaggattggggaaaaatgaacaaagaaatctctcaccaaacaattcctatatatgcaccaatgtccagctcaaatctcccttcctctgcaaaaagttccctaatcccttccatgtcacatctcttggcaagtttttgatacctcccttaaggcagtatttactgttatcagtaaatactcccttctgctagacaaggagtttaactaatggaactggagttatttttgcttttgttattgatatgtaaaacaatggctaccaaaggatttatatatatggtggaaagaagtacaagaaaagtcattaacttgaaaaagggatttacgttataagtaaaagactggactttgatattctagtacattttaccagtgatactatttttccaaacatttctcaaaaatttaataatcacatgaaacatactcagttattttttttattatactttaagtcctagggtacatgtgcacaacgtgcaggtttgttacatatgtatacatgtgccatgttggtgtgctgcaccgattaactcgtcatttgcattaggtatatctcctaatgctatccctcccccctcccccgaccccacgacaggcccctgtgtgtgatgttccccttcctgtgtccatgtgttctcattgttcaattcccacctatgagaacatgtggtgtttggttttttgtccttgtggtagtttgctgtgaatgatggttttcagcttcatccatgtccctatgaaggacatgaactcatccttttttatggctgcatagtattccgtggtgtatatgtgccacattttcttaatccagtctatcattgatggatatttgggttggttccaagtctttgctagtgcgaatagtgccacaatgaacatacgtgtgcatgtgtctttataacagcatgatttatagtcctttgagtatatgcccagtagtgggatggctgggtcaaatggtatttctagttctagacccttgaggaatcgccacactgtcttccacaatggttgaactagtttacagtcccaccaacagtgtaaaagtgttcctatttcttcacatcctctccagcacctgttgtttcctgactttttaatgattgccattctaactgttgtgagatggtatctcattgtggttttgatttgcatttctccgatggccagtgatgatgagcactttttcatgtgtctgttggctgcataaatgtcttcttttgagaagtgtctgttcatatcctttgcccactttttgatggggttgtttgtttttttcttgtaaatttctttgagttctttgtagattctggatgttagccctttgtcagaggagtaggttgcaaatttttttcccattctgtaggttgcctgttcactgtgatggtagtttcttttgctctgcagaagctctttagtttaattagatcccatttgtcaattttggcttttgttgccattgcttttggtgttttagacatgaagtccttgcccgtgcctatgtcctgaatgatattgcctaggttttcttccagggtttttatggttttaggtctaacatttaagtcttaaatccatcttgaattaatttttatataaggtgtaagaaagggatccagtttcagctttctacatatggctagccagttttcccagcaccatttattaaatagggaatcctttccccatttcttgtttttgtcaggtttgtcaaagatcagatggttgtagatgtgtggtattatttctgagggctccgttctgttccattggtctatatctctgttttggtaccagtaccatgctgttttggttactgtagcctcgtagtatagtttgaagtcaggtagcgtgatgcctccagctttgttcttttggcttaggattgtcttggcaatgtgggctcttttttggttccatgtgaactttaaagtagttttttccaattctatgaagaaagccctttgacaaaattcaacagcccttcatgctaaaaactctcaacaaattaggtattgatgggacatatttcaaaataataagagctatttatgacaaacccacagccaatatcatactgaatgggcaaaaactagaagcattccctttgaaaactggcacaagacagggatgccctctctcaccactcctattcaacatagtgttggaagttctggccagggcaatcaggcagaagaaagaaataaagggtattcagttaggaaaagaggaagtcaaattgtccctgtttgcagatgacatgattgtatatctagaaaaccccaccatctcagcccaaaatctcctttagctgataagcaatttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggacacaaacaaatggaagaacattccatgctcatggataggaagaatcaatatcgtgagaatggccatactgcccaaggtaacttatagattcaatgccatccccatcaagctaccagtgactttcttcccagaaacatactcagttattaaatgtatttaactatcagttattgctaagatggaattaaagtcagttcttaatttttcaaaaaaaaatgaaccccaggatgaattcattcatttcattcatttaccaaactgaattctccaaatgtttattttataccctgaaatcagttcctcttcctgaatttcctatcccagttaatggcactgccatatgggcaacatagtgagaccatgtctctgtaaaaaaaaattaaaaattagccaggcatggtggtacattcctgtagtcccagctatttgggaggctgaggcgggaggatcgcttgagcccaagagttgtaggctgcagtgaactatcattgcactgcctcactccagagcaagaccctgtgtcaacaaaaaaaaaaaaaaagaaaaaaaaagaaattaattcagtgatgagttagtgtcttggacaggactgaccttggcttagtcattgtatcctgaatctattgatgtgcctcaaggttataataattataatggccacattgggttctttctacccaccaagggcagtgataaaagtttcccccttctcccatccagtcttcatcatgagcttttgaaatgtaggtatgattgagagtgaggagtatagggccgactccttgggctggaatcagacctctttcaccacttaccagctgtgtcacttagacatgttttccggccccctgtaccttagtatactcatctataaaacagataatagtatctcattctgaggattgataggaatattaatatactcttttttttttcttttttgagacggagtctcgctctgttgcccaggctggagtgcagtggcgcaccttggctcactgcaagctccatctcccaggttcacaccactctcttgcctcagcctcccgagtagctgggactacaggcgcctgccaccacgcctggctaatttttaaaatatttttagtagagagggggtttcaccgtattagccaggatggtctctatctcctgacctcgtgatccgcccgccttggactcccaaagtgctgggattacaggaaaatattgatatactcttgaaccctgtgcctcgtgttagctgttagagtcattatcctcattttgcagtcaaggcatctgagcctcagaggttaaataacctgccccatttctcacacagtcagtataaatcagagccaacgttttggaaccatctgtctgactgcaaggccttgtatatgggatatatccttattgaacagaatgggaattcacaattacatgttttcaaatttcttagcatagaaatttgccttacgtacatatgttcttcctgggtgatcttgtccattccaagggcttcatttgccatctaatttagggttggcaaactatgacctgcaagctgaatacattctggcacctatttttgtaaataaagttttattggaacacaggcacactcgtcctttagctactgttgatggctgctttcgtgcaatagtgtcagaggtgagtagatgtgagagatcctatggcctgcaaagcctaaaatgtttactctctggccctttacagaaagcattcgcataccctgatcttgctcactactttcaacctttctcataagatcttgattcctaaatttagccacccaccaaatttcttcatgccccatatctaccttaaaattaacattttccaacctgatttcttcaaatgtccatttcccaccctgaaatcagttcctcttcctgactttcctatcccagttaatgacaccaccatatgcccaaggtgtatctcccctttttattgctcatgcctgatgtcttcaaaagggctgttcattgattatcctaaatacatacactttttgaagacagtaacctaggcttttaagtaaccaatgctgatcattctagtattctcagtccccatgtgcgattagaccagaaattcctttgacagtctgtcagaagttgctttaaggtatattcagtgagaaataactatggtctgtctctgtcaagtaagccatggaaatatgaatccatttctcgactttagatactgtttcacaagtaagaattaaagaatgctagaaagtcagaatattgtaaaatgtgtagccattactcaaatatatggaaaagaacacaggtttatgacttattgagttgtcacttcaaagttattcgtcattaatgttttaaaattaaatctctattctttattcagggcctcattggctggcagggtaagaagttaaaattctaacatcagattatcattttttcttgttcatccaaataatatattcagataatacattcatgttcattcttatcaatatcacttgaatattattccaaagcttatgatattattaactctgcattctcttttatgaatttacaattacaattatgctataataactgatgaagagcacagaagagcattgtaaaaataaataaactttgaaatacgaaaggattagtggggataataaatatccgctcattgtcttatcatctttgatcttggcatttgttctatccagcaaatattttcatagtactttaatttcagtttctttatctgaaaaattatgcaggagcagcctttgttttccaagaacaacagagatgtttatagcatttaagtcaaaagcagagataataaattaattctaatcctctgagcaaagacattagcttttgtgtagcacagggatttgggtttgttcacacaaaataatcccaagaataatagttcccggtgctcacaattgatcttaaagattaatatatttctgtggttaatgattatgtaatatattaataagcttctccaaatacttcctgaaattttaattatctgtagacttttaaagctatattttgatcagacatgtaaagaagcagtgtagctcaatcactgtcaaattaaggatgattttacattctgctttagagaaaaatgccacccaccatcagtctgcaaaatagctgaaatacttagaagaaaaaaagtaagtagttaaggatgtctcaatgccgtttttgtcaactagcctcatgcagtggtgggggctactgaacttacaatttcactctgccttctgctgggagtgcaggtgcccttggctggcctcccacctaagctagaggtggcacttaaagtctcgacacagagtatcacataaaaatcactttcaagtctttaaataggttttagctatgaaaatgaaaatttggaaactactttcttcaacaatgaggacgtgactaaggatataaaaatatttaatagtttatagtcttttttttttttttttgagatggagtctcgctctgtcgcccgggctggagtgcagtggcatgatatcggctcaccgcaagctccgcctcccgggttcacgccattctcctgcctcagcctcccgagtagctgggactacaggcgcccaccaccacgcccggctaattttttgtatttttagtagagacggggtttcaccgtgttagccaggacggtctcgatctcctgacctcgtgatccgcccacctcagcctcccaaagtgctgggattacaggtgtgagccaccgcgcccggccaatagtttatagtctttaaaatgatttatgcaggctgttttgaaacatagaaatgcattttttacgtaactgaaaatggcacatgacactgtatttgctgatggcaacttgctaaatatttacataaaatcaaagatcaaaggaaacatcagagtacaatagagtttaatgttcattgttttctctgttttctataaagttgtttaactttacaaaaattgttatgacctgtttgtcttaagaatgtaaaaaccctccttttctcatcattctaatgagaaaggatgttcagtcgtcctaatgactgaatttttggaatgaagtctttttataaattaggtctcttctgatgtttttctttttctgggttgccaaaatcttatatatgtgcaataagccaaaaaaggtgggaagatgaacagaagatttagatttctaattaatcgaacacaaatagagaaatacctaagtagatgtgccattctatagaaatttatgtgacagtttggggctgatggtttcaaaaatcttaagtcgtttttaaagggcacctgcctgtgattcatataaattaggacttctctgttctcatttttctatttcctcttatcacatctaacagggacactaatccagtagtgctcattttacataagagcagagccttcaggcttaacttgggcatgtgatagagctggcatcacgtcatccagcccagcactcagtatcagagacagcttacagatggatggagaaaaacccactgcataagaaataattctgcattcattaagaggcatatatatgtataagctttatctcaagaaaagtaaaatgtaagacaaacgtaaagtcaccatcctgtagagaaagagagtgatagaagaatatgggcaactcaaattcactttggccaccttctctacttgttcaattctgtaagactgatgattctgggaggctgaaggcagtgagtttgtgtttcctttggaatgagcacatgttctactggcttctgccagctcatgcagcaggaatgtgaggatgcgattgcggagttgactcaccagctgatggactcaagcacctacttctctcctttcattgcctcagtgggtttctctacattatctcactgggtttacttgtctttctgttttcctatctggaaggaatccaaatgccttaaatccaaatgtatttaccgcacatgaattaacttatagacaaatacagatagaaaggactgtgagtaccattttttttttatttcaggactaagctttggtctctcccatgtcttatggcattttatgacagctacacttatgaaggggtaactttatactaaaattgtggcttgagaactgcaacatggtgctggaacctcagatctctgtgattttagatgcgtaaaactcaaaactgaatttcaaagagggtcttctccagccaccttcttaccactcttcctgtgaatgtttaaatctaagtttgctttattagataaattctgacatttgggtatatgaatgaggtagactaatttatgtgattaaattctcattcatttaataagaggattaaatgcttcattgcaaaatgctgaaggatatttttaatttacagtctcaattttaattgcaacactatcattctgttttgagcatcgaggaatagcaatgaaacgtgtttaagttataaagtaatgattatgttgaattaattttaaggcagttttccctagttttgtttttataggaaaaatatttacaagttaatttttgtttttatccatatataaaatgaaaatagtacattaaacatgccatcctgtgtcaaatggggcagactcggggagagaccaggagagcagggagggaccttctccatccccagtcccagcgtggggtttgttgtatggtaggtactcagtaaatatttactgaatctccaaatgtatgattaactactgggagtcagcagtctagactggagtaccagccctgttagtcctcagtaatatcactgaacctctcagtctcagtttccccatttgtaaagcaggcatggcaatgtttcctgtcgttttaatggaagactgtgagaattaaagggaaaacgtggcacattttagaaaactggaaaatggtgatataaggaatcctttctagcattattattttgctatgtgctgcttattagtgcccagtgtttgttagtattagcatccagttagcattcaacgaatgcatatttaaaataagctaatgcactcacagtaaaattgaggacacattagcaatttatcatacattatttgacttagcattttttaaaccctatatttatttaggtataattgtaattcctttatgtgcttagtttacttttgcattttcataggtggacattgaaaaacatatatagacaactaaatcattatttttctgcagcattgtacattaatagctttttgtgtacatgtgaataggagttggcaaaagaatgtagcacataatataaaggtttaagatgtaagtaaatgagaagctggcttattgctgtcacttctttggaaattagattagggcatatatcacattaaattcacttttagatatgttgtgaagctaatgacagggctttgttgaagtgagggtttgtgggttttgatgaagaaaatctatcggtatatgccttatcttttattctctcttcttgctcaatgtgtaattaggtttgctctgcaggatcacagtatagagcatatattaattttatattcaccctgcctgtaatgattgtatgctagcacttctaagtgacaccaaaaatgcattaataaagtcataatcgttagccagaatcacaagtattgtagtcctaaattttgctttattttctctgtatgtccttaattgatgatgtattaatgattgaacccatttgagtttatttgtactgtatattatatattgcagtgaaacactgggccgcaaagacttatgaaatataagacaaaactttgtccaggcagggagatgggacacaatctcacaacagcttttaagatcatctaataaatgtatgtacatttatatatacgaatgatgctagcgtcgttgatgtaaatcataataatgacaaccaccctgaatttcccaagttctgagaaaaactgaaagataagataaaatcattgtcagataaggctcaaacatcacccttattatctgtaaaggccaggctgcagggcatggtttatttgttctcctaatatggaacccaggaattaagcacaggtcacagcggctggggcaggcctctctgggcccagagaatcaactcaaattatttgctggaggatcagaggagaattcatattcatggatggtagccctactccctgcagagagaaggcaagagctgagtccaggagatgcttccccaaattgcccattagacatgtatgtcactcaacctccccttgggtagagtaaatgaagagatggaaagagaggtattatatgctagaaatgtgtagggaaaaaagcattctcccccaatataagacaggtaatataatatttgatgtcaagtgaactgggcagaatctaagagcagaaggaaaagaacaagccttgctaaaaaggacagtcaggacttagagctaagtggtcaggggagaagggggaagaacattccagtcatgaatggtatcagcaaaggcacaagcagggatgaggagtttgtgttggaaagaagtcaaggctggtgaatcaggttacagagggctggaaagttctaaccacaggaactagggagttccttacccaaggagctttcggaaatggtgcatttgagtacttccttgtgaacatgtgtaggagaggtttacttttttctttatcctagaacactgaactctaacaatggttttcatatatttgcatgattctctctatagtttatcttggctaattacatttaactatgggctctccaattatatgttgaactcaatgactaatcatcagatttcgatagcaaagagcctataatttcctgagtgtatgacctatgtaaggatatgttgcagagagaagctgtttcctttaccatagtaaaaatttgtttgtggttacattagaagctacctctaaaagacatttagctctgagatagtttttaaaattgaagtttgtagtgtgtgtccatctgagtggaccctatggaatcctgcttaccaggtcatgcccagatgcatgagacaagagccttttgattttaaaggcttctgtttctgtttaagtgattattgtatacattcctccaaaataaagacttttctcaaaagaagacatacatgcagtcaacaaacatatgaaaaaaagctcaaaatcactgatcattagagaaatgcaaatcaaaaccacaatgagataccatctcacatcagtcagaatggctgttattaaaaagtcaaaaaacagatgctggcgaagttatagagaaaaaggaatgcttttccactgttggtgggatggtaaattagttcaaccattgtagaagacaatgtgttgatccctcaaagacctagaggcagaaatacatttaacccagcaaccccattactgggtatatacccaaagaaaagtaaattgttctattataaaaatacatgcacacatatgttcattgcggtactattcgcaatagcaaagacatggaatcaacctaaatgcccatcagtgatagactgggtacagaaaatatggtacatatgcaccatagaatactgtgcagccataaaaatgaatgaaaacatgtcttttgcagggacagggatggagcaggaaaccattaccctcaggaaactaatacaggaagaaaaaaccaaataccaagtgttctcatttataagtgtgagctgaataataagaacacatggatacatggggggaacagcctatactgggacctgccggagggttggggggtaggaggagggagagcatcacgaagaataactaatggatgctgggcttaatacctaggtgatggtatgatctgtgcagcaagccaccatggcacacgtttacctgtgtaataaacctgcacatcctgcacatgtatccctgaacttaaaataaaaattggaaatttaaaaaaaagaccttagaaacggggcttccaagagtggtcacaatcaattacaggattactacatagattttcttattccgtgcattaaattatgtttgcccaaaaacaatgttactaaaaagaaaaacattttaatatgaaactttgctataggtctgtcctgtacccataaagcaattgttaactctttgctgaatgctttgggtatcaaatggtgataagagaagggggaaagggcacatcagctgcctttcctatcattgaggagtttgaaatttcactggggagatgtgacaagtattcacatcataggtggtaaaaactaaacagtttatggataaacaccaggatgcctgcttttagtcatccaatgcttcatttattcagaaggcttgctaaacagtttgcaaagcattagagatgcattcttttgcctgatacactgtcaaatattactgccttgcacagaggtcattggattcactctggaactgatatcctctccaagaccaaaagcttggtaagtttttaggattctcttcttggctgtcattttatcatctgtaaaatgagggctttggaaccaaatgaatgtcttagttccttcccggctctaatatttaccgacttaagagtatccctgatgacacagagaaaaagaggagagaatcaggataatgtaagacaaaaggaaagttgtgaggtcgagttatgctgttacacgcccaatgctgaagcaataggatggttcagagtaaatgggcctgacatgagagatccttatctgtcaagttttctttcagatactataaacattacaggctgcagtatttttcttttttattaatgcagaaggtctattttattttgtctgtgtggatgtttgcttatgaaagaattggcttgttttaacagaaatccttttagtttgggatgggttgaatgaaccactcttttttaaagaaacaacttattgagatatagtatctttcacatactgtacaattcacctatttaaagtatacagttcagtggctttcagtatatccagctgtgtaaccatcaccacaatcaattttagaacattctcataactccagaaggaaacccctcacccctaggctgtcaccccacctccaatttccccatctcaccctccttccagctctaggcaactactgatctactttctgtctctagtgagctgctctttaatgaaggagacagtcagtggacatcagagactaagcaccatagtgcagctttatccagacacatctatttaatggttggagctgttagagtttgcagtagctgatggcaaaatctagtttctaagtgatattgaccagaagaatgaatgtcatcaaaaataacaacctgaaaatagccacaaattcagtgcttaggagagtactcttcagccattatcagtggagtgcttcagtcacttgcagtcagcctgacatactctacctcattacatgagacatgtttaacaaaataaaaaatcatgatacatttcttatagttgttatatttttatggcactggtgtatggttcacccagcgaaatcccactttggacattctgtgtgtggtgactttgctaggagatgttgaatggctctgctttcaaggagcagcataggagtggatgataggtatgcataaacaagcaagtgcaaaatagcagcaaaatactccaggtgcagcatagggggcacttacaaggacagccagttatgcccggggagactggtggggaggggggtgccagaaacagctcatggagaaggtggagctgcagataagcaatggaacactagtcatgcttagggaatgtgagaagcaaatttaggtagagggaccagtgtgttcaaatgcactgacataggaaacatcctagagcctttggatgtgagcagataagacagtagggtggttacaggagaggttgtgaggaggattctgaggctgtgcatcagtgtgtgaaaggggctatgtgagatctctaaggagttggacttgacccactgttttaatttcttgtggctgctgtaacaaagcaagcaaattgggtggcttagaacagtagaaatgtattctctcccagttctggatgccaaaagtccaaaatcaagatgtcaacaggaccatgttccctctgaagcctgcaggggatggatgtttccttgcttcttcctgcatctggtagcctcaggcattccttggcttgtggcagcaaaattccagcctttgcctatggcttcagatggcatttcccctgtgtctcttcacatctgcttccctctaggcacatctgtttctgtatccaaatttccaccttttatgtaaggacatcaatcctaatgggttagggcttaccctaatgacctcattttaacttgattacctctgtaaagaccctatttccaaatgaagtcacgttctgaggtactgggagttaggactttaacatttttaggggacaaaattcaacccattactgcccccaggcattcagatgttactgcagggaagtcaagtgttaatatttgcattttagaaagtcacttggagagttgtgtggaggatgaatgcaaaaggggcaagagtagttgggaacctcttggccttgaccgttcaagaagccttgtgggctgtttactttatccttcacactccagattcttcaagtttaaaaagaagaagaaaaagaaatctgcacatccacagcaaaactagaaagtcagggagaactaccatcagtggagaaggatatttaagaattcccagaaggtactaaaagaaatgaattgattggtagtgaaatccagaagaacaaaggattatattcccttttaccattacatactgtatattaataaaactttggttttaggtcagtaaggagcaggagaataaaatgaaaatgtgcatgccctttcactcagcaactccatgtctaggaatcctatctatactcactcatgtgctgagatatatatgcaggactaatcattgtaatgtcatttgtaattgaggaaaaccaaaaataatctaaatatccgttggcacagaatgcccaattatagtataaccacaccattcattgaatgttctatagttactcaaaggaatgagataaccctatatgtactgacatggaacattctctaacacacagtaaatgaacacaatgaaactgttgaacagtgactagtatagggtactatatatgtaacaaagaaagaaagactctttcgatttttgtatctttccagacctttttaaagtattgtactgaactctaacagtgcttacctgtgggattagggaatatagtgaaaaggaatattcttttttaaaacataatactctatatcctgtgtgttctgtgaactttttcagtaagcatgcagtataccaaaactggacatttactaaaacatttaaggagacagaatccatgagacttgagacttcaccagtgggcgaatgtggtgaacagtggggtggtaaagaggggaaagtagaggaggggtggaagggatgggatagggatagcatgaattcaaaacactcagaagcaaaagggcaacattttaaagggaactattaaaaaataaaaaagacagaaagtatgtattttattgtaaaaggggtctaggagtgttagtttgagaaataggaggatttatgcatcttcaactatgattggtggagcccatcagcataagaatggagaaacagtgccgtgagatgagagccagttgcagaaattaatgtcattcccagaatctcttctgctaaagagtgtatacagccaccaaaacagccaccaatgacttatccctagtgatccacaaattacatacaaagtaacacctcagggataggtacttatctctgaaatgggagggaaaagtctttaccccttctcttcattaacacctttacttgttcctgtctgtgttttcccatctccgcttgactctcctgttcctccttcccttcctcacccccctttctcttttacacacacatacacctacccaccccgtgatacaaatctactagcctgaacaaaaagttaaagaaagggaactcatagaagaaaatgacgtccaaatcagataagcacctccaaatgataaagaggaaaaagattttctgccaaaattatcatgtgaaaattgtcatggcctacttattttatcagaaaaaaagtgtgttaaaggtaatgttaacatagcagaaagcttgaaaaacaagtgacaaccatatttccaaatcagcttttatatgcctagtgttttgcagttagtgatcaaatgctttcacagcattatctcgtttgagcctcacactgaccctttgaggtaatgcttccatgtctttatggaaggggacactgagtcccagaaatgggcaagagccttgactggtgaggcatagactctgttttctatgacactctgatgcctgcatggcctcagcagagtatagttggtaccccatggatttgtctctcgagctaaacctttcagacttcatcttcccaaatcttgttctgtcacctgccttaatcttgaagaatcacagaagttagcaaagtatactaatctatgtcatttatttataaagcagagtggtcatttgaacaacaagaagtttggtagataaaggggataagattgcaccctttgggggaccaccaacaatagcttacaaagtaaaaatgcagaatttaatttcagagatagtgttacttcctcattcatggtactacttgtggatattatggtgagccgtgagcaatggagaaagagccaaagaaatgagattttgatcccagccagactctgaggtatttcctggtacctggcctacaaatattggcaatagttgttcataagaagaattagctattaattatttcactaattcgtagcatgcaatcctgaggttctccatctgaaggggagaaaatggagaaattattactaaatgtactacctaaaagaggtagaagtataaccaagaagtcattcagtgatatgtttactttttaaaagtttccagacataacactgcacaactgcagctttcctccgcaaagtcatcaaagagctaaaatgtacaaatgggaatagggatataaagtggaactgaagataaatggagagccacagcagcccccgcaatacttccctggtgttggttcctcctgggaccataatctgggctgacatcttctctccttccagcatctctttcaaataacatgaagatctggtaaatggccagtcaagcctctggctgctcattctggtaggtctgaggttagtttggctataatatatctttcttattttgtccctctattgtggttttgtatagattttcttgcctgtactacttcttaactaaaggatagttaccatggcaacacctgttgatgacagacaaaaaaaaaaatgtgattccacagggtggaggctgctcctatatttcttgctcctcgctctcacagttaagattcaaggggtgtttttgtttctccttctttcttcttctgtgggtgacactagttttctccattttggcagatcgatgtggaaactgctgtctgctgcttcagttttccatgcaaagatgcggccatgttaccctcgcgagcatttgttgtcatgatttttaccaactgtaatagacatcgtgcttttgtacaagggagtttacaatctttcacgtctgttttttccttctcctttcctctctttttccttcttctctttcctcttctacccttatttgatcaaccaggtgagcccatattccttctttgactagatagccaaaggtctgcagtagtaaagtccaaatttcacatctcatttaaaatgccattagtctggatatcaaaacaattaataaagtaaaacatggggtatacataataccaatttgttctataaacaaatcagtttgaaagaaatatattctagatagtaaataaatggaagagccttaaaaaataataatgtactgaagaacagtcgtatatgataactggttaatctcttcttatacatatgtagctatatcataaatattccacatttaagcaagcattttgatatgcctcatcgggacatggcattgcagaagaatctttggatgagggtttttgttgtttttttttaaggcaccagttctaacaccaaatcacctgattaggggaagaagcacaggtagcgtaggtgaaatggctaagccaccacaatggaggtggaggtgaaggtaatgaaaagtggcctgggttatgtttgtggctcagacctcagatagccgtgtgattacagccagggctcagtttccttgccactaaatttagagactgaacagaaatatcatggagtttgtttctaattctaaagtatattaatataactctgaaatatacataagtactaaacaatagaacagaaacatcattatacactaagggctgaaaaaatgtacatagagaaacagggtggactcataagcatgaattttgagtgacttttcaaagacatgaattaaccaagaggggagtctaagaaaataagtgatgtagcatatcagtcttaagatactgtgtcccagtaaagcaaaaaaattccctaggaattttggttgatataaattcttacagagctctttaaaatttttcctcacaattaaaataattattgaaagctgtttcattaagtatgctgcatattttttggtcattcatctctcaagctatcactggaaaaaatacaattgaaaatgcagattccctctttgaaattgtataatgaattgcgtgaacctacctgttattttgatgttcatttgaagttatataattaagaaataactccatatagcagatggattgatgtgtaaacctcttgatatgaggtatgtaaagtaatgagaattaccttccttaccctaatctctgtgtctttaagtcaggactggaatattaggtaacttgaccatcttttcatgcactgaccctgtattctagggctgccataacaaagttccatgaactgagtggtttaaacatccagaattgattgtctcaccattctggaggctgcaagtctgagatcccagcgtcggcagggccgtgttccctctgatggctctaggcaaggatctgttccaggtctgtctcttagttgcttgcagttccttgccttatggcagcataccttcaggcttcacatgagattctccctgtgtgggtgtccctgtgtccaaatccccccattttataaatataccaatcacattatatgggggcccatcctactctagtgtgacctcatcttaactacttatggtatatctgtgatatgctatttccaagtaaggtcacattctgcagtcctggaggttaggacttagagacatgaattttgggggacataaatcaaacctaacaggctcagaaaagcgtcacataggcacatgcacacacacacacagagtataagattctctaattgtggccaccctgtgaacatggactcttattagagtccatcatgatacttgtagttcttctaaacaccatattttaccaatcatactgtagctaacatttactgggcacttaactattgcaaaactcttgttagggtgtttaaacatacattagttcatgtgtcatttcccttcaagtgaatctccttgactatctctgtgatagtgagcattacatctcactgaatgtctcagaatttctctaaagttccatgtagatcatttagtagttactttccttcagagaaactaaatgtcatacatatgttagcatctcttaaaaccaccctaagtcatgcgagagtgtacacacgggcacattatcaatggcagagttctgttgtggtatctgcaagcagcattgaaagtctaagattgaagtggtcaaatgtgtgtgtgttctctctcataacacacacacatacatatatatgtactcattacatatatagagtgtgaaggagcaaggaagacacttcaaactactttatcccatatggtccatctgtaaaatgccaacctaccaacccccagttcacacacggccctgcatacccctctgaaactcaggcattttacggacaacaatctttcaaaatgtggaagctgccaggcgaataaccagagcttaaatgtctctctcttgaccccacaggcagagccattgcctcaggtcaacacaaacagcccagccagttttgcagaaccccaagaacggaggccagggtcctttctgtggctgggaagttaccccgtggctgggacttttcatagcagaggaacttcacagcagatttttgtgaatgtttggcatctcaaacacatacctgggcagacttcaagttagttactgaccccacaactttctcggcttcctggggaaagggaagtctttcttgcctgcccctccccgccgacatgcatacccattcacacaacttctgctggggcagcaaccctccaaccccataaccccttgagtgatccccagattagataacttagaagtcagagaactgtttctcatcaggaaatgcctgaggcagacctgaggctttgtgagagacaacccggtgttccaggtggctacccagttagctgcccatgatgcacaatggcaggatagggcatgtgcattaggccaagacaatcaaagctctataaatgacagctaaagtcccagtccaaaagaaagttcctaaatgtgcagagtggaaaggactggaataatatttactttttgttcattgtattcataagcaaggaaataacattgagaggtgaataaagaaaatgaacaaatgactgaatgaatatcctctgtagttgtgctggctattatctcatgcttatttacattgcctaaaagaagatgttttaaattctgtattttactatcaatttataagctaataattagaggagtcaatttatatgtcttctattcactaaagcaacatttaagtactgaatctaatcttactttgtattcagatgcctgagaagcatgctatagagcttctcttaaacacatcgtgctgcacattataaactattctattctgtgccaacaagaaagatttcttttcctgttttgaacacttcggtcatttgattacttctctgctgatattgaaactgcaaggaattcatatccaagccacacttgggatggatgcatacggataaggcttatactaaattatggcattttaagcctctttccaggtagcatgcttagaaatagaagatttttgctagtaaaatgtcattttaaaaaaatcaatgtatgtattataactgtatctgtcttacctgagtcctgtatgttgtagatagtataaggatacatcgttaaggatttttatcttcagcttcctagaattcaagaaaattatggtcctcttggaaaggagattacagagttttcattaaaccacaccactgaagaggatttgcagaaagaactatttttccggtgtcatacttataatctttttgatgcctaaagaaatctgattattattatattttgccttcatcttatcttcacagtggcctcttttggcagctctgtgaactactctttcttgctgcttccattttttctgtactcaacgaaaaaaaaataaaacccagaaaaccctcttttaatggactgctgctttgcatacatcagggatttcagctgttcgagtgtgtgaaaaatgaaacaggagacatcagatggcatgaagactagaactgttaacacagtaaataccagaaaggctgaaagtgtgagccaaagcagctggggagtggaaaaaacgagaggcacagctgggagaagcagcaagaaaaagcagccccaggaaacatgagggagcttagcagggggagaagagcggctgatgaaaacaagaatccgaggataagggaggcagaagcgttgttagttatgtttttccaatattgcacagtgcatcatagcccatatgcattgtctttggctacctctttaattgctgtgtcattgagcatatttaatacagttttcttgcatgattactatggactgaatattgaaatatcaatgaaatatctgtactttgaggttgatctctgttatattgataatgtactaaacctgtcagggaattcagacaggttaatgagaaatatcatgcattagtttaaggatacatttttttttctaccaaaagtatatcaaattgctaacatttagtatttggacaaataaggaatgtgtgtaattagctgggttaataactggtttggtaggcatatccagagagcactgattaataaattgctctcttcctgaagagaggtttttggtattttaactttatccagtcttagtccacattaggcctcacatgagtaaaactgtataaatgcatgccccaaagttgggagagatagcagatgtaaaaactgatggaaacagaattaggaccatcttgacatttaacacagtgacccaaatctaagaagcagaaatgtcacagggatcagtataaacaccctgctcccccagttaaattgcaaaggaacagtaaggagagatgaagcttagcagcatcatatttcacagaaatttagattttagtcaaatataaatgtatatacacatgtgttaatatgtgtttataactgtgtatatatgcatgtatatatatgttaatacatatatacacatgtgtatatatgtgtgtatgtgtgtcagggtagctgttaaaaaggcttctgtgatctttggccttctaaataatgtgggtggacagaaataagagacctgttccactcttcactgatgaagtgcttcttcacctggagaattgcctttgagcttgatcttttagaagagaacatccagaaaatgacagtgccagcccccagtacatctcctcctgccttccttgttccctcactatttgttcctcttgcatgtgccatcgttgccctccccaaatctgaatttgttctgactaaagcagaaaacactttaaatgtttaaacctaccccacagtccactggagcacatcactaattatactctctctgtgcctcgcccacagtagtatcttgcccaatgccagctgtgtttgtttgctgaatctcccatgttgagatgttattgccccagtgaacactaggatgactatgtcacattccagcgatgttattgtcatgcagatgtaggctctggtatcctaagatgattctcaggctcccataatccttactccttggccttccaagtttcagctgtttctgtgtctgtgtaaccaagcgtctgggactgaagatcctctttgggtctcatagtctgtgttggtcttgccaggtgatcttcttgagaactgtggctcttactctgagtagctgctcagtggctagattctgttgctgtgactagacctccaggatggtaatggacgaccctcctgacttcaccaacctatttactctttgctgatagctttgcctccctgcgatagctgggccccaaaaatccccacccaccgccaccaccgacacccaaataagggttatttcctaaatcaggtcgatgttgccttgttccttggaggttgtgcttggttgttgggctcccctcccaggttgggctttgtagctgcagcaggctcttctactctgctcttgtgagcagacctggccagggacccgctcccttctcctggcagcctttgtgttcttttgagttatggcaggtggtacatgaaatcgtattctttggaatagagaaggaaagctcaagagcaggggaagaggaacttctttaaataggtgtcttccagtatctgaagggttgccatgtcagggaactattggacttgctctgcatggccctagaccttaaaaccacgactcaaacaaggttgaagccactaagcctctggagcacagaagaacctttcttactcctagctcaaatttaacaacacttctcagagacagaaagggattccttgggatggaggaagccctttattgtggcagggaattcagcataggtagattagcaggtctaagttttgtttattggtttatttccattgcaacatagataaagtattgtatttactggaatgatgtttgcatgtgggaaatattgctgcagcagtatgccagtcatgagcagccggtaatcctactctcttctctgtcttcagggactgtgagtgagagaggttttattatagcaacatccttgagcctactctgatttttttaaaatgaattcactcaatcagtgaataaatattgagcaattactatattccaagcactgtgattcattccatgctcagtacgttgaactgttctatttaaccaagtccttttgacatggcagttatcgatgagatgtcacagacattgtagaaaggattcaagtatcaagtggggttgatttatggatgacctttaagtttcttttaaatttgagaatctgtaattgagtttcatgattctggtctcatactgagtagttatcttgcctccaggtacagtttttaaaagtcagacatgaatttggagtagattgctgaagtctattctcctcaatccctgtatttgtctacccagatagcagggagatacactctcaacatcattactccttccccagaagagactgttaggatataacctcgagaaaacactcctttccttagaccctcctcagcactgccagcgggggctcagcccaggccatctgtcaggtgcccatctcatccctcagggtttcagtgtcccagaatggagctctgtttcagttctgctgggtggctttagccagaacaagagttcaggttagtttggtaaaaacacatcctgaactggagttcacttgcttgggccttcttatgaatgtcatcattagtattaagaagtcaccaaccgtcctcatgaaaactgtcagagagccagatgtaacagaaactgctgggcgtggcattccatggacaggatatgtgggtttcagggagaggtcatgtttgactaaatcgtcagtatcagaagtcctaaaattccattcggtggaaaaagaaatcaatattgaaggtatgggatttctgtttgattgggtcaataatcatttgcagtgattaaccttattatctctataccctgataacctaattatctctatcacctttggaaataatcagcaagatgaaaggagacctgaagaagtgtttggtctatcagaattatactcaagttgtcccagtcagggcatgatagtttgcaatggagctaggttatctgcttagtgtaacaactcccatgattccagctaaaattgttttggggtttgccatttttttttaagactgatctgaaaaatgactgatgcttacttataacatccaaatccttggaatattatttttcataagagctttatttagatgcaattcacataccatacaagtcatccatttaaagtgcaaccatcaattttaggacattttcatcaccccttctcccctagccctaaggaacacaaatctactttctatctctatgtatttgcctattttggacatttcttataaacaggatcatataatatttttttgtgactggtttctttcacttagcatgttttcaaggttcatccatgttgtaacatgtaccagtattttattctattttatggctgaatactattcttctgtatggatataccacattttgtatatacccattcaccagttgaggggcattgtttctacttctttgggtattacaagtaatgcttctgtgaatatctatgtgcaagtttttgtgtggacgtatagtttcatttcttttgctatatacctgggagtggaattgctgggtcacatggtaactctctgtttaacattctgaggaactaacagactgtttcaaagcagctgcgttattttacattcccatcagcagggcatggggttctgatatctctacatcctcttaacacttgttattagcttagacgtgtttattatggccaagagcaaatcactaggaaggtatgaagtggtatctcattgtggttgatttgcactttgttgatggctacttatgttgtgatgttgagcatcttttcatgtgtttattgattatttgtgtatcttttttggagaagtgtctcttcagatcctttgcccatttttggttgggttgtctttttattattgagttataagagttatttatatattccatatataagtcccttatcacatacgatttgcatatattttctcccattctttgggttgtcttttcattctcttaatattgtcctttaaattacaaatatttttattttaatgaaatctagtttatctgctttttctctagttggcttgtgcttttggggtcacatgcctctgccaaatctgagctcatgaagatttagccctttggttttttttctaatagttttgtagtttacgcttttacatttaggtatttgatccattttgcattaactttttctgcggtctgagttaaggatccaactttattcttttatatatggctgtctagttgttccagaaccatttgttgaaaaagcctgttctttccccgttgaatagtcttggcacccttgccaaaaactcaactggccatataattgaaggaatataaatatatgggtttattcctggatgctaaagtattgatctgtatgtctatccttatgactgcaccacagtgtcttgatgaccttgtttcgttggaatatttttaagtcgcaaaatgtatattttgaaaattcaaaactgtgcaccatttttatattattaaattaactgtcaaatcttgtctccagttttcaagtcaggatcttactcatatctggtgatagagaaagcacatccaaacattatttttaatacacattaatagaatttgacattttttaaaaaattgttagttctttaaattttaccttttaattgcagcaatttgatttagataattaaatcttgctcatatttctggctaattcaggagaattccctggattgaccatgatgacaagaaaaagtggagaggtttatggttggaatccacatctaaatatatctgcatggcaggggttcagaaggaggcttgacttgaagtctaataaaagagtggaacgatggcttgggaactcagttgtctatcaagccctgcacccagcgaagctctgtctcctagttgatgagattgacagcagaaagacctggagtcggcttagaagaagacagcccatgattgtgtgtcttgttctgatctttttaaacttattaaaagaaaataataatgtagctaaatgcagtggcaaacaaaagacagcagtttctcactttctaactgtcagggaaacaatagatatacctcaagataatataaatattctgctgactctgctatcagagaaagcaacacacagtctaagatgataatatgtggttctaacaaaagaacatcagtagatgcaaatctagaaggctcacgttccactccgtttgttatgtcagaaatcaggaattatgcctcagttggttaaaatgattgagaggttctgaatcttagtcaacagccaagatattctccttagagcataaacacagccgttctttcatccgtttgttcgttcgttcattcattcattccgtccctctcccctcctccctttcttactgcacttgtcatggtgtcttatgtaaagtgagtgttcaatatgggagagacttatttgaggatgggaagagaactagagaggaagggggcaggaggaagggctaggcaccaaaaacagcagaacaacaggtaggattggggagctgttgaatcaggagggagagcgagggaagtcgcccatgtagcctctcttttctgaacatcttccccatttccacagcagaatgcgtgaagggacaactcggggctagatctgcatgtcgtccaggtgacactgttcacgctgcaccaaagtctccttctaataagaaattttcagaactgaatcacagcttaccttaccaaaaagtataaatgctcttttcaaataaatcacttgttttatttcaaattcagaaaacagttatttgaattttagtatcactgtagtaacacagaggtttacttggcataaactaggaaaaatatagaaagagcaagtaaattgatttgtatttgattagacacttacgtggcttttttattaaaaatttttgggtggatggggagataggaagttttctttattgaaatttttttatttaattattactgtctatagttgtgcctctacatttcagtttgctttgttcaggaaggaatataagaatataaatctcagtgtttggcataagtacactagcatttttacagtgaactgaacaagtatctttcacagtgtatatccatctgcctttttttctaactttccttctctttggctataggccaagaaagaagagagaactctcaccacaacatttcaaagggaatacattgccagaacttggaatactctactggacaaacatttcctccaaggtaaatattaccattgtaccaataaagggacacatcactagaatttttgaatggcagtggtacagcacaaaggtttaattgtttagtctcatacagacctagagtgacataagagaaagagagagagggagagagagagaagaaagcagtgctgttggggtatcctgcagcctcttctaaatgtgttaccaggagaatgccatcagaatctgggagctcactgagctgtacgaaaaatgtgtgggaaatgaggaggaaagaagaggctggccttttttcttcgtgttacagatactcgtgaacacaaaagccagcggggttcgattatgaaaataacatttcatcctttatgaggaaaaaaatgagtagtttcctttagaggttaaaataaaatatatgctgtattcatgtcacaagagggaaaagcctgaatcataatattttacaccaactgagacaagtatgaaagattttaaggaactccatgttcttctatgaaaatacctgctaagtaagcctttagtaagcctttcattggtttgtgaggaatgcttcatgaagttcttgttttggaaatcatatctttaatgcctcttgtggggaggggtgtgtgtgtgtgtgtgtgtgtgtgagagagagagagagagagaccaaagaaggatctgtcagcatgatactataggtttcagaggagtaactctaggcgctttctttgtgaatcatgagcttagtgggaataaaggcttaacagaagcagctgaattcatagtcagctttggcattcatgaattagctgccaatgttttagcacaaattgctgtgtcatttctatgaagttcccctgtcgctgctcagtctgtagctaaaagctgtcttgttttatctgatgaaacacctccttccttataaagatatttgtgtacccgcacacagaaatgcaaaaacatatgatcccccttaaaagaaaataaacttgtcaactttctctgtttagaagttaatatgatatggttgatactacctagcccttagtgttctggaaggcagtttcagattggccaggggagagtcctgttttcctcctcggtcctcatcctggttattctcttctgaagggcttggggtgagggaaatgtaggctgtacattagaggagaattttgtgatactattcattctctgttctgacagagaggacattgtttgttcactgtaataggcttggcaggaatctgtgctgtgcgtacagaatgggaaaatagcagagcagtgggaaatctcaaaattctaagcagcagatcagcttagagattttgcaaaaatctattttaatagcttctcattactgtagacgtaagtcataatttggagaaacagttttcctttcagtgataattttcttcacattgcattatgcctgtgttacatgaaaaaagtctttaagatgcagtatgcctatccaagtactgtagtaacaagaattaaaatcatgaaagtttagaaatacttgatgaacacactagacctgctttgatattgccctttgtacgtcagcattcacattggtacaaatgaaaattagcctatgtacgtcatctggtggttcacagaagcaagtgtatgctgccaaagataagagaaaaaagacgcatttaaagatgtgcattgaggtaagagatgcactgctagtgagagggagccatgctccaaatgttcagaactttaaaggcaacaactgtaaaagcaaaggctcaaagcagcatgcaaaccgtgaactggaaactgagctggctgtgactgaggcctggcatttctgcttcttgaggctatgtgttcccacttctccctgagcacagagactgcacaatatgatgggccctgatagccccaggtgtctggggaccttgtgtgtgtgcatgtgtgccaggctgctgtgttcacagacagtgtgagctagagagtgggagagcctgccccacacccagcagccccaacagcagctgtgggggaccctcgtctttaggcttaaagagaaatttctcatggctgcccaatcttggcctatattctttttttttttttttttttttttgagacggagtcctgctctgtcgcccaggctggagtgcagtggcgtgatctcagctcactgcaagctccgcctcccatgttcacgccattctcctgcctcagcctgccgagtagctgggactacaggcatccgccaccacgcccagctaattttttgtatttttaatagagacagggtttcaccatgttagccaggatggtctcgatctcctgacttcgtgatccgcctgcctcggcctcccaaagtgctgggattacaggcatgagccaccgcgcccggcctcttggcctatattcttaagaacagctccctggatatttttataaaaactacataatataaattatgagacttttaaaattctatccgtagtagtgtcagtatacagtagagcattggattattgcaaatccctttttatgtagcctgtgtaagggttaatcttatgtaacaaaagcaggtcctttactccaccacttgtgacatgattcacacgtattatctgctttgttgtttttaagtttctcagtcttttaaaatgtatttgttagacaatctttttgatgatgcatttgttcgtctttttaaaaatgtatagaaattggccagctgtggtggctcatgcctaaatttccagcattttgggaggccgaggtgggcagattgcttgagtccaggagttcgagaccagcctgggcaacatggcaaaaccctgtctccacaaaaattaaccaagcatggtggtgcatgcctgtagtcccagctacctgggaggctgaagtgggaggatctcttgatcctgggaggcagaggctgcagtgagctgagatcataccactccactccagtctgagtgacagagcaagaccctgtctcaaaaaaaaaagtatagaaatatatttatatgatgatattttgaagtacatcacaaagatagcaagaaaaaaccaccaaggcttgaataaactccctttattctttccatttggtacatttttttggtctgtttttcaagcagtttttattttattgtttttcacagctgagttaaggattactgagggacgtgaggttgaggcagggccaggttctcctgctccctccagggactccttggaggtgctgcctgcagcagcagaactggcaggtccctggaagacaccttcgtgtgcagggtaattgctggcccatctgtgactcagcagccatgcctcctatcctgcctgcttgttcctttcctgcggaatttccggtaaccactgagacctgatctttagcacacaccagtgacagctgggtctccataccctgtgaccacagttcgccagaaagctgggagagcctgcaggcagctaagttagtgtgggcaccagcctcatgtgtgtcatcatcgtggctcgggggaggatgccctaaagcaaggcgtgcaagggccttgtttcaccaatgctatgtgtcaccatctagtatgaaagaaaatgtttatcggtcgagggaaattggagtaaacacttactgacactcttttattttggggtttttttgttttgtttttctgagacagggccttgctctgttgcccaggctagagtacaacggtgctatctgcgctcactgaaacctctgcttcccaggttcaagcgattctcgtgcctcagcctcctgagtagctgggactataggtgaatgatactattttatttaacaaacactcatattgtacctacagcgaggcaagcactggtctaagcactttgcaagtattaaactttaatctgcctgatcaccctattactattattaacattcctgttttaccaaagaggaaactaaagctcagagagggtaagtgacttgccaaggaagggtagaaacagcattggcatctactccagggtctaggcattagggctccatgcgtctaaacacgggtgtctcctggaccatagcagagcttgcttaactgtcaggcccctttagggtctgtaaacacacacactgcccccacagaggtacacacaccatgttatgttgtcatttttggaactctatccccattgactgatggcatttgctgcagtggaggaagaatttgtcatccctgtccttctagaattcaaagtgggtgcggactaatccctgttacatggtaaacaggattccaggcacctcctcctgtggctgtcagggtgaactgcatcctgtgacatgcctgcagaggaacgcccgagcagcatgtagagaaaggaccagggtactgccctgcccctcctttacagcttcttcactggtgggtcctgggccctttgacataccatggccctgggcacggtggtgtagcacgacctgccagtgtggagagcagccgctctccaggatggacatttgacaattcctccctccccactgccatggggatttagacagttgctcctggaggccttgtcttaacacagaacttcccaaagtggaatctgaggagtttgatgggtgcagctctctctcatttgggcgcccccaaaagagaaaacaaacaaaggtttattcatggttggatatgtttgggagacatgggttcagcaaaattaaattgatttacttattgcaggatttctcagaattttcttgtgactctccaaagcaacatgtagaatgcagaatgtcctacattttatattttctcaggtgggtgaaaatgtctgtcaacatcatttggtcagtgttgtcttaaggagaggtaaaaaaaaaaaagaaatccaccgtcataggaggcaaacagatattgagggaaaatcaataagctacatttggggtctctaaattccagtccctttttaaactgatagctattgggaccttagagcctgaaatttctcatttgtaaaatatggaggatagaactgaattatccctaagcttttttcatccttataagctggtgactgttttgttccagaagagttttaagaataagatacaatacacaacacatcaaatgaaaaattggtgagggtaaaatgaggcacagagaatgtaaggtagaaaagatggaagaaggagggaagttattatgcaaaatacattctgtgaaatccttcatggttaatatgatagaaccaaatttggttctatgctttctaaggaacagtttgaaaagggaactatgaccacagctttgtaattaacagactcctaaactaaaaacaaacattttcctaaaagaaacaactgttcccagtttgaacaaatttttcccatggcttttaactctgtggtatggccctttagtcttttaggtagaaatttcagctctgtggtgggatggcaccaagatttggaacctcagtagatacacttcataggtcttgtggatacatacatttaatatacatcatcctcatttacggaaccattacatgttgtagcccagcccaacttgcgtatatgtggaggtgtttgggtcttgactctggactccggagtattctctccatcctggaggggccgtgtgccaggagcccgggggtgtcagccgctctccagatggcctcctttgtgcatcctcacatcagttctgggtgcacccttctccttcctgcatctctaacttagcattggccgagcctggatcggggtttccaacagccttttcacaaaatcacagcgatgcaaagctgtcccaggggttttgtgttgttcagggtggtaaaggttcaaacctaggttctattttttaagtaattattaataaataaaatgatagcttaaatacgttttagaaaataatactgcttcaggacctcttaatgtaagtgaagctattagtgccagtcagatgagtgaacatgcttatgactcacataaacactgcaagcccccatgggggctttaattagtttttataattagtcatttactgttactttatacatagaatggataactgattacagacagtaagcagaagaagcaactgatgttgtgacgattatcatttgcagtcatctggtcaaaattcttacagacttttcatggtgtagataatgttttatttcctaaactgggtgtgtatttcctaaacctgtgtttattgcattattcttttaatcttaaatatcttaatgtatttgtggagttttatattagtctattaggacatttatatggtataaaattcaatgttgataaaagaaaaagtaatgataatcatatgtaatttgaccttgatttattagaaataaatatcactcataccctctgtctttccctctctctccctttttttctctctctttctctctctctctctccttacattgttcctgataagctgacaacagagtcaaatgaaacacaaatatatatatatatactgcagagaaatgcatacaaacagcagcctaaagctttatcttgtctcattattttataattaaacacaaaaattattgcaggttgattatttttgtccaaaatgcaagattaccaaatattcatgaatgaaaacttttatctctttatctatcatgacatattaattgtagcttgaaatttatataattggtcccaaaaccaagtatatgcccatttgtcatttcaaaaatttgtcatttcaaaaatttcaaaaacaagtcatgcatttcattacatgatgaatttaaagtagactaagtagcacatcactgttaaataagaaaaaagtcaaactagaattagtaaaatttgtatttaaatgaacttgttaatgtaacctttaataataattaacttaaaatcaagtaattttacttaaggcacttcttatgtgccataaaattttaaaataattaaaatatcttccatggaggtttgcaaaagtttatgcaagtcaaaaaacatgaaatctttaaagaagccaggaaaagatattaaaataattatttgtatccaatttaaagagaaccttgctgttcttgagtagattactggtaattggataatatgaggtctggtcagttgcagaagggagattaaaggccaatggggtagtcagctgatttgaagaacatgttataaagcagttcttgctgtgctttgccctgtccacatcatagaaaaatctcctataatttcctgtcccagctctcagtgaaaatcagggatcacctcttcaaatgaatactaatcttaaatatgttaaacaaatccctatactgttttttatgttctctttttattgaagatatacatagatattcatactattttgaaatgccaattataaattagtacaattttcccaataatatatgggcattattgtgaaatgaaataccttttacctttaatatatggatttatggacactattgtgcccatatattatttagaaaaaatatagtaagtaaattttacatctactattacatccaaatgtggctaacaattcagaatgacttagataagcatcgttattttccagcaatattgacattgcttggctgttccaattgttaattttaaaacccaactgttatcagactaactatgatttaataaaactttggtaaatgtctaaaggagcctttcagtaaatatgatctaaggaaaaagaaatatacagaaatgaaataacttttacatttgattaattgaagtaagttgcaacatttttctgaattgcagttagctttcattttcagactttggaagaacaagtcatttgtaccaggaagtacatggtaaagaactatgtttggcaacttagagaacatttttagcatttgaatttccctatttatagtacagcatcaggcatagtaaaatgtttggcatttctataagggatgcaaatgccttaacattcactgttgtgatctaacaattcatttcagagtaagatgaatcagtcttgtttggaaaatgttttacacaaatactggcaaggaaactatcactgcatttctgtggattttaaaatgcagactcctctaaagtaaatggtgacaaattgcacaatgttttttctttcttctgcgttaccatgcttctatgtgaactgacttttattactttaaattctcacactactctactacattccttgctttttagattttgttaatccatgctggaatcagaaactctgtttccaggtccttctaaatgtcgaattctttttaacctaaccttcctttaatccacaatgttttcctcataattgaaaccacagattacttcattaacatctgcccttttcttttacattagagaacgtgagaattgtaatttgtaggattttgcccttaatttgctacatagaaaagaaatacttgtattctccctctttctctctctctatcacacacacacacaaacacagaggcacacacacacacacacacacatgcacacacacacacacttgaagtaatgaaaaatgagcagactaaatgtaatgcagcatcctagatgggatcctggaaccaaaaataaaaggacatagggtgcaaactaaggaaatccaaataataataataatgtaccgatattggtccattaattgtaacacatgtaccatgctgacgtaagttgttaataatagactagaaaaaatacagcaaattcatttataactaacgtattaaaaaccatagttgacttcagcctgttttgtgataagaagaattgaagtatacaaagtgataatgatatctcctgttgtcaatgtcttctactgaacatagtcatctatagcaaaggctggcaaaatccaagtatttggcaaaagctggagaccaaatccagccctgccatctgtttctgtagggcttgaacacacttctgctgttatcttccagatgcccctagcggggcaagaggatgcaggctcagatgatctgggctccattcccagccatttggtgttgtgggcattgtttgacttatttaacctttctggatgtcatttttcgtatctgtgaagtcagagggtcgaaccaggtttttcagaacctgtggcgtggagaattctgactctgaatgtgtgttggaggtccatttgtgattacagcatagagtttattaaggatgaaattttggcattaaagcaatttgcatgcattatatatgcaatatatagcttaaaacataagattacccatcattttcggcacttttgaactctaccaaaaaggaattaaataatcacaaaaaggaaccctattgccacgtgtattagtctgttctcatgctgctaataaagacatacacaagactgggtaatttataaaggaaagaggtttaatggaatcacagttccacatggctgggaggcctcataatcatggtagaaggcaaagaagaagcaaaggcacgtcttacatggcggcaggcaagagagagcttgtgcaggggaactcccatttataaaaccatcagatctcacgagacccattcaccattatgagaacaacatgggaaagtcccgcccccatgattcaatctcttcccaccaggtccacaacatgtaggaatcatgggagctacaatttaagatgagatttgggtggggacatagccaaaccatatcattctacccctggcccctcccaaatctcatgtcctcacatttcaaaaccaatcatgccttcctaacaatcccccaaagtcttaactcatttcagcatcacctcaaaagtccacagtcctaagtatcatctgagacaaggcaaatcccttccatctatgagcctgtaaaatcaaaaacaagttagttatttcccagatataatgggggtacaggcattgggtaaatacatccattccagatgggagaaattggccaaaacaaaggggttacagggcccatgcaagtccaaaattcaatagggcagtcattaaaccttaaaatgacctttgactccatgtctcacatccagggcatgctgatataagaggtgggctcccatggccttgggcggctccacccctatggcttttcagggtacatccccactcctggctgctttcacaggctggtgttgagtgtctgtgactttttcaggtgcacagggcaagctgtcagtggatctaccattccagggtctggaggacagtggccctcttctcatggctgtactaggcagtgccccagtgggaactctgtgtaggggtatcaactccacattttctttccacactgctctagcagaggttgtccatcagcttgccactcctgcagcaaacttctgcctagacatccaggcatttctgtacatcctctgaaatctaggtggagattcccaaacttcaattcttgacttttgtacacccataggcccaacaccatgtgtaagccaccaatgcttggggcttgcaccctctgaagcaagggcctgagctgtatgttggccccttttagccatggctggaactgaagcggctgggatgcagggcgccatgtcccggggctgcacagaacaggggggccctggcccactaaaccatttttccttctaggcctccaggcctgtgatgggaggggctgctgtgaaggtctctgacatgccctggagacattttcaccattgtcttggtgattaacatttggttcctcattacttaggcaaatttctgcagctggcttgaatttctcccagaaaatgggtttttctttttaattgcatcatcaggctgcaaattttccaaacttttattctctgcttcctcttgaatgctttgctgcttagaaatttcttcaaccagatatcctaaatcatttgtctcaaattcaaagttccacagacctctagggcaagggcacaatgctgccagtctctttgcatagcaagagtgatctttactccagttcccaacaagtttgccatttccatctgagaccactttagcagggactttattgtccatatcactatcagcatttttatcaaagccattcaataagtgtctaggaagttccaaactttgccacattttcttatcttcttctgagccctccaaactattccgacctctgcctgttacccagttccaaagtcagttccacattttcaggtatctttatagcagcaccccactcctggtcccaatttactgtattagtctgttctcacactgctaataaagacatgcaccagactgggtaatttataagggaaagaggtttaatggaatcacagttacccatggcttgggaggcctcacaatcatggtgtaaggcaaagaagaagcaaaggcctgtctcacatggcagcaggcaagagagcatgtgccaggggaactcccatttataaaaacatcagatctcatgagacccattcaccatcatgagaacagcatgggaaagacctgcccctatgattcaatcacctcccattgggtccctcccacaacatgtgggaataatgggaactacaattcaagatgagatttaggtggggacacagccaaaccatattgccatgtgagtcacttatgtactaggaaagcaagaccagttgttttgaaatacccatgttgaatctgagctcaaaatcatattaaaatattaaattgtgccttaatttgtgataaagtattactatccaaatgataatgtacactttgagaaagaaagattttaggctaatgtactttaagattgtacacttaaatgcaatttagcttgaatttgttattcaatatagtcaataatgttatgtggtatttaatttaggccaataaagttttgaatacctaattatgttaaggcctttaagacagttgagaccttgccaaatgttcatattatgcttgtcgagttaattatcaggaagttacttatctgatcattgtttcttaatttctattgagccagtcattgtcctttataagaaattattttccagctgtagtatttcagtgctgggttttgattatagacatataaaaagggtttatttaggactgcctttaaaattaaatctgatcataattatttgactagtagaggcactctaggaaaaggttgagtagtggctgtccactttggctactcagtaaaattacccaaggggctgtttaaattcccatgtgcaggtataccctcaaactaattaagtctatctctggaggtatttttttaaagctcccaaggtcctttgaatatgcagccaaagttgagaaatacaggccttgagaacaagcaaggaaagcctcctggggaggtctttctgtagtggaatgctcctgctctttgtaattgggtagcttgagtagctgtgaagttctttaaagaagattattttcaaaaagaaagaaacttaccaatatctggagaggggcagaaagcacgtgttgcttgccctaagtctccatcctacaaataccaggagagtttgtcctgattttgaaaggatttaggaggtaacatcctgcttttgtcaacgcatggtgtttgctttgacttttgtttggcatcttatttcacctacaagatcagtgggagctaaaatttattgagcgcacctgctaagtatcaggtcctgtgctataaacatcactctgtctcacagccaggaaagatagaattattcacttagaaataaaaagtcagagttctgttttgttagagaaatcttagtgtaattgcataaatatttagtgatttctttattcatctggtgacctttgttgaatacatatgctattccaaaaataagtttaaacatgcccaaagaatacaaaggatctgtattcattatctgttgcttcataacaaccttagtggctttagatgaacatgtatttagctcttgattctgtgattgatagtttaggctgggctcagctgggcaatcctctcgtcttggccaggttcactcatgcaacaatggtcagctgtggttcagctttgctgatcttggtggggctctctcacttttctgggagctttaactgagacaagctggctgaccaagctctgttcctttggcctctcagtcatcagcagggtcaacctagatttgttggaatatggagttagggtttcctagagaatgcctaagtatccacggcaccttaggcctggtgtgagaatgggcacaccatcacttctgccacatttcctggccaaagcaagtcacaagcccagtctagacacaaggagtggggaaagagatttcatttcttgatggaaggtactaaaaagtcacattttaaagggcaaggagaaaggaaacagtgagcaattaatggttattttttgcaatcaaccacaggtagaaaacttcagttctatcttgggacattagagggtgttcctgagaaatggtaacatttgagcaggtttcaagggtagaaaatatatttcaggtgaggcaatagcataaggagaactgtcaaattgtgctttcattagtgaaaaacaaaatggaggtagtaagttccctaaacgtagaaaatatgtctagccgacaactgagcatgtggaaggcactcagcatgtactttctcatttacatcaaagggcagtgaagtgactaagagtgtaggcccttaaagcaggtataataacctgatagccttaccatttaccagctagtttgccttgaacaaattactgtgcctctttagtaccatgaggacaataatacctcctatagcatttgctgcataacaaaccactccatgacttaacggcttaaaaacaacagccatttactcagcagctcattctacagttttatagtttgggccatcttaggttggaggttcttctggtctcagttgggctcatgcctgtgtctttggtcagcttgcagtcagctagatgtctctgcttctgaggattggctggctactgggggaacaataaggacaactggatgaccaccttctcatcatccagcaggctagtgtgggcttattcacatagaggatcagcagaattccagagtgagagtagaatcattcaaagcatgtgggctgggttcaacattgacacaccattgcttccaatgagctccatgagctaaagggagtcacaaatcagcccaccattaagagtagagaaacagacagcatttcttgctggaaggagctccaaagtcacgttgcaagaagtgaggatacagggaggggaagacttgtgaccatctagggaatcttctatacctacctatagctcacaacaatcctgtgaagaaaaagttaaatataacttgatttttctaggtgaggctccaacctaaaaagtaccaggctaatcatagatgttcaatacatggaaagtattaactttttcctatgaaaattagaaatcagattttaagccaaattctttaattgcttacttttatagaatatcagatgaacctccaagtgcttcttacaaaggttaaacattatacattctttccctgttgcagaaatataatgtaagtgggtaaagctcactgcctctgagtgcatgtgtatcttggcctgacagtctggcagctgcaatgtgtagaatatgcttattcaacataaagggtcaactcaggaaaagaaccagagacggtcaagtacaatgtttcagttcccaaaatattcaaggccttttataatgggtaagaactcatttcaaaacctatacaaagaacaaaaaccttaataaattgttattgatttcttttactgttatgagtattttcataaaaccagctaagcctcatatagttctagattgatccacacattgcttttggatcccataaattgcattcaatggagatttatttatctggcagctaaaatacctctaatcagtgatgtgaactggatcaaaaaatacctatactctttgaaataaatagaacatcaaagggtattcaagaatgtgtagtgcagaaatatggcaaatgtgcattgagggtggtgccagcttttttataattatggaacttctaagtccttaaatgatagagatcagatggttcttgcgctctgcctcctgacttcagcctgctttacccaacccaccacctccaaaagctccaaagcccacaaaagggccctctatccgcccgattgcacctcattcccaaacactgaatgtccactgtactgcttgttcctcttaagattttagaaagtcttagtggtggagtgattaagaactgtggctctgatcctcatgtctctcactttcttcctctctgagtgacaggggaagcttctgaagctacaagcctccttccttatttccttaataatggtcgtacaaagacatgtttacgtggccattccatcacatttagagtcatttgctgttaacaacaacagaaatattgaatccccaacgatttatgtcattagaaaagaaaaacaaatataaattaattaacattttcaagacatcccaacacaggtttgctgatggtgttgctttggctttcaaagcctgctagtccccatcttgctctgcagcactggagtatgggtcactttctggaaaggcttcagtgcctttgctacagagtaaatagtttgttttgaactctcagtttgtttttaaagtaatgttttatgggccatgtaatgaagtacctaacatagtgctaagcacatagtaataagtatttgtagacctgatatgtctatctttgcatgcctgagaatgatttccggtttataaaatttgtgttggcaaggaaagcagtttttgttgctactgataagccatctggggcttgatattctaaatttgatgactctatttacacataatatcttttagggggattccatattttttacgtttgtttgccaaactagaagttatgtacaaagttgtaagcccaaaatctgagaattttaccctggcaaaccctacaaatattttaaattaccgcaatgattttttagtaaataaaatgtcaatgcaaatatgtggaactagatttcagagatctcagagatccctgaacattctatggttctttatactggcactgtagagaatttatattatattgaacattttatattaagcatatgtcttgaggccaggtgcagtggctcacgcctgtaatcccagaactttgggaggctgaggcgggcgaatcacttgaggtcaggagtttgagaccagcctggccaacatggtgaaaccctgtctctacaaaaaatacaaaaattagccaggcatggtggcagacacctataatcccagctactccagaggctgaggcaggagaatcgcttgagcccggaaggcagagcctgcagtgagccgagatcacgccactgcactccagcctgggtgacaaagcaagactctgtctcaaaaacaaagggcaaggggaacttgatgttgagttggatatgggaggaaacagagagggtggtaaacagggaggacctgggatttgaccttggccaactagctgaaggtggcaccatttccagagagaggggccctggaggatgaccccaggggcagggtacaatggagagtatagccttgcgcacactgaggccgagggcctgggggacacccaggcagagaagcccaggtgcagctggatatgggatggcagctctgaaaagaggcttgggccagagatacagatctgggatcatggcaacctgatgggaaatgaaggcatggttttggatgatgtgtccaggaagataatatgcagcaaaatcaggaaaagaacccaagaccataccttaaacaactatggtatttcatagctagggagaggagccaatatcctggggtgttttctcaaatgtgtggttaccataatttggcatcatcctttgacccatacctctgccttttaagttggcatatggatgataatgattctggatagttatacagtgtctgaaatttggtctgatattttctcacagaaacttatacacaaacctctgtcttgtggatgtgagttgacggacatgggtaggcaaaattcttgcttgctatttgatgatttaagtgacagaagtgaaaaaaaattttttaaattctggtatgtagacttagaggcttgatcaatgcgagtttgcattatcgttagactttctagctagtgcccagggtttccttttgcatcacacaatacaatgtctggttgtgcctcttttcctgacattaaaattcatcagtggattcagaagaacctgcttattttaaaaactcaatgtatatataatatattcaaatggacagctggtatctgattatttctttattttagttacagctgtgttaaattcaattataaattataaatcataatagaagaatcagctgctttgaatgcaggaagatgcagattcttctttaagtatgtttttgaataaaataagattatgttaaaccagccagggaagcagcaaaaggagttaatatttactgggtgcctactctgggcaagggcactgaactgtgcatgttgcacaagatacaaatgtagctgattttggtaggggtttcaaatatacttttctatgctgaatggcaatctgaaatactgaagatactgaatggagctgacatgcaaacataggcacatgtttggaaggctggcagagtgtgttatcaatatggcttaaagtgctagtctagaccaaacagaagtgcctcaaaatagtggtagtgcccaactgtcattccatatgtcagtaggatttgtcctgaagatattgcagctgacttcttggccagtactctcagtatcatgtggtaataatggaaggataagattactaacaaaagatcccaggctataatgagtccactaacattaaatggatgctttctgcaatgtacctcccatctcaagctgacatgtatggaaatgaacaattgcaagagacccaaaaactttaccatggcagactgaggaccctatgccaaataaacatggtgttactcccgataaagtgatctaaagaaacctcaacagacgattggaagtacagtttcagacattaatgtctagctgccttctgctggaaattgaaaggaacaactaagattgcaaaatgtgcaaatggagaagccctctctaccagaagcttggagccagccagaggtcagcaaagcacaggctgcaaaacgccttctctgcaaaagtagctggcactgtgaatctaattaaaatcccaacatgtgcatattgcatgagggactatagcttaaaatgaaattgcaactgtacacattcattatctattagccatcagtagttacaaccttaaagaatacaggattgtatttggtactattcttagtaagactgcaaagatatgcatttattcactccatcaatatttactaagcacctgctctgctgtaagtgcatgtattagtccgttttcatgctgctgataaagacatacctgagactggtcacttataaaaaaaaaagtttaatggactcacagttccatgtggctggagagtcctcacgatcatggaggaaggtgaaaggtatgtcttacatggcggcaggcaagagaaaatgagaaccaaacaaaaggagttccccttataaaaccatcagatcttgtgagacttactcactaccatgagaacagtatgggggaaaccactcccatgattcagttatctcccgccaggtctctcccgtaacatgtggcaataatgggagctacaattcaagatgacatttgggtggggacacagccaaaccatatcagtgccttagttatagctgcaaagacaaacatagagtttgtgctcatgaaggttctattctagaggttgtacatacaacaataaacacaaaggccaataaataatatgctttcagataaggataacaggaaaagacagcagggtaatgagatgaaggctgagtgtagtggagtggacgggagagtttcagaatggttggtcatagaatgcttttctgagaacacgatctttaagcaagactgaaaaaataaggaggaaccagctgtatgatgacctgaaggatgttcattccagaaaacaaacagctagtataaaagctccaggtgaggggaagcttgacatggtcaagggctagaaagaaaaagcacatgagaagtcatggtcaaggagaccaaggaaccagctgaggctggaatggttgggtccacctgccccatgagaacccttcaatgaatgttggtcaaactgagctgaacaaagtgtactgtgtccgtttaaacaatgaaggtcaatagaaaagctaaaatagcctaaatcataaagaaaagttattgtcataataatgtgttgatttattgtacattctttctaagaattatggatcattttgcaagtggatagagaaatgtattttggatcagctttgacatacgcttaaaaacagtggtatgttaccctcaaacaagtaacaggccaagagattttatatatttcttgttgaaatttttatatttgaaaatgcttaaaaataatgctattttaatttctataataaattacaatagccatataacttttgagggatgcagagaaaactacatagaaataatgtagcaaacaagcaaaaaaaagtgtggctcaaaatccctatcttctaaatctgagtctttatgttgtgtgagctcagataccaccctctggaatagattcaaaacatgatctgttttggcctgggctttaaggatatacatgtgagaaactttggtttatgtgaattgcagcatagactcgttatgtgggaagaggaacaatgagctgtatctgttttatattgccacatcctgattatgacatgttccaatactacaagagaaataagatggaatagcatctgctagttaagagtttagaaatatgaatgaatagtctagctcagtgattctcagccccaaacatatattcagataccctggggacaccttcacaaatatcaatgtcaaggccccattcctgatctattaagccaactttgagagttagacctcggcattagtgtattgtaaaaagtttggcctgggcacagtggctcacacctgtgatcccagcactttcggaggccaaggtaggaggatcacttgaggccaggagttcaagcccagcctgggcaacatagctaaattccatctcaacaatacataaataaaaattaaccagatgtggtggtacatgcctgtagtcctagttacttaagaggcctaggtgggaggatctcttgagcccaggagttcaaggtttcagtgagctatgatcacaccactgtactccagcaagggtgacagagaccttgtcttaaaaaaaaagttggcaatggatagccagggttgaaaaccactggtctaatttaataggtcgccatagtctttaggataccgttggtttgattttcagcatcttagtctctatatctcatatcttatcatctgggtaatacttcattattttttttagagatcagagcttatggtccctaaggttagtttgatgggaaagtcttttcctttctgacttcctttttccttttattctttgctcttttgaaaatgtattttccttctaaagcataatctggagattgagaacttttaaaatctataaaggaatagtccatggtaattaaacttcaagtttcatgtatccattattcagaaattaatatctgcttctaaaaatattgaagttgttataataaagacacataaggttttttaaaacatatgaaataaaaaacttgtaattggcattggtgtaggcagaggaaagaaagagctagacgaagataattgctataattaaagataattacagctttgagcatccagccagccatgtgaggggaaaagaagaaaggaaatatgatttttgtatgtgtagtttatcttttatacaaaaaggcaaactacttcaccaggacagaaaaccttcttctgagaagtaaaatctctaggagtttatcacacagacacataaagctttatgtaccacacagtagaacaatgtcatttaatagttttatgagaaattcagataaatcaagataatttcttatattaatattttataaaagctacttttatgacattacttcatcagtaggttcagctgctacctcatagagtcctgagctcatgtcagtaggactgtgccagctgcagtcctggaggatgttggtattccagtgagctgtggcagagcatgtccttcagttcatctgaaagccatacgaagtcacagatgagaggaagtggagcagaacaccactctgttaggaaacgtgagattggaatttgatctgtcaggttcaccttacccttttaaattcttacagtagtagtattatatatactactatattatatatattatatattagtatataatatgtagtattatatatattatatgtagtattatactttgggagagtattaatagtttgagaactatactgtagtcatacatcttggtgtcttagatggatcctggctacagaatcaaaaacgtatgatagataagtggctactgcagaacaccttacattgttcttaattatgttcttcgtaaagggaagcagagtgttaccagtgactactagtgagccagttgcccctaaagtttgtttattcctgaaacactataacatggcaatttattaagtataatgaagtagaattttgaagagtttggagaaaggtctaaaatatgtgatgtgaaaaagactgaattattcttgtttatgggataatagcatattgttttacaatttgtgtctagaaatcacgtaactgttagaaataattgcttacaaaaagaactagaatgaaaccacatagcttatattatttaatccgatggacaaaatgatacatactaacttcttttcccaatagcaattactagatgtcagtggctaccttgattttcctagatgagttttctttttgtcctaaaaacacatcttcttgtcctgttttgtaaatatatttttcttgaagttttcctgtaatagatgcatgagaaataagcacacagtgattcccccggaccagattccactgttatatttctcacagtaagcattggcagggccactgccacggctatttagtgcaaacctcatgcctctaggaggtgccactcacagaaatatagtctatgctcttagtacagccagacctcctcaaagcctcagtggcagagaagtgtgaactcacattcctgactccatgtgtcattcttcaagctcccgtgttttattttttaagttcttttttttttttttttttttttttgagacagagtcttgctctgtcacccaggctgggatgcagtggcacgatctcagctcactgcaacctccaccttctggcttcaaacaattctcctgccccagcctcctgaatagctgggattacacgtgcccgccaccacacccgtctactattttttttttttttttttgtatttttgtatttttagtagagacggggtttcaccgtgttggccaggctggtctcgaacccctgacctcaggtaatccacacacctcagcctcccaaagtgctgggattataggcgtgagccaccatgcctggcctattttttaagttcttaatagaaccttgtactccatgagatccatgtttcttttatgataaattaacttaaaatcaaataacttccacatttctagaagatgttgttggcacctttttcccgcacttcccacaacatgtctctaatatatgcctgtccctacctgcaaaccttgccgctgtatcataggctactctctctctctctgcctctctgttgaatgcctttaaaataccctttccagaaaaagagtgaaaacgtagcatagagaagtgaagggggcagggctgtcagagccatactgtgatatttgttctcattgtacaacctgaagactttccttggtctctactttccaaagaaaatggaaattgggggtagagtgaccatgttgactgccttacatacaaagggctttgaactcagcacagggaaaggctctctttaaaatgttagcttaatgaatccatattctaaggcctctccaaaaaagttcttaatactgtggcatacaatgtgagttccacatatgatccttcaacttgaaaacctctgtgacactcaaaatgtaaaactcttcacattatactccaagacttttcataaacacagccttaacccataacttccattttattcatgatttccaaatagaaaaaaaaaatggaaaatctcgaggaagacagtgtgattttaaagatgttcagaattgcattctttttggtgcatgaggtcttgtaatcccattggctccatggctttctaaggagggtcagttttctgagttctccctgtggacttctggagtttcactgcctctgcccctggggacccgctatgagattagatttttactttcacactatgaaccaggaacacagtgaggcttgtctacagaaccagtgagatggaaagggaccaggaagaggtggcacttcagtgcccacacagagagagaagggatagagaacagattcaggattgggcagtgcaggactcacaagcacgagacctgtgtccttcaaagggttttctagtgaattacctacttgggaatcacttaggatgcaagataaaaatatagattcttggccaggcatggtggctcatgcctgtaatcccagcactttgggaggctgaggcaggcagatcacttgaggtcaggagtttgagaccagcctggccaacatgatgaaaccccatctgtactaaagatacaaatattagccaggcatggtggcacatgcctgtagtcccaggtacttgggaggctaaggtgggagaattgcttgaacctgggtggcagaggttgctgtgagtcgagatcgcgccactgcactccagcctgggcgacagagcaagactccgtctcaaaaaataattaaaatttaaatttaaaaattaaaatatagattcttgggcccctctccaactctattatatctgggcctcagccctttaacaaattgccccatgtgttacaaggcaggactgggagaacgtcagggagtgagggattctggagggcatctttgcctgggaaggacggcaagtgaagcctatgaggctgacagatggaggggcaggtgtgctgaacggacctgcaggacacgcgctctgatacagatggaggctgggtattccatagggccacaatcacacttatcacttcagttgacagaacacgcacttgctcagaaatgttctgtcccattgttgtgtctctactagagaccctccagttttctccatattgccttttgtatcgggtccaaggtctttttggctctccaaggtattagcagcctttgaaatgaacaagaacctcttccaaagagcatgactgattctgatcactgagttccacattcagccatgtcagactgaaagaacaagatctgcacgagtgttactattctgttgtactgatttcccccacctgtgttgacttaattttaacttccctaaattggagaatggaggagagggagatcaatgtattggagtatataaatacatacatacatacatacatatatatgccattctctcagaattccccctggattaaggccagccacaggcaaagaggtgaagcagaaaacaattacctggaaagccccctaagtctattcccccatgtcctgtctctctcagatgcacaaggcccctgcgtcctggcctcagccctctcatccttctccttcccctcttttcctcaccaggtgacttggtctgttgccagtcatttatgttctgtgtgattttgaatgcatgtgtcacctcttgcatgaatattttctgttttaagctttcactttaactgtaaagtgaaatcagttttcttccattcagaaagtgggggaggtaggctctatacagcaccttcctggtccctgggatccagcccatcctcagaggccggctggccctggctgtggtcaagtgcatgcgtgggagggagtcctttccaccgtgtgaacatgcaaaggctgtctttggaatccaccagacacattggggacagttctcagcttgaaacaacatcagtccaagggcattgcagctgcatcaatgccatggagcctctgctgccaggctaaacagaatcaagcagcaattattgtgattaaatgttgtttctagtgcaacatggtagaagtgaaagaacttgtggcttttttgttctgattgcacaagcttggagttcaacaataaatggcttttcatttgtggtcaaaatacagctctgtattaggaacttaatcctaaacaggtttttacctcttgcaaagtttatagtggtccaatattgtttcatattcatggtgtgattagaagatgaaattgtgcctggcacatagtaggtatttatcaattatgtgtttaatgaatgacagagtgtcagcaagtagaaaatatcatgcgaggtattggtcaagaaaccagtgaaaccaacccgagttgcagactgcctgtagtaagagaaacagagaagctttccagaatctcttatcacatatggaacctcctcaagcttatcaagtcctgagattagaaattaaatggatccatttccaacttgctttttgtgtaagattttcaatattttgggtatatgcctttaatcagcctcggaagctttcaggagaagtgttttctttctgcgttacctgtccgtgcaccatctgtgtgttttggttctgtcttcgcattttgttgaaaggctactctaaatttgaattgtaaatatgtaaatatgccaagtacatgttaatgaaaaaataacgagacttgtaagtcagccctgcagccggtgtaccatggtgatgttgccagagtgcaaatggtgttttggaagggctgtcgggagtgattcccggcactgcatgctgactaaaaaggccgtccatggcttctcttcctgacatccacctaactgctgtggcctcatcaggtttgcctctgaattactaagactgtgctttctgggagttgaaactattgatcacattaagaatttaagattcttgctggagcaacattctcctttgtgtggaaagtcctgaatttttatcttagactttaggaatcactggcaacttataaaatgatagaaactaagggttcaaaagaacccttagcttcttttgaaatgaccacatttttcagaaggggaaactgaggcatggggcggcttggactcgcttcaggccacacagcaattcagtggaaaagaatggagcagaacctggtctgtacttctacgtagcagcaatgtacccgatcactgccattttaccagactctggagtgggaaagagctgccttatattcaagttcctttaagggaatcaagaaggctcctaggaaacaaaagctctgactttatcatcccataatctttgagtaaactgaaggctaggttccagctccagggatccggctgtataaccttcagcatctgtactagtgctacttcaaatgtagttcacagactggcagcctggatgtcacctggaagccagttagaaatgcagactcttgagccccgctccagacttgccaaatcagaatctgtaacaagatcccagatcaccatatatacatctagcagctcttctagaacagtgcttctcaaacttcagagtgcgtcacgatcacctgcagggcttgttaatacagaggttgccgggccccgccacccccgagtgtctgagtcataagtctgggggaaggttcagaattctgcatttcaacaagttcccaggtgctgctaactgggaccacccttggggaagttccattctacaagaaccatgaccctgtcccttcctctacaaggggcctaggagtcacaccccttgagtcatctgccttccctgccctctccaggcagaaagctgtgaggataagctctggacatatatttttaaatacaagttctgactttctctaatcaagctagtctctcttgaaacatttccccagccctaagtaattcacaataacaccagtaaataacttggagggatgtgtgttttgaggattttggttctatttttatgaatcaagaaatattttgcctggctattaatatttttaaaacttcataaagatagccattatttaagtactgcgtaatgatttcagccacatttttgccattgctgggtacaatattagcactgttaagccagcagtccttacgatggcagtacatctaatggtgtgggagagaccacaggacgcgttctctaatttggcactagctcacagtgaactggtgttacaaactcctctgttgacattcctttgacatatgaaatgaccatctgctcttaaattctacttctccagtcttgagggtttacttttcccagatcaagcatcttttactgtgcagtcccagtgaggtagtagctgtctgccgaaagggggcatttgtagttagcccaggctaaacaagtgctaaaaggaagtggatcttttcaatatcatgagccacgagtaggaaatttgattgagaggcatttgtgtcaagtggtacatttttgaacctcttggcaaagaaactgaagtttatttttttttaagtcttttattatgaaaaaaaaaaaggtggctgaattactgccctcagaagccaaataaaaacagtgcaaagcaatgcttaacagagcgtgactgcaaatagtgctggtctcagtaaactggcctgcctgtagacaccacatccatcacagcaaagctggtgggatgtttgtaaagccctccagataccttggaaggaggtttatgattaatgcatggctgggagtaagcagtgggtgtaccagatgggagtgaacattcttctctctggccctaaaacaagtcctgatagagtgaagttaagattgccagggagatgggtgtggctctcacatcctcacctgtctgctgctgtcccagacaggccagacgcctggaggttgtgaatacctggggctgagagcatgctgggcagtgtgttagaagaggaagtgctggggacagagcctgtagctgcatgaccctaaataaggcactgaactttgagcctcagtttcctcatccatagaatcgattcaataacatctaccgcaaagggtcatgaggacgaaataaaataacccacagtaaagtagctggcagacacacagtctgtgctcacttccatttttcggtgctttttatgtcaagcctatgagtcaaaactggtatgtagcgagcctcttgggggccctggagggaacttgggtaaagccacagtaatggattatatgcaagcaggagcaccatggagaccaacctaccctggccaggtggtcgggcaagcaggcttttgtaggttccttgtgcccccatcaagtttcagcatcacttgagaggacagagcaaaagggtttcttccaactcttaccacctttgaagatctgaccaatatgcacttcctcttgcctccttttcttcctcttaactattaattcatccaataaatattaagtgcctactgggtgccacacactacggctacagttatgaaccagataggtcagtttgaagttcctccctcctggggcttagcccagcagaggagacacttgaattgcttcataatttcaattttgagtaaggaaggaaaaaacttgtaaaagatgggcctcagccacacctgagaggtgggagggttttggcatcaggaaagctgccccaaggaagtgagactcataggatgcttagatttgtcagatgaaaaatgttggaaagagagccaacaatgtttaaggctcctttttcctttagaaatggaaggtccagcccccttgaggcttgtgtgaggaacctaggagctggagaaggtgtgaaattgtcattgcagagaggggtcagaagaacactaagcttggggacatggtgagattactggagttgacaggcctgctgcgggggatgaagacactgatattacggtgctgtgacttttctcaggagatgttcagctgcttcagtgacaatacagagaagccagatggctgtgttcattccagagtgaaggatttgccttaaggccaggtgcggtggctcatgcctataatcccagcattttgggaggcctaggctggcagatcacttgagatcaggagttcaagaccagcctggccaacgtggtgaaaccccatctctactaaaattacaaaaaaattaccaggcgtggtggcacatacctgtagtcccagctactcaggaggctgaggcagggaatcacttaaacccaggagtccttacaatcgattcagtaacatctaccttaaagggtcatgagccgagatcacgccactgcactccagcctgggcgacagaggaagatgctgtctcaaaaaaaaaggatttgccttaagacactcttagcttattttttaattgtttgcttagtgcgctcatccctattactctccttcccttccttgtggtataaattatgaattaaacttgcattttgagaatctgcttgagaatctactcaccattcttcctacagaaacatgtattcaataaaaattcctgactggctcctatttcccaggtcatagaggtgctaggaatatggtgggaagtgaggtggagacatccctgccctcaaggaaattagattggatgagccaacatgcaaggcaggaagaaatagaacctaaagcccaaaatacacactgtctgaaacattccatgaagccttcttgtgcaaagtgaatccccactacccgtgctccttatgcagtcagtgtagaacgtaccgcattagcccaaatagaagcgcatctcagggttctgtcagagtgcatgtgatacgtacttctagaaagaccatgcccttgcactctgcctccctccctctctcgtgtctctctctgtctctctctcttcaccattaaaaatgaaccttgagaattggcttccaagtcagaatttgggggaaaccaaccttagaagtgattccttacccatcaaattcacttgccttttggcttgtctggggcaaaagtgtttataaacaataaactatattatttctgtgatgtaagtttaatgtattattgaagacaagtgacagccccacatacccctccaccaaaagggtcagctttcctgttttctgtgcagatcgataggtttggtgtgtacaaaaagtgaccaggttatgctgacagacagccatgaggatttataacttgcttttaggatgagtgccggtctctctcccatgagcagtgagtcctgatagcagggtcactgtggtctggtgatgttaaggcattccaggtttctttcatctacactcattcttaaactgctgcagaaagagatgtcaagatatcactgggtggggacattagaaaaggattcaggaatctataaacaagaaaagcttaccttccaccaccctctgtgctttgggtgtgttctgcccctgactcagtgcaggatcagaatagggcgatcttgataacaatcatgtgtaggcaaaagcctttgtaccttagcaggatggaatagtaaatatctgggtaggtgattccccatgtgtttccaacagacactcatccgtgcagagttcagtgtggcaggcttttctgtagcacagtccctgtaacctgaacggaagactacctgaatttgcacactttagcttaaaactctttctggggcttgaggattctgttcagagtttatttcatcttagcctgtgcagctgtcagtgtgctcacaggaccagggaacccaccaaagaatctgcttcctccgccatcattaaatctggttaatttagagcccacaaagtgtcattttaccacatggttcccacgcctggtaatgaccaggaaggaagaattcccactgggattgggcccttgaccatatttcatccaacagtgaggggtcatgagtggaggtggtttctatcatgtttaattatgtgtcaactgcaacagctgtaaaaaggtaatgactatcattactgacctagacctgcttcaaaagaactctaaagtgtctgtttccatatctaatctcactggccatcccatctctaccaaattattatttatagaatttgctatgatcagagaacctacctgttaaggatgtttggccaaagaaataaatagctgccatttggtctgcacctttcattaatttgtgtggttttttttttctcctgttggaattgattttggtggctgatagtgcaggctaatgaagacaattcaaatgccaagcataaggcaccaacaataattgagcagctttccttaaagaaagtgctgcatagggctgagaacagaattatgctgccaccttgtggttaaaagtgacacctgctggccggtcatggtggttcacgcctgtaatcccagcactttgggaggccgaggcaggtggatcaccaagtcaagaggtggagaccatcctggccaacatggtgaaaccccgtctctactaaaaatacaaaaattagctgggcatggtggcgcgcgcctgaagtcccagctactcaggaggccgaggcaggagaattgcttgaacccaggaagcgaaggttgcagtgagctgagatagcaccactgcactccagcctagcgacagagcgagactttgtctcaaaaaaaaaaaaaaaaaaaaggacacctgctgttaaatttaaaggccagtggtttttctagtgattaaatcacttatgcattaaaacaaattagtggatataaaagggtaagagagtatggaccttttagtccaaaataattaatgagataaatctttgaaagaatccccaatgaaagtcctttaaccataagcactgacctttctcaaggctaaacaacaagttctcacagtagttcgaaattatacaaaattggggtggagattgaggtagtaccactgagtcttttacagcaatactatatgcttgtattatattacagtctccagccatgactttacatcaatgcagccaataatgaagcctattttatagcaaacagaattaatgtacaactattaatctaaatctgtgatcacattaatattaccatcttctgtggctcatcttagtacagcattcaggtgccaaaattaagtgttagtagagttaacaattaaaataaatggtccttctttgccctgtgttgaataactcaaagaatatttacacatgtggtctgataagagaaattttttaaactttgaagaaataggctgggtgtggtggctcatgcctgtaactccagcactttgggaggccgaggtgggaggagttcaataccggcctggcaacatagcaagacctcatctctactgaaaatcaaaaaagttatcctggtatggtggcgcatgcctgtgttcccagctactcaagaggcagcggtgggagcattgcttgattccaggaggtcgaggctgcagtaatcacagcactgcactccagcctaggtgacagagcaagaccctgtctcaaaaaaaagaagaaataatattctatgtaatattatatagttgaatgcaagtttattgagtcaagtaagaacaggattcggagaaatagacttaaatgtcttcatgaaaaaaacataggggatgctcctccaaatggctcagatatttctgctggaagagatcatccctgatagtcaagacataacttacttgatattgaatcagcctaaaataagatggtccttgtggaccataaccatgtcacaggacagcactgccttgggtggcacagtgtagagtctggaaatgccatgattgtcacaggacagcactgccttgggtggcacagtgtagagtctggaaatgccatgattgccacagggaccttcctgttcagggtagcttttactatccatacactatgcctcctatccgcttactgtctcccccatcactcatcctaagaaaagcctcgctggccatctgaaagggtactgatttccctccaccttcccctcactcaaaagaacagaacgaggacccccaagcactgcatttaagggcagttaaaccgacacatgagggtccagcctaggggcagagcactgggccctctgcatgaggcctctaccctcagctgctccaagaaggtgaaacacaaagtgatccatgtacatctgcacacatggggaggggccatccccatgcacaggggaggagccggtccaccgacacacatttaccaggaagtccatctagacctgtgagcaggagggtgagcgggaggcagtcttggctcagttgtagatgagctgccaaaatttaaggagatagccagagaaggcatgggcagcagaattttggaaacaaacatccagaaaaaagagagagagaccaggagagaagggtagcagtgcacagatcttctccaaaatgggaaccgtccaccaaggacgtctgctgtaaggatcaaagattatgttagtctagatcccctcagccaccactcctcccacctccccaccaccaacactcacacactctgccaggcccctaaagaagagtaggtggcagttgctggtgcagccactcaacccgccagcactgcccacgaccacggggactggtgtcccacagtcctcctgcagagcagcacttagagggtccaagaggagaaagctgcccccgcaactggggcctttgtccctgaggactgcagtgcatctgactcagaaacgtgcacctgatgatgatcattctgttcgctgtgagaattttgtccacagtaagaacttgggaaaaagtctttcagtggctttatagacaattctaattgaaggggagtgagccaggagtttcaacacattttctcttggttccatcctttattccacagcttgtaataatcccctttcatcctctttctccctgcactgtactaataggctgggcatcccacatctctcatcatattctactgacctccttctattaggagagaggagagagagaagagaaacatgtacagaaaggagagagttgttggcgattccacactaggtttcatgaatggatatctggcttttgaataactcacacagcaaactctttttaagaacatggcattttataaatgggcatcaattaatctgttgtatgaatgaatgaagaacaaacagatgcctgcacaggagatagataccttttgtctgtgattcctaaaatgttgtatgctttggacctgtgtataaaaatgtattttatatattttcattggtcatcatgatttagctgcttgcttgaatgtattttaaaacctattgtggtgccaatttgtagtctcagtttaaagtgaattattctttgcatcaacaaatcacagaagtggtggttattttcatttgtttatagctgtctgggggcaaacatgcaaagtaatttgacttgttattactgtacgcctgtcgtgtttacaggcacaatatacatacaatcaaacataggaagaaagaagttctgtattacgcagggagtcctgcatttatataattatagagccttagaagacgttcatgttgattcaaagattgaggaaaacaacttcatctctcagaactctctctgcatacattgtaggtaaaagtctctttttcttcagctttttaatattctttaactttgaatattcaaataaatgtgacagtgtttcacctggagatgatttggtccaattgaaccacatttgccaaaatggcttttattctccccgttttaggaggcaccctggtttgctgcgaagccacccctgccgtcttgatgtctgtgctcagggatggctgaaaacagtcacagctttatcactgaagcaaacgaaaatgtaaatactttttcaaagaagatattgcactattatcaaaaaaccaaagtatttgcttattcatgacacttgagaccaacttaaaggctatttcttttcatttagaatgttctagaattgagcaaagcaaatattctttaaacaaggcctctgtgatgacagatcatttgatatacgactccatttttaaaatatctgtagctcttaaaatatttcacacaaggaatctgaccatttctgtttcgaagtattgggacagggtgcagtgaccctgtgagtcccagcatccccacagtgacaacgagctttccttgatggacacagagcacaggctttggagtctgagacagctggactcatccctccctgccacttagctcctgtgacactcaggggaagtcaccgctctgctgggatttagcttccatctctgtaaaagggggattaacagtgcctcctacacagggtggtgacagcaattaaatgaggaaagcatttagcagaatccctggtacataccaggtacggaaatgtactaggtagagctcttatgcttctcttgcaattgtttataaataggtcttatttattcccagggatgtattcttagcacatacttcattcattcatttgaaaatgcatttattgggtactcacagcagggtagtgtaaacatactcagaatacataacatactcagaataaataaatgcaggtgaatataaagacattctatttcattagttacattgaccttaaaccttctcagacaacagtgggtgagggagatgagagatggcagtgggtagggagatgagagatggcagtggattagggagattagagatggcagtgggttagggagatgagagatggcagtggggggcaggggcaggtgatgagttgcatttttgcaaaagctatataagaattgttatatactgttctgattttttttaatgaacctaaatgagcatggatttatttgctatggagtacttgaaatctttatttgaagacattaagaatccatccaggccaggtgcagtggcacactgtaatcccagcactttgggaggctgaggcaggaggattacttgagcccaggagtccaagaccagtgtaggcaatatggtgagacttcgtctctacaaaaaataaaaatattagccaggaatggtggcgcatgcctgtagtcccagcagtggggggcaggggggtggttcaggagaggattgcttgagcccagggaggtcaaggctgcagtgatccatgattgcgcccctgtactctgggcaacagagcaagaccctggttgaagaaaaaaaaaaaaaaaaaagaacaagaagaatccacccccaaacatatcaagataagacatccattgcttcaaacactgggccaggcagctgtatgttcccgctttcgttttcaggtaagaaaaatgaagacctagaccatggaggggacttgcccagagtccaatttcaagtccagtccggggctctcctcagcatccagcacacgcttccctgactttgcgcaaaggtcttgctcctgacagggaccgaattacagattctgccactttacccgagaattactctccaaacgcactggtctctttgcaggacacagctctctgcctccatgtcaccacctttgaaggactgactgattccctcggctggtgccagtgcctgctcctgccatggggcccgcggggagcctgctgggcagcggacagatgcagatcaccctgtggggaagtctggctgctgtcgccattttcttcgtcatcaccttcctcatcttcctgtgctctagttgtgacaggtgagaaccagagtgtatatacctgtgccttaaactaatacatcccctgtacccagaagagtttctgtggaaagcctgttaggaatggaatcccgccacagagccgtcccagaaacttgtgcattagctttaactctcttctctctgctgcagagcgtctcgggacattctttattcactgaaggaaaacccatatttggttttgctagggagcaactagaagagcccttatattttaaacttcccagaatgaaagtcttgctgttctttcgatcacacccttgtcaaaatggattttgtcttttttcatgtgcgggcattttgaaatcttgtgtgatgcgcatctttttgccaccaccctgcggaagtcacagaatgtttgctgctacgtgatttcggagggattgtttatgattaaaaatgtgtagtgtagaccttcagtttctcaagaaacagattattttccaaggagaggaacatgctgtatatgaaataatcatcagtgtcctttttttagagttatacttctctctctcctctgtctcatataaaatgtcagtacccccaacaagagaaatctttgctcagagagaagttctttctaaccagaagtgatgtttcaggacattctggaactgttacaaagcacataaccttctgataggctagatgccaccagaggcccatgcagaccagctgaccgtcagccagccctgtccaaactctccctccaccatggaagcaactccaggagcgtcacttaaaattctgaaatagcttcctaccctaaaatctgtcaggaggagaaaagccaagaccctctgaacccagctagcctcctaatccctgcccagcctggacccagacctctgtggctgggacagagtctgaatgattgggaagatgaacaaagaggccgcagggccggggcttcccggggcctggacggcctgcttctgtagttactcatgttcccactaggtgtcacccttgttttatagagaacgtggatgggcggcgtattctctacaactgatggctttctttagactgtcccgagtaaaaacaaattctatttttacttgacagactttcccatagactggaagtacatatgactcaccctgagagcatgtacccttcctggcgtgccaaaaatctgtattttctccatcccactgcagtgtgtgactttgcagagactcagataattgtcttcattttctcaaaaaaaaaaaaaaaaaggtataacttactctgctagtttaggtataaacaatttctacgcaggcccaggcctcggtcctctccttgtgaacttgtatgttttttcccggaagaaggggtgccaggggaggtggacagtccctagttgaggcttgaactcctcttccccagcacctgcaaacgggccatcaaatcactgtctgattttgtctttgttgacaaaataaacatggttcttaaaacgagagatttaaaagctgataagaattgggataggaaagggtagtgtgcgcttgattttaagggggcacatttgacattacaacatttcacttttcatttcagggaaaagaagccgcgacagcatagtggggaccatgagaacctgatgaacgtggtgagcctgcgcgtgtcgtctgcctgtctgtccgtgcgtgctccagaacatcagctacttatctaagtgtgctcccatgtgctcacagcctgagtagaacccacggggagagctaagcctaagttaaacggtggcttctgaaatggatgcagtagtgctgctgccggaatgatccttaaatggctccaacctactgcagggatgggacttttttgcctctattaatttgctagtgctgtcataacaaaggaccgcaaacagggtggcttaaataacaagtttgtttctcagttctagaggccagaaatccaaaaatcaaggtgttggcaggattggttgcttctgagggaaagtctgttctaggcctctcctggggcttctggtggtttgcagccaaactttgggtgtgacttggtttgtacaggcatcaccccaaattctgccttcatcttcctatggtgacctctgtgtttcacatcacctcccatctatgtatggctggctgtgtccaagtttccccattttataaagacaccagacatattggactagtgcccaccctactgtagcacgacctcatattaactagcttcgtctgcaatgaccctatttccaaatgagaccatattctcaggtgctgggggttaggacttggacatgaattttggagagacacagttcaacccataacaacaggtcattaagctggagggagcttgggacccacaacaccctaggtatataacctagccttgctggcgttttcccagccctcagtatcttacagggtcctgatgatcctgaggccctcagggatccaccctggcgaggaacagcctgagagtgtccaggtccttccttgtcctctctgacccaggcccgtgcttttgaatggctgagcagtcccagccgctggggagggggcccatcgtcacattagcaaggcagagttcagaatctgccctgagtcctgtggcagtgctaagacagaagatgcttcttgttcaggacatcatttctcaaggtcaagcaaaaactggttgggaggagagggtgcaaacaaggaagcatggatgagccaaggtctggcgtaaaacccgcagccagcagacgtttgcagagatgaccaggggcatctccagtctaggcttcctgacctgccaattctcaggactcctctggcccaagcaggcaggaagttgtcaggactccccgttcctcctgggacccccaggattttccttccctcccctctgcatccacatgcccacctcacccttcgcagctttcctgggccctcatcaccactcctccctttactctgtttctcgccctgttcccatccctggttgtccacattgtcgccacttctcatctgttcccagcgcccctgctctgcctggtgattgctgctgtggtggcctcagcagggagggtgggagggatggagggaacgccccactgtcgcttctccccatgcagactccaggcccctgcctttcgtcactccaccattctcctggtgccagttgggtggtgaggtggggctggggaagggctcccaccgccattcctcacttccttctagagcaggggttcttctgcagtgtggcctggacctccacccacagcagcagcagcacctgggagctccttagaaatgcgaattttcctgggggtgaggcccagtaaaaggctcgcaagcaccccaggtgatccagttgtatgctcgagtgtgagagccactggcctagagcttgggttcccgctgttctactcaaggtcagcagcagccctgggcgagataggaagagagtggcaggtggataaaaggaaaaagctggcttccatcccctgccttcttcctcatccaccatataattcattattgccccaacccatagcctcatttatatggatgtgaatgtctgtgagagagcgcgagcacacacaggaacgcatgcttacccggacactggcacccatgtacacacgctcgcccacccagctctccttaagagcttttcagctcctagatcttatacaacttgcggattcttcatctcatagaagcaaagattaggaatagtagttagagtctagattatggtaacttcagctgtgatcgattatgctgttatgggcccacctgggagtcttccttccccacacccatgcctgcccatttataacatcatttctgggatattagcacctgcattgcaagttcctggcaacctaacacagtgacccatctcactgggggctcatcagacgtgaatgagctgcattggatggaaacagctgacttccaatacacttttggatcattgcacagcatgaactatctgctgtgtattactggcttccaatcaagagtcagagaatttgtgaggccaactagcaaaggtttgtgtgctgtttacatcacaactttccttgtagaatcctggagcatgagatagcctcttggaacgtgcaggctgtgagaagaacagggagcaaatcacatttgcagtgatttgggctgcaacctgagacaagttgggtatttaaagaaatacatgaacaccaacttgctttctgactactcttagctatagctgagccaggcatattgttctaggtagcatctacacattctatccctgcagaaaaccaactattgatgccattcttccctccaaatgtcctaagtttatttgtaagaataagaaagatttgcagagctgggcacagtggctcacgcctgtaatcccagcactttgggaggctggggtgggcatatcgcttgaggccaggagttcgagaccagcctgagcaacatagcaagatcccatctcttatgggagcagccagacatagtggtgcatacctgtagtcccaccgattccagaggctgaggcaggaggatctcttgggcccaggagtttgagacttcagtgagctataatcatgctactgcactccagcctgggcaacaaggtgagacctcatcttaaaaaataaataaataaataaataaaaagtttgcagagctaattttcagcatattattgtttctgtgaacctagcagccagaggctttgctggttctaaaatagtttcagaaatcaatagccttatctatctctgaccagatttaagtctgttcccttcacatgacaaagggtgatgcctttccacgtttctcatagcatggcacacctttaccaataatgatttacagcacctgtgttgtaaggatgaggctgctgtggtctttttcaaccagttcccttcctgccttgagctaagggaattgatatctcacaacctgcctatagccctgtgtaggtcaccaggcaggaagctctgcacatggctttggaagattcccagtgcccctaagattctgggacaacagtgtctaatagaactttctgcagtgctggaagtgttctgtatctcctattggatatggtatccactggccacatgtggctattgagcgcttgaaatgtgactagtcaacaaggaactcaatttagtgtattttattttacttaatttaaatctaaaaacagtagctccccttaatctgtagttttgatttctgcagtttcagttacccacagtcaaccacaatccaaaaataggtgagaaccatacaagatattttgagagaaaggaagagcacattcacataactttcattatattatattgttttattgtcagtggttattgttaaattactgtacttataaattaaacatcatcataggtataacatatatggataggaaaagacatagtctatatagggttcagtactactcatggttttaggcatccactgggggtcttgaaatgtaccctctgtagataaggggggactattataggagattctgttttctgtttctgctgttttaattttttgaaaaagccatggatcttctcctctgctctgcagtccagattcttagcaatgtgatgcatttgtttttgtttttgtttttgttttcagccttcagacaaggagatgttcagccgttcagttactagcctggcaacagatgctcctgccagcagtgagcagaatggggcactcaccaatggggacagtaagttctgcaaaaacaccagctttccacacaggcctcatcacctctggaagtcctaggtttcaaaatacatagctcaaaaagtaggaaatgtgttattgctcagttttagtattcctagcagttttagcagaacccctcatttggatgaatactgctacttattaatccacttctgtgtgccaggcattgttctaagactggtacatgtactaattcatttgctcttttagtacattttagtacatttacatgtactaattcatttaccccacgagattactgttattaataataacactactctgtaagataggtattattactcctcacaatttaaaggtgacaaaactgggcacattgctgctgtaacaatattaccacaaacctcatgccttaaaataacaatttattgacttgcaattctgaggtcaggagtctgaaatgggtctcactgggctaaaatcagggcatccgtaggcctgtggtccttcctgaagcctcaaggagaatccattggcctctccctcattcttcacatccctctctgaccctcccccctccctattcacttatagggacccttgtgattacactgggcccacctggataatccaggcttccctctcatccgggagtcatctaattaacagccttaattccacctgtagccctaatccctccataccctccacaaaacattacacattcacaagttccaggaattaggagacagacatttttcagggtcgttctgccttccacagagatgttgctaatttgcctgatatcatatagtcagcgggctaaggatctgtagttggaaccaggcagtctgatccctgggcacgcactcagtcactctgcataacctctgcatcatgcattgtgtactcttgctgatggaaggagcagctaggtttccttcatgctttagagtttacaccatgcttttacctgaggtaagagggcgtcctgttacccctgtttactgatgaggaaactgtggggtaatcaggacaccagtgcctgttctctgtctaccatgatgtagacaactagaaccagagagcaaaagttcaccccctccgtgatgatcagggatttagaacacacaggggtgttggtaagttcagaaggattgggggatccgttgtcattttttcacataccccttggaaacactatttctaattcccccagagtgagacactaatggaataacttgcttactttgtgtctgcatcctaagggcagggctttctgtttcattgaatgatgtgtctgcagcaccctgcaccatccctggtgcatggcaggcactcacaacacggttgacaaagggacgactgaacagcttcacacaatagcatatctgtggctggccaagaatttcacatttggtttttttctaatttgaggtaggaatgttggtggcgggatgagatggaagcaaggtatgaggtgccagtccctttgtgctaatggctgacgggtgcatgtttgccctgtagtttctattatgtctgccaaacaaaagtcacctgtgtgaaagggggtggctaccaataattccctccacacaggcaggggtcagtggtgctggggactgtggtcactgcacatgctgcctttctggtgtccagcctcccatagttcagcggcatcaaactggtcatcttctggtcacattggacaatctgcctacaagagtctctcattggagtgacattaaggaaagtaattgtgaactacacttagagccaagataacttattaaatcttgtattgggaaagatataatgaacagctttattttaaactgtgattgaagtaggataccaactgatggtcataacaactataatttgtgcctgagacttaaataaaaagcacgcatcttgatttaacctaactttatattacctgattctcggtaataattattgaaagacttgcctttctccgcttttaatgtgtgtgctgctttagttctttcagaggacagtactctgacctgcatgcagcattacgaggaagtccagacatcggcctcggatctgctggattcccaggacagcacagggaaaccaaaatgtcatcagagtcgggagctgcccagaatccctcccgagagcgcagtggataccatgctcacggcgagaagtgtggacggggaccaggggctggggatggaagggccctatgaagtgctcaaggacagctcctcccaagaaaacatggtggaggactgcttgtatgaaactgtgaaagagatcaaggaggtggctgcagctgcacacctggagaaaggccacagtggcaaggcaaaatctacttctgcctcgaaagagctcccagggccccagactgaaggcaaagctgagtttgctgaatatgcctcggtggacagaaacaaaaaatgtcgtcaaagtgttaatgtagagagtatccttggaaattcatgtgatccagaagaggaggccccaccacctgtccctgttaagcttctggacgagaatgaaaaccttcaggagaaggaagggggagaggcggaagagagtgccacagacacgaccagtgaaactaacaaggtgggcactggcgtttttgttttgtctttgtgggttcctgttctggttaggaatctagctggccctggagttgttctgggaaatatctgcaaacactttccagtttgttgaatgatgagagctgttttcatgtaagctgtgtttggctttttccccctccaagtaataaaataccaaaaacttgtatttatcaaatatttctctcagcaccttacttggatattttcacattttttccatcatgtctaattagggccaaatcttgtttgcttcattttgatgtccacaaattaaatacagaaactggacactttgcccacacattttacccattctgcttgttggctgcctcagcagcatggtgacctttccccttccaggatccccaaaaatcagcatgcatagcaacaggtaccatgggaaccaactcacaggtgcccctggttatatctgattgtacaaaccttcatataaatcagtaggagatcttattttgtgaccctttctaaactatagcctatacttcctaaatttagatattcaacaaagctgtaaaatgcattagcaatccacaccttctgcatgtgtctgataacttgatatctgagccacgatgaagttcacatccctggttgttaaaatctctttgggatttaactaggcccatctacttcaggcaactaataattaatttctgttttctacacagaaaaagaggaaggttctctcttctattcagttttagtaggaaggacaagtagcaggttagccagtcactagtagccttaaaaaccttccgtagttcatggccagaggtgaaccctcactctgtttgtataaattagaccaagaaaatcattctttgtgctgttctctgaatgcatttcaacttttcatattatccatgaaatcagctgttgagagcaccaataaaagggtttatgaacatgttcataaaatataaaaatgcagtccaattttttgcccttcatagaaccaaagaccataaacctgatgtaaagttcatgctgcctaaaccagacaaagctttttacttacaagcattagaaagataagacgttgagttgtctaaccattgctagtaaacagttctccagatttcacgttaaaaactggaaataatcatctggaaataaaattatccttccacaatatagtaaaaatgagtaatccatcatctttatataaacaaccctaattttaagtgagttgagggtttgaagtatttaatattcattcatttatttaacaaaagatcttaataagcacctgctgtgtgccacacagtcttctagtcctggaaacaaaacatgtacatgaacaaaatccctgccctgtggaacttacatcttagtgggaagagacagacataaagtttaaagtttataagagaaaaaaatagaaccgaataaggggaactgagaaaacaggtggggagtacagttttggatagagtggtcagggtctgcccagctatgaaggtgacgtttgagttaaaggatccaagggggtgaggtttgtgcttttgtggaaagagcacgtgaagcagaggggatgcccagtgtgaggcccctgaagctagagcttgcaactggctttttaagggaagaggaggggactgctgtgggtggagagggaagagcaaggacagcagtgaggagaaagagaaccagagctcgatcctggatggccttggcttatagtctgaacactaataatgtcactagagtcccgagcagcagaatggcacaacctagcctatgttttcaaaggatccctctgactccagttttgaaataaagggtagaagtgaggagaacaattgggtagtgactctaataaaccagattagaaatggcggtggcctggatcagggaagaggcagcagaggtgatgagaaaagctaagccagagccaagagatttgcggatggatcctacgcttagtgagataaagaagaggcagtgatgagtacgaggctgggcccaacatgtgggaaagattgaattgccattaactgaaatgaagaggatacaggcagagcaggttttggggggagaaccagcagtcagtgttgggtacgttcaacttgagataccgattggacttccaagtagagcttatcagatggtagctggattgatgagccgggtaaagaggaaaggccagggctggatttgctgatgtgggagtcatccacagaatgtggttttaaaagtcatgagattgggtgaggtcacaggataggtgagtgtaaatagagcctggaagagctccaagaatagagatctggaaaaggaaccagcagaagagaccaaagtaggaaacaaaaacaggaaagttgtggagtcctggaaggcagtgaagaacgtgtccaggaaggaaggagtggcgggccgctctgccaaatgcagcgggtaggtcagggaaggcgagtctcattggtgcccttgacaagagcagtctctgtggaatggtagaggcagaaacatgactgaaatggattagaaagagaataggaagagaaaaattgttcggttgactttttagaccactctttaaaagattttgctataaagaagtgagacaggctgggcgcagtgactcatgcctgtaatcgtaacactttgggaggccgaggtgggtggatcacttgaaaccaggtgtttgaaaccagcctgggcaatgtagcagcaccccgtctctacaaaaaatacaaaaattaactgggcatggtggtatgcacctgtagtcccagctacttgggaggctgaggtgggacaatggcttgagcctgggaggtcaaggctgcagtgagccaagatcacgccactgcatcccagcctgaatggcagagtgagacgctgtcaaaaaaaaaaaaaaaaaaaaaaaggaagtgagataatgagtaggtagaatttcggagtaggactaggtttgttttggttttagaatgagagaaacaacagcatgtttgcatgtggctgggaatgatcccacactgggagaattcctggctcagtattcacacataggtatgtggagacagggtctagtgtgtaggaaggaggggatcacctgaaggaggaacatggaaaatccatttgacagggaggaaagaaaatagattaacgcagaggctgagggtggggctaagagttgatacaaatttcttctgattccttcagttttcttagccaactaggaagcaagatcatctgctcagagtgaagataggtgaggaggtgttggaagtctggggagaagaggagaagatgcaaagtagactgtgagttgagcagagactgagtatactggggaagcatcggatgatacggagcggctttaagggctcactagagggttgagttcacgtatgattggcagttgactatggagcttaagcttagtaaagcagtacaggacaccaaggagaagggcagactttgaaagcatgaatgggtcccaatggtgttgaaggagcattggaactgggttacagaaggagtgagctttgacaacgagcgctggtctgaaaggggttgcaaggacttgggctggtggagaggctgtggtttagaaaggcctggggtgcagccatgagggtgctgaggccgggggtggacatggagaggggacacagatagagcataaaatcagtgggggaagggaaagtcaaggaactgaagggcgggatttagaagggtacacgtttgttgaggtcaccaaaaattaagacaagggatgtgttagagaatcagtaaaccaagagccaaaatccttcagaaatcaggcagggggcaagacacaaaatgtgagtcagtttctccattagctttgaagtttccaaatgacttaaggatctttctgatgacgccagcaaactgtagaagtataaaattcaggcatttgataaagaaacaccatgtttttaaatattaatcctccatggatgatcaatccttcagtgacaattaggaattgaaacagtagtctaaataattattttggcttctttgtacctacagatgcaaatacaaaattagaggaaatttctctaaggataatactactagatatccccgaacatcatacatgtggtaatagattgcataagtgtttctcttcccataatttcttcgtggttccataaaaatcatttgaaaacgttgctagacagattatgaggaaacatgtgcaaaagaaaggttagattgttaacgctgaattactttccttggcttgtgtttgttctgacagagatttagctcattgtcatacaagtctcgggaagaagaccccactctcacagaagaagaggtaagttttgtttctttttaaaaagggaaaactgtagtaaagaatagaccttccccccttgaataaatgcactgtaatgttaccctttgaaagagctgaaatattctcctatgcctatgtttggagatgaagacttgggatgctggttttataatggcttggagagactgacgggcaggccagacaagaaggatggcaggacaagtagtcagctcaggaaaagaaactgagcaggaaagcagggtcaggaaaaatagagagggcaggggagaagagtgagaagagaaaaattccagcgtgggagcagtcagcagtcaggaagaccacatcagaaggaaatgaatcatgggttggaaaattcaggaaattagaacaggtgagtgtagggaatttgctccagcctgggagacagaaagaggaagtctccgtggggaaatttggatgctgagagcagattaacttcagtaagtacagttccaggcaggagctagggtcagacatagcagccaacaagagcagatcgcatattcccaagcaccagggtgcaaaattcacgagttagattttcaatgaagcattaaaattgttaaagccagtattatacatataatatgaaatatgtgtatatatacatatttcatatgtatatatataaatgttgagctatgctcagagagctaaacaccttaattgatctagctgtatatagcttctatctggaattcctagcagagtaaattgtgtacatgtacaagagcaaagtacatatgcaggtacatcacttcctataggactctgagtaaagcattagaatatggacatagacacccacgttgaatgttcaaagagcaaaaatgctttccctaggtgatattgcccaccctcgtccatgtttctacctccagaatggacctgccatctgtctatctggttgcacagaccaaaacctaggggtcatctcgatacttccttttcctcactgtcctccaacacagtcaattgccaagacccatcagttgcacctccaaactgttttctttgtgtacccacctccctcaagcccactgcggccgcccctccctaggccagagcagtcccctcctgctgatccctggcagctccttggcctccctccactctgttttctactctgcagccaaagtgatcccatctgggacaagaaggtaaaatatataggagttctgggaattaaagactatgtaaaattttaaattgctccttatcttacatttgtttgtattttttgaaacaggacctagttatactgatgaatttttaacatgacagaactatgactcacagacattcattttaggacaaagaggaaaaataaatatgaaagttttttttgtatttatgtaatttaatgttaaacagtccagactgaagctgagatctgagctttaagttctattaccccaatttaacagaatgttatggaaaggattgattagaaaaagaagagaaatggggaaaaggaagagagtaacttatgggaatatagcaacaatttacagactgaggaataatgatgaaagttttaaagagaaaaattgagaagctaaatagcaagggggctggaagagaaacctgtatacaaaataaaaataatagtcataatggtcatagaaaacagtcaaaaggaatatgagaagactcaagaagcttttataaaagttgaaatgtacagtgagaccctctgcacactaggttcattcccagagtcaatattaaattgcaagttaatgaatgaggacaaaggccaagaagaccaagtactcttacaaagagtgaggggcattaattacaaagaccagggggaagaaagctgaggagagaagctaacggtggtgaggggctgactctcattgttacaatctaggtcaaggtacatttgtcctccttgatgttaccaggtgatgaatacgctggtatgccgtctcccctcaccattgtcatccattgtttacctttttataatctgtccacatataatttttggcttggaccaccatttagataatacattctgtgtttgcacttccttataaacagcagtgaattttttttattaaattcaaagaaattataattcttgtattctgagagcagttttttcattaaaacctctaaggtgagaatgttaatcatttcatattcattaggatagtcagatcaacatagtaagagttttccaaagactgtttttctgaactgtaaacccttggattgtcaaggcctcaccaaactgagccagccaccagcctgtaatgaaaagttctcatgcaaatgaccagttagcatgtggcaggcctgtcttaagaagcttttgagacataagaaggcctgtcttaagacaggcctgtcttaagaagctggaaacttcacctgcagtatgtgagaaaagtggaagcaggaaaatgtccctcagcccttgggaagccaggcatctgtgaggaagcatgttcatgtatttcctgggtatttgaatgaatcaaatcactgtgataaaaataaacacaggtaatgaagggtatttttacttatttccaaccgtgatttttcacaataaaataatactccccaaaagtctcctaattagtatatttaatcttcacaatgaatgaaatccctgttgatatcggaggtgatacaggatttattagtgagactgtgggggtgtgcttggaaagccactggctcttaatagtatcctgtaagttgtcatttctgacttggctggttgcaagcgagaatgagttttcccactgaagaaaactagacctggactgtcaatgtctgtttaaccagtaatacgcaactaagtcaagaaataatggacaggaataccctttcagatatatgtgtaccaccaacgagaatccagcaacgggtgttggagaccactgtgatgcaggaagcatggagtagtctaattcagagttcttatactttactggccatcagaatcagcaccggttgctgggccccagccccgaggttctgatttggtggttctgggatgaggcctgagaacttgcctttctgacaaattcccagatcctgttgctgctggtttacagcccacactttgagaatcaccggtctactatgtgttttctgtccttttttgtaaagcagtggagccccttttcaggcaaaatatcattctgataaagaaatgaaataaaacacatgctgtggtcaggtccccggggccttcaggagcttcccactccacctctcctcaaattcctcggcagacccaagagaactgggttttcacggaattaagggaatatgactgatctagttaacatagttgaagatagtgtgtgtaattattctctagtaatgtgctccataattagtacagataagaaagaacaaatctttaaggagtacacacacagaaacccaggagtgctcagtatgtagcttgtcactaaaaagagggagggggaagtcacagctggaagtttattcaactctccctttgtctcctagatctcagctatgtactcatcagtaaataaacctggacagttagtgaataaatcggggcagtcgcttacagttccggagtccacctacacctccattcaaggggacccacagaggtcaccctcctcctgtaatgatctctatgctactgttaaagacttcgaaaaaactccaaacagcacacttccaccagcagggaggcccagcgaggagccagagcctgattatgaagcgatacagactctcaacagagaggaagaaaaggccaccctggggaccaatggccaccacggtctcgtcccaaaggagaacgactacgagagcataagtgacttgcagcaaggcagagatattaccaggctctagcaacccagaagacaaccctgggtagcctgtgatcagtgtctggagacgtttcttctgtggaagagaagaagtgacacaaacctatacttcatatgctgctttagtcacctgaagatggttggagaggccctgtcgactgttctcccagttgttcagtttctgagacagagaggtacggactaggctgcacctgagtgtgcccctgcctgccagatggacaggtacacccaagcacatctccctgctgcaccctcaccacccacaaaagatcccagctgtcagtggtctcatctcattagtgaggaaagccaagctgtatggaaaagctgcactcaccaaggaccacaatgcccccggcctaaagtactgccattcagaaaagcaggtttttcttcctctctttccttttctctgtctgctactgactttaaggctttttcccccttgaaatgtccagattcctgtggttcatcccaaggaaattttcacacaaagcttggcctttgccctcaatataggtgttttaggatggtgacaaaccatggctgctgctttctgcccagctcgccagtcctccccaaagagttgcgcatcagcacctggggatctggaccctgcgggtgaagggatggggagggacgtccctggagtctcttctgtctttgttccttcttattttggcattcgatatcagcagcctctccccaaagtacttgaagtcagttttagatgctttattttatttttctagtcaaaaacgtgtttcccccagtgtttgaaaactcgtccgaatcttttcagtattttccatgagtattgtggtacttctagacttgtttaagcccagaactcattccttcaaaacagagagccttaatctttatgttgggacacagaccacatatttggacggcagccatgcatccatcgctgaagggctgtggacatgaatgtgtatttcccatggtctccgctgcccacaccaacagtgtggcatctcataagttaactgctaccctaaggtaatctaagattaaaatgtaaacatttatttttgttatgtaagtttataagatgttttatgttcaatgcctaatttctcaaaagtgccagaaaaaaatgtatattagctattttgattttatgtacaatgatttatactctccttttgaaaagataccataaagcacataagctagatcactacaaggagctgttatcttttttctaatcaagtgtttaaaacactgatggtttttaaagactcacctttttaaatggtacttggagctcctgattcaaattacctagaccccctagagaaataaatggaatatacataaataatcattttcagtggtttatggtgggcaatattgcaatatttgaaatggtaaaaatggaaagaagaacaaaatatgatgagaggtggctgtgaattataaacctcataaaagtgtcataattccattaaggtttaattatattttttcagaaaacagtgatgaattctgtagtccagtgcttgccaatgcaaattgcctattggaatcttcttcctatattttacaaacatcagtggctgaaatagctcagagtaagagctcagcctggtttgaatttaatcatctctttagatcttataaggccagcattaggaaacttgttcacttttcattttcaaaggagcctagttgaagtgctattatgagtgtgggctatggaaagacagcttttcctacactgataaagaaaaaaaatgaggaaattatttcatccccttgtgacatctgtgactttttggatttaataatcttgctgtttttcctctttatgacaaagaatataattgggaggatgaagtgtcttaaaaattgtagagaccagctcactggaatgtttttccatccctgtattcatggcttgactttgtgactgctctacactgcatgtctgacattgcagagtgagctatgttgaggtaaactggttggttgtcattattttgcaatcagcctggtctctcccatgaagatgtcgtgtgcataagcacaatcatcactgattagaagatcacagcagaatacccttggattagagagaagttcgtaccttgcatttctctgaattctagtctctcataagcactgctttgctggatgattttcactgctttgtgttaatgactttgagcgatctctcacatgatggggttctttagtacatggtaacagccatgtcatcttacacacctagcattgtgaatgctgtagtgacatcctttataggcaccttacagctcaaaacttttgtttcatttcatgccttacttatcaaaaaggcaggaaagtaggtatgatctctaaagtaaaaaaaaaaaaaaaaaaaaaactttttatagaaagctcataaataatcatgtcattttgcaattttgttaccaaaatttcccccaagagttttcaaatattagttctgcaatgtggctatgaaatatgcactgaaatataccttttaatttgagaaccagtggttagaataagctgtgatataaagtattttcagtgtacttttaaaggaactataaggccctccagcataaacgctaaaagaatagatggtagcacaggccatgagggctgggggagagaagcagagtgaaccttagaaagatggctcagctatttggagcactggatattttactgaagttatttactgaggcaccatcactgttttgactgtacagtatagtttttcataaatttcatcacatttactttgttcagaatctgggcttgaatctttgagttggacaaaagcctatggtttcttttaaaaagtttcatcttgagctaatgctacagtttaaataaaatgtatgaaaggtagttatcaaaaacaatttgtatatttaaaattctattttgacatccattttttacagcgaattatagcaggttatgtgaaatttaaaaataaattttaggaaatttttttatcttgtaagtaagaattataaatctatctcagttaaaagtaggatctttgtttttattcagatattttgaaagtttagaagcattttgtatgctactttggtatttcttaagtatagtcagcaggaaagggtaacctgttttatgcaaaatttttttaatttgtcaaatgtttttagtgtgtctactttctgaaatagtctcaatatcctgtctgtatcctaggcagataactacacaagaacaaaacgctatatagaaaagaaaatatttgaggaaatcttaaattccataagaaagtaattcttgcaagaatgttggctacatatttttttttctgtcctgaataaattacatcattaggtctgttgaagcttttgaagctaccactattctttctgggataaaggctaattactgatttatctgccctcaaaatcccagagttaattctaattgagtactaaattaacagtaagtagttaacacagagaactaaaatttaaccgcattatatcactgtatatatttctcatgatttttgctaattagagcatttacttaaccagtaataaactacacacacacacacacacacacacacgtatacgtgtgtgtgtgtatatacttggctctgacacaactctggtgcttaattaggatatgttctattatgtattttgaatgtttatcctgctagtgtgatgaacttttgttggaaaagcagaattagaaggaacagtttttcaatcagtttcatttggtaattacaggaaaaccttgagttgctctaatttaatttttccaattaatacatttagactttaaattgcatccgtaattctcttggctgaaaaacagtggtattttaagacagttttgttatacatgtgacttacttttgactcagcctgagaggaggaaatgtaaagagataagagatttggcccaaagcagcaagagactagtaaccttgagccaggacgaagccaagacaacgtgactcccaagtagcaggagcagaggtcggtcacctgtggcattctgtttcattcccttttaaaattatgagactttataggcagtgtaaaacatcagcaggcagcgatgtgataggatgtgcgaaaaagctggtctgataccatggctataattacagagctttagttcaattaggattttgtaaatgagcaaatgacctttttttccagtgccccttgtaatagttaatatgagtccatgcaatcttgtgatgccattctcctgaaggtgttgatttctggtacccagccagcttagctttggctgctggaagcacagtaggtactgatgattacttcctggaaatcttgacaggcttattgtactgtgtaatggggaaaagttaaagtataatgtttggtgttaataaatgactgatgtgaaaataggaacatgtgtctttaatatcaaatatggctttatttgcagtgaaatctaaattccttattctacagtagtattttcttgccctgtgttgtatattttcctaaatacatttttcctgacagtggctttaggccagttgaacacacttagactgaaagtgtttaacttaaagagatcagtccagaaaccatgataaattagaatctttatctggaattaccaaattaaaatttaaaatcatggtccagaagagaacaaacattcatggttttttttatcctactgctcatttttaggtctgtgtttacatctagtctctactatttgtgaagtatgtcattatttttttcaagttcttctttgacttaactgaaaaataatattccaaattcttaatgtaacatgaaaagagaaatacaatttttgcttaaaagacattttttaaaaagcgttcaattcagtaatcatttctgttaatacaggaagtttttttggcttgccagttatatactgtgggtattttttaaaatgtgctacccttgggttgtctcatatcaccttgcgtaatcatgtattacaaaggttgataattgtcatttctcagatgtctgtatgttacattggcagcagtaaaatgttttaatgttgttaccttttaaataattgtgttgtattaacatgcctcatattttctggggaaacttgaaatatatctaaacaaaaaaggtctgttataaataggaattggcatttcattgttaatgttttttcctcataaaaatagttacaccaaaagtgacatattgtctattacatgggcccaatcagtattaaagtactccccttactcaaaaatattaaaaaataattcatgacacttagtagcattttcattgattgtttcaaaagatcttcataatggtcaaattgtccaattcacaaaagagtgagaaagttgttttcagtactgggaatttttaaaccttagttttaagaccaaaaatatctcttattagcttgaacattttgtgattacttttccctccccggatctagtccttttaaggagtaagtctaaagaatgaggccatgaagtcactatttcctcccacctcagtttgtctcctggtacttagctggcctatcgctttgtgtggcaatacccctgggtcgcttccccactcagccttctgtatctgctgttcacaggacatgccattatgtctttccagtacggatcacagtgctgccatatcacagaccctgccagccggcacagaaccatgcctcgtcacagctctgcccaactcacaggctgccaagatgaggccacaggtccacctagggcggcagatgctggtgctatttgtcacgacttttgccaaaacatgtacactgttgctcacatctttcgtaagaatggttgacactaaggggccatggaaaagcacttttaaaaaattatgtggtggaatcaaactcacagaggcagaaatgttagtgccgtgctctaaccaagtaagcttagtgttccccacagtgatctgtatctggcctgagtctcctcaagcagcaacccccactgtccagcatgtggaaggtagatccttatgacaacaccagacccatagttaccaggaaagaaaaaggaagctgagtgttgtgaaggggaagaaatcctttttataagaagtaatcatttttaggccgggtgcagtggctcatgcctgtaatcccagcactttgggaggctgagacaggtggatcacttgaggtcaggagtttgagacctgcctggccaacatgatgaaaccctgtctctactaaaaatgcaaaaaaaattagccaggcatggtggcatgtgcctgtagtcccaactactcaggaggctgaggcaggagaatcacttgaacctgggaggcagaggttgcaatgagctgagatcgcaacactgcactccagcctgggcgacagagcaagactccatctcaaaaacaaaaacaaaaaaaaaacctttttaaagtaaattgagtgtaaaatgttttcaccatgaagccattgcaccctctcccccaggaaacagtgcctaaggatgatgtcaagttacagccagtttgctctgatcccccaggacctaagaaaactgtgagtgcttcagcatgcaaaggtagagctaccagataaggagaataacttggccatttatagcaaactgcctgactttggagtgagaaaccaagcaccttctaggtcctaggataggtgaattggaggtgcagctgctgaagttcccattttctacatacttcaggagccagggtgtttcatttggttttgtaaaactttgctgtaagtcatcacagttaattctttgaatggacattttagagtgtaactttttttcaaaattagcagaacagatatctctgctcattctctttatacatttagttttttaaagttcccctagtatacctgttaggcactctaaataggacacagttaaagctaaaagaaggaccagttgctccctagagcctacagttcagaactatcttgttgtcatgtcctggtttggtttggtttgtttttaactcaacaagttggaaaccatgagtttaaagcaaactatttccttttcttaagcttaaagagaattttttttttaatctttagctcctcatttaggtagtgaaggcttccctgaaagacagcagtgcccttctctggaagaagaggctgggaccaaaagcctgagtctatgggttgaggattttgagcattcctttgacaagcttctatgtatttttaatataagactcataaatgaacctgatgtggtgttcatgacccatcccttaagcatgcttgctttttttaactttactttttgagtatagtacttgtcttgtttttcctggagccatgctaggatttaattcctatgtgccactacccgcccatgtcctggaagatggccatgcctgcagcaatgctcatgtcttgaggagaagcaatgtgaaaagcatcaggaaagctgaaccttacgttcaagtcagcaaacatttgtgagcattctagtatgcttgcgaccttgacactttttaaaaattatctttttatttgcttcgagtatcaaccgtatagttgactctagtggggcgaagggagcagagatgagagcaaaattcagacttgctgcccctgtgtgtctcagttctcatgtctctctgagaaatgtgttggcccaattccctatctgccactctgagtctcttgagtaaatgtgtgtaaatgagaaaaattatctcaaagatttaacttattatttagatattttcttctttttaaactcaggaataaacctggtttgtagataatataatatggctactagagctataattgagtaggtgactagaagcattttttcaaatatatttcttgtaaagacatctactttgttttaactaggaaaagaaactcctcatattaaaataaacatttccataagcactttctagaagagtgtagcatccatctaccatccatcccagaatgtttgtatcttgctcatagtatttcaaaaatttttatgggtgaaaaaaatgcacttttttatttattggaaaagtgtagagttattgaattaaattctcaagtgggacaatttagtgtaaagggaaacatgggttttggagacaagagcacagggctgtggtccctgttccagcattgactttactatgtgacctcgagcaaatgatttaacttctctgtgcctcagtttctccatatacaaaatggggataatgatactaaccattgcctacctcatagagatgttatggggacaaacgaaataatagagataagcacgaatgctttcaactcttcggaagaaaggtgctatataaattgaagttgtgtttttaatgatccaattattaattatgtttagggtttaaataacaatactgttagtcatgttaagaataagttttgttttgatgcatatttccacttctcttctgtggccagatcttgatcattcaaccagtaatggtacctgaggaactgaaatgggtatttgttttcgtatgtttctgccagtagtatttcaattgaatatccagaaaagactggagtttaacttgtaatatcttatagtttacatgtaataaaacttattcaagctatatataaaagtatgattacatgtaaatagcaggtatgttgtaattaaaggcacttatcaaattgtctttgttcttttttaattgtaataaaagtcagttttacataaa

SEQ ID NO: 110 - DNA, 1653 bp, Homo sapiens
cagagactttgccaccaccagtattggggatgctgagctgcggggtacgggcctgaggagggatgggagtaagaagtgctgtggaaaccgtcaggccatgaaccaggctgaccctcggctcagagcagtgtgcttgtggactctcacatctgcagccatgagcagaggcgacaactgcacggatctactcgcactgggtgagctgggcagggcaggggctggtgggggaggggtcatgtggccccaggtcccacctgctgggccctgggggtggggcggggctgttacaccccccttcctttcacatccacaggaatcccctccataacccaggcctggggactgtgggtcctcttaggggctgtgacgctgctatttctcatctcgctggctgcacacttgtcccagtggaccaggggccggagcaggagccatccggggcagggacggtgggtgaaggacaacagggatgggttgactgagagttctctcttaccgagaagtccccactcatcccctaaactctgcgttgcagctctggagagtctgtggaagaggtcccgctgtatgggaacctgcattatctacagacaggtagggagctggcagagaggaggggcacagaggccaggtcctgggtggctgggatgggggcgtgcaggaggaaggacaagttgctgaccagattcctgttccccgtcccaggacggctgtctcaagacccagagccagaccagcaggatccaactcttggaggccctgccagggtgagtcaactgtggctggagaaaagggggagggaaggaagtggggggcttttcgggcttttccgagggtccagtgaacttctaacagccttgcatctccaggctgcagaggaggtgatgtgctataccagcctgcagctgcggcctcctcagggtcggatccccggtcctggaacccccgtcaagtactcggaggtggtgctggactctgagccaaagtcccaggcctcgggccccgagccggagctctatgcctcagtatgtgcccagacccgcagggcccgggcctccttcccggatcaggcctatgccaacagccagcctgcagccagctgagatggagggcctggcacagcggggcgtgcactgccccagccccccgtagcaggggcatgactgtttcccaaccagcacccaaagacgggcgccattgccaagtcacaggatgtgatctaccccggacttcctatctgagcttcaagggagacatctcagggcaaagctttcgtgatggaggaggcaaagacagtagccccctccttatttcttttttctatctgttcctcttagcccccaaactcccaggttctcacttccttcttctggagtttaaccagatcctccccacccccgctccctcatagtctacccccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtccccaagttttcaaataaaactttccaaaaa

SEQ ID NO: 111 - DNA, 14392 bp, Homo sapiens
gcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaaggtgagtgtccctgctctcccctaccagatgtgggccccattggaggagatggcagggaggtaggcacggcgggggggtcaggggccctctggtacagtgggatgtacccagctaccgtgattccagccaggtaaggtctttaaaaaaataataatagaataaatggcagaagacttaaaggtgaagtacttaatgcatgggcaggggcaaaaataaatgaattcatcaattgatacgtagatggataggatttttaaaatatgtcagctgccagtctttatggatttcagagctttgaacaacttgaaatgctgtccaggtgcaactgaaaatttcaactgcatctctctcatctctttgtctcttagctcttgatgcctctcatccttctctgtctctctgctcaccctgtcttgctcttttacatgtttctctgcctctctttctcccgccatctgtctgtcgctacactcagactctctttccccgcatctctcctggcctctgaccatctcccctatctctgtctcctccatcttgaccacactccatcgatctcctttcctccatctctcccgctctcttttcttgccttcccccacctgccttcccagccagcatccagcctagagctttgtacacagctggcgtttaataatagtaatgtcgccgaggacctttacattttatgagagtgagcatcagttctgttcaccctagtagcaggaggattgcaaggtgccggggcaagctgagcacttaactgaactttgcttgtatcgctttagaggagacccttggggcgggggggcagggagcacttcacaccattgtcaaccgtagtttagctgtgtggacctaccccaggactgcatgtgtgtgaccagagtccatattcaggaagcaaacaggttgttcagggctggggtgagctcgattctgcaggcttagcacagcgtttggcacaaagtaagtgctcacgaagtgttagctattagtatttctgtaaccaaattagaatcatgctatatattggttttgttcctgctttattcaattaacagtagtgtttttgaagcttactaaaaattgtttgaacacatgatctttcatgatggacaagactgtcctcacatcagcatgaactttgattgatttgaccaagtgccgattgttggacattccggttgtttctcgtttttttctataaacatccctgactgcttccttggattcctgaaaagggagttgctggggcaaagggggcgtgcatttttaaagtttatgaccctctctgctaattctccttccaaaaggttgtcctattttatgctccctctacttaagctaaccctaggtgagtattattatgttttaattatttcccaacatgacaggtaagaaaaacacattatcacattgttgaaatttgcatcttgtgattacttttactattcattggccattcatgcttttttttttttttttttttggttgtctggtcatgtccttactcctaatagggtgttcatcttatttttcccttattgatttgccacagctctttatttggaatggttattaacctttcatcagccattacatatatagcaaatattttccccaattcatcatttgctttttttctatttgtttatggtgttttttgtgatgcttatgatggttttatacagtcaaataggttagtctttttttctgtggcttctgtctctggttttgtgcttagaaagtcctttcctacttgaaaatgagataaatgttcacctatgttggcttctagtctcttttatggcttcattttttccatttactatagaggttaagagtgtgggtactggagccagactgtctgggacaaacccagcgtcaccccaagccctatgtgtgatttttagccaggcacttaacctctccatacctccatttcctcatatgtactgcaatggttataatagtaccttcctcaggagtctttgtttagattaaaatttttaaccacagtaaatacttagcacaaggcctgacacacaataaacccaagatcagcattaggtgttaaaacttatatcttgaatggatctgggcattttagggtatatgatgatggtgacatttcaaactgggcagggaggggttgttgggataatggactgactattcactcaataactttatcttctccctaattatctcagacacatttgttaaaccatactccatggtcctccagtttgaaatgccacattcatcacaaattcagttctctccatatgtgggtccatgtccaagctttctattctgttctcttccccagtatctgttcttataccagggccacactgttttgctgattgttgctttgcaatacaattcaatacccagccatgggtgtccctggcaccttgcccttctttattcttgattatttcaggcagcatcagttgaaccagccagagaccagcaaatgttcttatttgaggcaatcctcctctcgcacacatgcactctggctctccatgcatgtgtccatttctctcaatgtctctcactatctcttgttctctcttgctcgctctttgtgtgtgtctctttgtctctatgtatccctatctctcagccagtcccctggatagaggggcaattgtcaacttgaagccctgcagacacctaatgacttaaccagacagcgtagaagggccctggcccttgtctactccacgcctctccgtgctcagtgtagaagggcaaattgaagaccagagatctcagggcctcaccgaaatgcagcggcagagttgaaatccaagcctagatctcaggactctaggtgggaccctggttctggctctctccccaactgaaggcctcagtttacccctcagcacccagaagggggaaggggaacctgggctaccattcccccttctgccttctcacacgttggaccccaacttcccacaggttggacgatccacgatcacagtgtggggcccagcctcacaagagctgggctaggtgaggccccggactccataggtcaggaggcctagttggccagagcgtggtgatgatggaggcatgtcagtcagtcaggctgtgtgtccccagagctggtgctggtccccgaaaaccttgattgtggggcccctctagagagtctgatgatgggctctgtattggcgaaggctgaggcttttccagctccccccatgaggcccagaccaaaggcacaccagcctcaacctcctcctccccctgttgccatctctggcggagtggccatgtatttgggaacgttgttccagagtggacagggagactgaggccctagggaggctggctctgtttccaggcctggtaggcaagaggccctatgaagcagcaagctgcctgactttcagatggttccaaggagtttggacaccagggacactggcctacacatactgagactttgggaccgtagaccccacagtctgtggttttgagattctaggatcctttaaatctaagaaatgctgttctatgattctgaggtcctggtgttatactatttgaagaccccaggggtcccagtatctgtggagcctgcctggcactctcagagcttcaaacctgggtcctctccacaacccaagaagggccaggtcttcagagctaggggcttgtcatagtggccagatggacatcacctaccacatccaccagcacccatgtcaccccacctgggccaagcctgctgcaggacagggcagccagttctcggaacgaaacctgtggggtggggtatctgccctcttctcttcctccgtggtgtcgatgaagcccggcgcatccggccgccatgacgtcaatggcggaaaaatctgggcaagtcgggggctgtgacaacagggcccagatgcagaccccgatatgaaaacataatctgtgtcccagaaacatcccccattcagcttctgagaaacccagtcagaaagggacgtcccaacagacagtgcaggaagccggctgcccagcccggccctctaggtcctctacccccagacagatcatctccatgtccctgtctgagaatgtatctatgctttgctgagtcaggccatcccacatgtgtttggggagaattcttagctctggccaagtgtccaggcagcttcagaagtgaccacaggccagccacatgggccaggccagagtggtggaaaacatccatttgcaccgaaatcggtattagtttgttctggctgctataacaaagtaccacaactgagtggcttcagcaacagaaattgatcatctcacagttctggaggccagagtccaagatcaaggtgttgccagggttggttccttctgggggccataagggagaagctgctccaggcctctcccccagcttctggtggttgctggcaatctttgttatttcttggcttgaaggagcatcaccccatctctggcttcattcattcactcaccttctcatctcaccagtgctctcccaggcccttgttcggagcctccacagacccacactcctgtttctcacgcagtaatgttctaagcccccaggagactaagaacttaatacctggattctcacactcatctccctcagcaccacagctctgacaaccacccccaggaggtgacagcaaagaaaggaaggagcaactgctcccccagaacccttctatactcccccgggctgctctcagcagctgtgtgcccaactcagtgctgtgaggtggaacggggagatggagacacacacacacacacaccagagagtttataaaatgtgcacacggaaacacttcctaaagaaagaagtggagttctcaagtcactatgggactacggaactcggcatctgagcatccccttctgtataatggggttggctgggcagtcccttccagctctggcttcctctcagaccaggattataggatcctgaaaagccagtgcttccctcagggagtggaaggttctggggctcagcagggggcccggagccattgtggagggctttcaaggtgaggacaatagaagagcaggtcttgcgtggcttggacagggaaagaggagaaggagtgggcatttgaggcagggggtgtagcatgagccaggcttgagggccagaaattggggtgaactctgatgggggctgggtagagaagcttctacaggccccagctcaagagaccccatctctcctcctctctgtcacttgccatgctggatccgtgcatgatcacactcctggactcgcctccttgccctgagatccagacccccgtattcagctgccccctcagctcctccactcacatatttaatgccagactcttcatgtctatctacacctgcacttttgcacccaatccaactccccgccatgtcccccatctcaggtaatgtcagctcggtccttccagctgctcaagctaaaacccatgtcactttgactctccctcttgcccactacatccaagctgctagcactgctcctgatccagcttcagattaagtctcagaatctacccacttctcgccttctccactgccaccagcccattctgtgccagcatcatcacttgccaggactgttacaatagcctcctcactagccccactcacagcagccagatgaatcttttgagtccatgcctagtcactggggcaaaataggactccgaggagaaagtccgagaccagctccggcaagatgagcaaacacagcctgtgcagggtgcagggagggctagaggcctgaggcttgaaacagctctcaagtggagggggaaacaaccattgccctcatagaggacacatccacaccagggctgtgctagcgtgggcaggcaagccaggtgctggacctctgcacgtggggcatgtgtgggtatgtacatgtacctgtgttcttggtgtgtgtgtgtgtgtgtgtgtgtgtgtgtgtctagagctggggtgcaactatggggcccctcgggacatgtcccagccaatgcctgctttgaccagaggagtgtccacgtggctcaggtggtcgagtatctcataccgccctagcacacgtgtgactcctttcccctattgtctacgcagcctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcaggtgaggccctgggcccaggatggggcaggcagggtggggtacctggacctacaggtgccgacctttactgtggcactgggcgggaggggggctggctggggcacaggaagtggtttctgggtcccaggcaagtctgtgacttatgcagatgttgcagggccaagaaaatccccacctgccaggcctcagagattggaggctctccccgacctcccaatccctgtctcaggagaggaggaggccgtattgtagtcccatgagcatagctatgtgtccccatccccatgtgacaagagaagaggactggggccaagtaggtgaggtgacagggctgaggccagctctgcaacttattagctgtttgatctttaaaaagttactcgatctccatgagcctcagtttccatacgtgtaaaagggggatgatcatagcatctaccatgtgggcttgcagtgcagagtatttgaattagacacagaacagtgaggatcaggatggcctctcacccacctgcctttctgcccagctgcccacactgcccctagtcatggtggcaccctccggggcacggctgggccccttgccccacttacaggcactcctccaggacaggccacatttcatgcaccaggtatggacggtgaatgggcagggaggagggagcaggtgggagaactgtggggaggggccccgagtcaggctgaaccacagcccacatgtgccccccagctctcaacggtggatgcccacgcccggacccctgtgctgcaggtgcaccccctggagagcccagccatgatcagcctcacaccacccaccaccgccactggggtcttctccctcaaggcccggcctggcctcccacctggtaacacctcagcccgtaccccatggcttcacagaacccccaagtccccagatccttggctgtgagcagtgtaggctattctgaattgcagtactctgggggtcaaaggtgtcaggtctcagaggcttggaaactccaccctccaaaaaacgtcaggtgcagaaccttaaagatgcagaatgtcaaaatcacaaaaccacagagctttacaaagctagtcaaaatgtcagcacctgcgaatggccgtctttaagcttctctgccagaagcctgggactttggggacagcagagccccctgggagtcagggttttcgaggctcaggagggtgggaagctcaaaatgagaggccttgtgggccaagctccagagcccagcccacagcctccataggtgccctgtccccacccacagggatcaacgtggccagcctggaatgggtgtccagggagccggcactgctctgcaccttcccaaatcccagtgcacccaggaaggacaggtcagtggacagggctgggaaggatcctcgccctcctatcccctcccctgacaccctctgtccccccagcaccctttcggctgtgccccagagctcctacccactgctggcaaatggtgtctgcaagtggcccggatgtgagaaggtcttcgaagagccagaggacttcctcaagtgagtggcccaggcctgtgccagtctaccggccctggcttgtggggagaggtctagggtgcagatctcagctcaggcttcatcccaataagtagtaagatgcaagagctaaactctgagactgtgggttcaaatcccagctccatccctgactggctgtgtgaccttggacaaattacttagcttctctcgacctcagttttctcgtatgtataataagaaacgtttgtgctgttatttacccccattttacagacaaggagactgaggccaaagaggttaagtgtcttgatcaaaatctcccagttcctgagtgacagagctgggatttgaacccatgtagccaggctctagaatctgcactcctgctttgccctgctactcctcatgccaacatgccagccttattccactgttcccaaagttctagctcctctagatggctgctgctgcctcccctcagtccccccatatgtctctctctctctctctctctctctctctctctctctctctctctctctctttctctctctctcacacacacacacacacaaatacacaccacactacacacaacccttagcagcaaccccacatgtcctgtcctccttgcagccaggcctttgcacaggccgtccctccacccagaatgctttgcccactctcacctccctggcccattctcaactcaccacacttccaacattatctccagcactctggccaggctcaagtggtgagttcaggcctgacatgcagtaggtgctgaggggcatgtgttaagggaacgaggggtgtgagagggagactgaggtagagaggggaggggagctggggctcagaggagagaactcccagagggtctgggccctccccattcagagcattgagccagaccaggcctgtcgtggtcacctgcatggaatcttctccctacttaggcactgccaggcggaccatcttctggatgagaagggcagggcacaatgtctcctccagagagagatggtacagtctctggagcagcaggtaatgccagggcggtggagggtaagggatagggatagtgcgcaaaaccttctgtccaccatgtgccagaaaccaagttcacctgggacgagggctggtataaaggaaggaagaggagcgggcactcccagggaagaccgtagcctgggcaaagatgtggcagagaagggccaggctgaggcctcatgtttgtgccatttcacagctggtgctggagaaggagaagctgagtgccatgcaggcccacctggctgggaaaatggcactgaccaaggcttcatctgtggtgagcgaccccaggactggtggtggcagactcagactgctggggggcagggaggaggtctgcacggtgcagggaacctaacctcacattcaggtcctgagagctaggggcccctgtccccagctccaaacatgcccagacctggaaatctgtccccttctacttacaaaccctctgaccccggctgggcgtggtggctcacgcctgtaatcccagcactttgggaggccgaggcgggtggatcacgaggtcaggagttcaagaccagcctcgccaagatggtgaaaccctgtgtctactaaaagtacaaaaaattagccaggcgtggtggcaggtgtctgtagtcccaactacttgggaggctgaggcagagaattgcttgaacctgggaggcggagtttgcagtgagctgagatcataccactgcactccagcctaggcgacagatcaagactccgtctcaagaaaaaaaaaaaaaaaaaaccctctgactctaagatccccaaacactgtgatcctgagttgttaaagcaaatgcaaatagccagacttgccagatgcaggctgtgtgccagcaggaccagctatgtaacctgcagggccccttgttcagatttcaagatggcgaccacagagcattaaacaaagcacagggtgccacataaccacataggtcacacgcccatgaagccagccctggaggccaggcactgtttctgagcgctttgctggtggtaatttatttctcatgatgcgaatgtacagatgaggaatattgaggccaggggggtttaggtgactttcccaaggtcacagttgggtggtaaagagccctattcaaccccagttcatggtcccagcatcagtggccacatacgacatccgcacctgtgctctaataaatacggctcatgctgttttgtgggattccacctcagactggaatttagaagagggcgtccttgctttgaaaaacactgatttaaaaataaagtggagccaggcgcagtggctcatgcctgtaatcccagcactttgggaggctgaagcgggtggatcacatgaggtcaggagttcgagaccagcctggctaacatggtgaaaccccatctctaccaaaaatacaaaaattagctgggcgtagtgacgggcacctgtagtcccagctactcgggaggctgaggcagaagacttgcttgaatctgggaggtgggggttgcagtgagccgagattgcaccactgcactccagcctgggcgacagagcaagactcagtatcaaaaaaaataaaaaacataaaatagaaagtaaaaagtgggaagtttaagcctctgggtcaccagcctctccccctcacccaggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccaggtaagaatggtccttgcactacacggtgcccccaagctcctaatcctgacaggctctgggtggagggtgcaaaggagctccatgctgccccttcccaccaccaccaccactgcagctgccgccactcagcctttgggaaaatgcatccgctcacaaaagcttcctttcgggatgtccgtggcctgaaagccccccatatggtctcgagtgtcgggcccctagccctgactcccttggggattggggccatgcctcacccactctggactccagctactatattcggccatcagaagggagggaccctgctaagtaattccaggagcacctcctttcctcccctgaccaaggaaaatcggggtggattcgcccgagctcacctatccactgctctccaccaggcctggcctgtgggcttagcagggatcagagaccttgactgtcatcctggctctgccatttaacctcttgcatcctttggtgtgcaagttactccgcttcttttcaacctcggggagaactattttggcagaagtggtgcaaagaataaatgatacaacttatgtcaggtgctcagcaaacagtacctgtgcccgtggacacgggtgttgacggtgagatctcaggcctgtagactcaccttgtagggggaggggacagggagctagctaggaggtcctgcatggggcttgattcatccccaccctctgacagagttcctccacaacatggactacttcaagttccacaacatgcgaccccctttcacctacgccacgctcatccgctgggtaagcagggcagctcggccccaaggaggaggaagacaaagatggggtgggggacctgcctcccaaactcctgtctccctctgagtgccctcagagtgggttcctccattcccaagccccagccccaaggatccccaagccgtgcctcaaatgtgacccctcatgctggcttcaccccaaacctgtccgcaaatccaaacctaaaccaccatccaggccagagcatgccaaattctgaccctaaacctacccctttccagatgtccacctcagccccatacctaaccctctcctggacccataaaatagcctaaagctaaccccatctctgcaccttgccctaaacgtaccccagctcttactctaactccttccccagcctttatgccaacccaaccccatctccttccctggccccaacgtaccccagtatgtcaatacacccccaactgggcaccattcccaacctttccttgtaacacccatttgatccttaacttcatcaccccatcccaactccttcatctcagcctccccaatgccttctcagaaccttcatcctagcgccacacctaaccccaaacctgaacctcacccctacatgataccagatattccccgactgtctctgaactgaaaccctgacctagccccatcctgactgatagcctcactgcaatcatcatcgctgactctgtaatcccattcctgaatccaaactgatcaaattccctgaccctcagcctcactccacaccgaaccccacaactaacctcatccttgccctgagcctaaccacctaaccatgtccctgacacgtaagatactcgataattcaaaccatctctggcttctgacctaaagccaagtcatcccatccctcacccctagaccccccacctgagtccaccccagcctgactcttaacccaccccttccctgacccttaagttggcctggccctttaccccttccaaatccttgaccccacttctgacccttcaccttccccaaccctgaaatgtcacctccacagagaaccccaactccaactccatcccagacctttcacctcacttcagccctagccctgaacaagaccccactcccaacctcagtcctgatcccttacctaatcccagaacaaccatacccacacccatctaaccctgcccaacccgacacttcaccccttttctaaccccatctttgaccccatgcttcaccccacatctagtcctgtccctgattacctgcccctacaattccgcccccatgtcagatggctcggggtaggtcatagcccctctaaaccccaagtttggggaatgtgccccttaccccaccccccaacttccaggccatcctggaggctccagagaagcagcggacactcaatgagatctaccactggttcacacgcatgtttgccttcttcagaaaccatcctgccacctggaaggtgagctcctctgaggtggcggtgactgggatggcctcaagtgccatcgcagctcaaagtgggcaggcctgggtctgggctcataggcacattggggaggaacgggatgtgggttgttggtggtggctgctggcctcagaggttgacgcccacctgctccctgtccccggccttccacagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcactcaacacaaaccccaaaacacagagagcctgcctcagtacactcaaacaacctcaaagctgcatcatcacacaatcacacacaagcacagccctgacaacccacacaccccaaggcacgcacccacagccagcctcagggcccacaggggcactgtcaacacaggggtgtgcccagaggcctacacagaagcagcgtcagtaccctcaggatctgaggtcccaacacgtgctcgctcacacacacggcctgttagaattcacctgtgtatctcacgcatatgcacacgcacagccccccagtgggtctcttgagtcccgtgcagacacacacagccacacacactgccttgccaaaaataccccgtgtctcccctgccactcacctcactcccattccctgagccctgatccatgcctcagcttagactgcagaggaactactcatttatttgggatccaaggcccccaacccacagtaccgtccccaataaactgcagccgagctccccaca

SEQ ID NO: 112 - DNA, 23620 bp, Homo sapiens
gggaagccagacggttaacacagacaaagtgctgccgtgacactcggccctccagtgttgcggagaggcaagagcagcgaccgcggcacctgtccgcccggagctgggacgcgggcgcccgggcggccggacgaagcgaggagggaccgccgaggtgcgcgtctgtgcggctcagcctggcgggggacgcggggagaatgtggactgggtagagatgaacgagacttttctcagatgttggatatttgcttggaaaaacgtgtgggtacgaccttggtaaggaacttgaattttttttttttaattctgaaattgatctgaaaactttattttcttttcctttattgttattattattaattttttttggctaatgtcgcagtagaaacatgcttctgctttagtgcacttagtgctgtcaaacatttgtgagactttccttatgaatcattaaccctttcagttctagacataattgccaattcattgaaatttcagtagtggttccagctcacactcgtcaaactattccgggttggctgaagttttctattttattttatttttaacatgtgtttggcgtcatgactctacatgttggaactaaataaaaataagcaggtttgcttaaatcataactgagggaaaaacaactttgcatccaacttttttttttttaagagcatcctatttagagaagtggaagaatgtaaaaacctccttgaaggacttccacagaatgttatgtttacatttgaacaaacacacattcttacatggaaatgatacccatattcctcatttttatcaaacatgtctatatgagaaaacccttacagaagttgtttacctttttttgcctttggaaaacagtttttttctgagtgtgagggaggattttgggggaatatcctcatcaatgtacaagtggaagcagagcttgtcctccaagtcttctaaatttgttataactttagttacagtaaactgtagtacatcagtgacttctgggaattcatacactttcagatttaaatggaaagtgctatttgtagctgaggactcctaaaggaattctctccagggaattttattaaacggttttatgttttgtttttgccttttcaatttggtatgagatgcttgcaagtcagaagacactgcaggctgttttccccttcacccatttttcctcctcttttcctgtggtccaagtgatttctaagaggccgtagctcagtgatgctggcaggatgcaacccttttcagtcttccatgtgagaggatgaaagagagctcgcagcagagggaggaggcagttgttttgaaagttgttttgcgttgggagctggtgggaaagttcggtcttccccatttggaaaaggcaggctgggttccgctcctgcaccacacgcgctttccatttttagcttcattcagaggcagacagagctccttcctcttcctctccttgtttgtgacacttttctgaggcagcttttccacagtgccgagggtctggcggccatgaccccaggcattctgggacactggactgtgtgcccagaacatttttctgccatgagaggtaaagccagggattgttcagaggtgattctttttttttttttccttttccccacagtgaggttgccacattcttttttttttttttttttttaactaagagtagcatttaaaaaccttgcttcttttcaaggcagtttactttatacggcttcttggctctttctcaactgtaccaagcactctgcatctgcttttaaagtcttcagactactgtattagtcatagcctctcagaaggagccacaggaacggcgggacaatggggattaaaggcctttcctttctcttccaggctgcccccaagtgtaactccagcactgtgaggtttcagggattggcagaggggaccaaggggaccatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggtaagcctctggtttattgacaagaagattggggacctggtgccaaatctccctacttgcccttgaggccttgtatatctctgaaaacctctgagaatctgtaagtatcagtaaataattgattgctctattcaattcttgcattgctttctctttccctaaaccatttccttctcatttcttccagccttcaactgttcctcactaattagtaaacagttaaatattttggcaaattggcatgtcttagaaaagcaacttgcagcatagggtgggtgaaattgtcagtgaacttcaagaaagctctgggcccactggccctagtgtccctgttgtacaatatctcttaagggagaaaactttttcttggaaaaaaaagttttaatatttcttttgtctgtctttggtaattagttggctttactctttttaacaagccagctttattagctgggtttctaaaactatcctcaaaactttgacgtgtttatgaagtgaagtgatggtataagccgagaaagggggtcatgtaaaagtgtcctctgtctggatgacttcagagctaaccactgtttatctgcagcagctcctttgctggggctgggctggcaggccaattccttactggcctctgaagtgggtacactctttgttgtttcaaaggggatgaaaacccaaacttggaatgagcaactgatttgtgtttacctttaatataaagattatagctaggcgtgatgtttagctgtgaaataacttgcagaaccacctcttgttttcagaatttggcttactgtagttgcacttactagtctactactgggttgagttgaatgaaaggacccctcagcagacttcccataccaccattagcacagagcactgtcaattctattacttccttcagaaagtagggaaaggggatggttggccgtagaaatccagaatttgctactgggactattccttacagccgtgtcaaatcactttcccccttccctaaggaacagtatttgaaggaatccgggagactaggaaatgctttgtctctttcctgtttgtgtgtctgagtccagtgtttttggtgagggggagacacagctgtctaaaattaaatagaacaacgatgctcagtctttcttttttcccccactgctgcgtgaatggaggcagattttataaaaaataaaatttaaattctagttgtagttgaatgttaccaaaaaatttaaccccagaggtcagccttaattatacctcttcctgaaagtaatgctcttcttatagaaagtctctcaatatgtggcccttggaatgaatgtaggatttgtttgggtatatgaggtttgactatggctttaaaaagtgtagtgtgttttttccccatatcaagtttgaccaaatattcgtctgttcccaagcttcgtttgtgctgtgttgccctgtccagtcctttgggactgaagtaaaaatctccattctgtgggtcatctttgccttttaattctataatgttcttatcgtcagttcagctcttagcttaagtttttcaatttccgtcattctcctttaaaatcatagctaagtcaagtaatgctcttagatcatttagttcaaggttcagaaagacagtcacttacccaaaggcatataggtaaagccagaccggggacttgaagcaaagcttttctgacttctccaatgagtgcttctcgattatgctacactggcccctcttggtgtcactgtggttttagttatcatcttaatatatttcagaccaatccttaagctattttgtgtttttttccctctgaatgtataacttcctatttcaatatattaagcaaccaaaaaacagacaatgcctgtgttcctgaagaaggtccttcgaaactaacctaagaggtgagggttctcttatcctatttccctatcttgcatttaactgaagcgcttgaatagaggatagtatgtctttaaaccctaatcataaagtcaagcaaggagtaaacttgaatgtaatactgtcttaagcttactctggaatttgtacctgtttttctgtttctctcctttgtttttgaactttgggaaaggacagcttcctttagaaggtgaaagaggatggtggagttgagccattaagggtaggatagctgcaaactagttccgggacagcaacattaaggattgatgaaatgtttacattatctttattcagttagttctttaagttccatgagccattgaaataggaagagtctttctacatgtactttttatctgacttattaatcttgcccttctttaaatgttttcgtttaaatagcaaaagatgttacaatatgtactattgtgctgacataccggggaattttttttttacaagaccatttttcattatgaatttgtaccatgtgtcagcaccttttttttttttttggttaaaacaaaacatacaaatcatatttctgatcttgaccctcatttttagattgggtttagaatcattctgcacctttaatgaaaaactgttcttacttcctatttccagaactgaaatcaaatatagacctactattcaaaactttgaaaatgttttaaactgatgggttattcttttatgggggttttccccttgtcctcctgaaataatctcttatgactacttgactacagaaaaatcagttcaagcatttatattttagaagcgttaccctgtagagtttctgccgtcggttgagactgcttgcactcaagaggcactgtggctctgtgagtctcacctccctgtatcgtggctgataaacatcagacagattgtgaggactcctttggtgtccattctgatcgaaatccattattaactcaagccatctgtaaaaagtatctcaccataacatgcaattctctcttcatgttgccttttatttgagaaatgatgtaccaaggcatcaccatgtctcctttaatagaaagataatgaagaaggaaaccttctccaaacaactttgttcacttcactccttttaaaaatggggtgattgccgggcgcggtggctcacgcctgtaatcccagcactttgggaggctgaggacagcagatcacctgaggtcaggagttcaagaccagcctagccaacatggtgaaaccccatctctactaaaaatacaaaaattagccgggcgtggtggtgggcgcctgtaatcccagctacctgagaggctgaggtaggagaatcgcttgaacctgggaggtggagtgagccgagatcgtgccattgcactccagcccaggcaacgagagtgaaactctgtttcaaaataaataagtaaataaatgccattgcactccagcccaggcaacaagagcaaaaccctgtttctaaataaataaaataaaataaaaatgaggtgattgcaggctgaaggtcttggtcactactgagttctagttctctcaagacaaatattcatatggtcaaaacagaattataatctaacgagtcattcttatagagtgggattcggggagggaaaacagatagctagtaatttaaatgatcttaatgtaatttggggagaggatgatcagatgacatttagacttggatatagtttctgcttcaaacccacgctgtgtgtgtctgtttgcatactctctaaagaaggaatttgaaaaaaaaaaaaaaaaacaaacctatattgtccttgttatcagccttccattaagcgctccaactcaacccatcctaagctgtcaaatctccttcattgtgtaaaattgaaaagaagccctgtgttttgtccggaagctgtggaaactgtggacggcggggtgtgttctgtaactgaggccacagacagaaacaaatctgctcaagtggtggaggggtctgcaccgcacataaagagcttctgtgggagcaggtgaagcaaggaggtattgaagccgggtgtcctcttgctgttgagtttatagaaggcacagagcggcctgtccccagcagtaattctttaggaccctggtcagttccagtgaagtttccttcttgagttaggtgaacacattctttgtctttttagcactgtgaagtttaagctacacaccaagttcctccttagtatttgcttggttcaaagataaactgttacaaactatgggtcagggagatgggtagtctaagatgcacattctggatctttctaggaccagagggagacttagtacttggttttttcacttccctttaaaaacaatcctggttcctgttccccctccaaagttacctggacaagcaccatagtcttagagtttcagcttttatggcgtctgtgtctcagacgtgcatttgagatgaagatgtttactgtatattagaacgctagacttagaatggatataggtggtttgtaagtgccttccagttttgaaattttatgattttgtatctttatctataggtgtgagtttatatgtgccctatagcactgtatgtaattgaaatttaaaatattagggcgctctgtccctttcctaatgataagctaatattgaagctctttaatttgtctggggtttgaggattatcatagacctctcttctaccacagagccttctctttttaattgttctcctgtcttgcctgttgaattgaatttgtaaggttagagatggcaagagctacttccggtgctgctttatagcttactagtgatgagtctatagttgtgctcaaataggtattgggtagcttatgctttctagttgacttctttttgggcacaagaaaatgtgtgtaagatggataactgaaaacctagaggcccattctgtaaaagaatggcaatttggaagaagaaccacgacctcagtgcagtgctccgttttggtaatcaagctctgactcccaagacaccatctgtaagagactataatttaaaacaaagttgatgaaccagttgagtgcctttcttaaaattactgttgtaaagtagatatgttgaaaatatcaactgctaattattggctcaccaacaaatggcatgatttgtttttcctgtttgtcattctaatattatggaataatcactgaaatatgaatgttaaatgatttgcatgtcatagaattcaattccattaattttccaaattaattagattcaataataatatgtccaaaacaatgagcctctgaataagtctactaaagctttaaatatatatatttatatctcaagactgctctgagatactcttgtccccagtagttttactgccaacaaataccaataatgacaaacggtgattaaaagggcagatagatgtaaatgaaggcagaggaggaggatgaaatgaacatctgcttttttcagctctctgacagaaattcttaaaggaccaaaaataacactcttgtttcaacttatgttaggtgtaggaaaattttctttttttctctttccagtctgagtatgcttcattgatttgtatattgaatactaaattgttttagaaaaaaaaatcattggctgataagacacttaaatgagaaaagctagtctgtcacaggcatgtaggtgtgccatatctatttaaatagaggtttaaattattgatgagacttaatgaggaactggtgtatattgtaaccaaaattgtagattccactgtgaacaatctgtgcatggatcgattcacatatttgagtctaccatttcaggtacatgaatgtacaggagctactgggaatataaaaactggaaaataaacattatcatctattaccactccctcctccttggtccattttagtaaagaattcagtaaagtgataggtaggctatcttgaatgagaagaaaataaaactaggaaagtgagagaataaaaaccaaaacaaaactgtaactgcaaactgttgtaaaggactactcacagaggagttctattgaatagtgacgaattgcttcctgattcacggttggtgatttttttaccccttcaaagagaaatttattattaaggaggaactggtatagttaacatgtttctttagcaaggccccacaaagttaaaatgtgtgatgcatccagtctgaggtcatttcctcagatcttagaacctacagctttcctccgtataaacttaatttcaaaggagggcttttggccaggcatggtggctcagcctgtaatctcagcactttgggaggccgaggtgggaggatcgcttgagtccaggagtttgagacaaggctgggcaacatggtgagaccccttctcaacaataacaacaaaaattagctgggcgtgatggtgcatgcctgtagtcccagctactcaggaggctgaggtgggaggatctcttgatcccaggaggtcaaggctgcaatgagctaagatcaagccactgcattccagcctgagtgatagtgggagaccttgtctttaaaacacacacacacacacacacacacacgagggcctttgaccactcttgagtagaagactcgagaagaacaaagtagaaggccagagaagaacaaagttacttgaaagatctcttattaaagagaatgtacaagctatgaaaaaaaaaaaacacacacacacacacaaacctcatctggaatgaaaaaaacataatgcatttggtttctggttccttaggctgttatggaacaaccaaagaacattattttggtttctgaggtcagaactattttattcccctcaagcacactatgcttatggtttgagggagaatgagaaataggaaactaggaacaggctgaaatggtctaatcttgaccatctaattctgcagtgtcttattctcattctaaaagagaatggttatattcgctgttctagcataaaaagtaatgataaaaataaaagatcccgtattaccagacaataatcccctagactgttttaatgcttggttgagtatttgcttatgatctcagactttaaaagatggtctccccctatggtgaagcttgttaattatgtaggcatcattaatgtctgtttacttatcaaaattttatcattgttagttgtattactacttgacagtccaatttatttaattgaaaagattggttaacattttatagtcaaagtaattgtttcctgtgttttttcctgtttaggttattggagtgatgagtaaagaatacataccaaagggcacacgttttggacccctaataggtgaaatctacaccaatgacacagttcctaagaacgccaacaggaaatatttttggagggtaagtaagggaaatttcttcagacccattaaatgttaggaaaaaatggagctaaaagagctgggtggctcacctttctcatcctgtgctgagaaatgctggggctcacccataagtatccagcatccccatggacacagggaattctgaacaaatgtgatgaaaccgatgaaatgtctggcctgtaggtggttagtgatggagatacgggctatatgtgaatcttgatttttgcaattcattagagctttgtaatgaaaggaaacagtttgttgcttgctttaaggataggttcatttgcatttctccgcaaggaagtagtaatgagttaccaagccttagatttcacccctttttgatttcttgctgacttaactttaattgaatggaagagttatcacaaatgaattatctttttggtttttttttttttgagatggagtctcactctgtcaccaggctggagtgcaatggcatgatctcggctcactgcaacctccgcctcccaggttcaagcaattgtcctgcctcagcctcccgagtagctgggactaaggtgcgcgccaccatgcccagttaatttttgtatttttagtagagacggggttccactatgttggccatgatggtctcgatctctggacctcgtgatccgcccaccttggcctcccaaagtgctggaattacaggcaagagccaccgcgcccagccaggaatgacaaatgaattaccttataagtaaatgccattaaggaaggatagctggaagatgggttgaggggaatggaggaccacagaactagtcctatttaaatacatgtgcatggtaaaatgattccatttgacaataggttaattatctcatagcataaggaaaatgcttaacagtcatatgcaagatgataagctttcctatagcatccaaccaaaagatctagccagtacaatttcctttgctatattagggttagaaaggcccccagaggtgaaccaattagatggaatccttgaataaaacactggattagcagtgaacagaaaaaagtcagattgctttccttcttcccatagatgtctcagggatatttagtttcctcagaagataaagaatttagtaagcgtttttttgtgcatacttacatgaaatgtacattatttgaattctttaaaaagaaacagctgcatgataacaaaaattgtgttatgcttgctttagctggtatttttgcctagaacgattatatcgttcggacaagaagctattcctaagaaacaatatttttaatccaggaagtttttcatttttagaaatttatcttactatttcccaagcaaaagagggtagttacagattcactaagaatcatgtgctcacaatttttatttaataattattcctccttaaaatatattaatcacctgacttacaatggtggaaccatgagtgcatttttgcctttattgtcaataacgtcttctcagaagtgagccacaaaggtgcatagttcttggagttaaaggtctgaattaagacaatccagcataagtctcattaatgtgtgattattttgagaaaaggcaagaagtacctaagaatctccccctcactgtccagttccctgtttcatttaaagattcactgtaagtaactgaaaggctttccttgggaggatttatttgaatcagtctttcacatgcaaaggatattgtagaacatctcgtttttgctggcaggaatatgaacatctgttgtgaggaaagaaaaagtttcatgcaaattacactgccaaagaagggatgttcaagttgagaaaccagtgacatttcttgtaactgtactatgaatcagcgcattttaatcttctagataatatatggaagtgcaggaaggtggtaggaaacggtgttcattttacatatgcgttattttattctgtgtgagtgacttcatggcaccgacattgctgtttttaaatgaggatacagtaaattgcagtccgaggaaggctaactggaatcaacatacccgtagctttagaaagcagtttccgcaccagcgaagagtacaagagcgatggaaccccatgttcctggaagtttgcacatcagagtaaacaaacttgaaaacccctcttgatagcagaattcacccagccttgttccattttctcttaacaaaacacaccgcaaaagctctcacaagctgctttgatgaagccacatgtatttcccccttcacaatttacaggaagttactcttaaaagaaagtgattctggtgtttaccgcctgtgttaaagggacagagttcctttttatttctgataacgtttgagcgaaatacagaaactatctgtagactagcatagtcggtacgtgagtaaggaaaagcaataacctgctgtccggtgagcacaaaattcctgctacgaacagtgccttactgctgcttggagactgcaagtcgcagatcacactaggtattgactgattgtataaggaaatttcttaaagtctaaagtaaaggtggtacctcctaaaaagaggggaagagagaaaactttgtgtggaaggataaggagtgtgtttatagtttcagtaagagtgtacgttttaatttttcttcttcctctgcctctttgccaagtagcctgagtgcatctgttatccagaagtagtattactctaggacaaacttcaaattcttcattctgcgttgcctttaaggaacaacatactttcttcctgttctttttccaaaaacacacgcctatggctctgtgtgtggtgttttagccagcctcctcccagataaggggttcccttccctcctttgcattgaaaggaaagtgcaagtctggacatgtttatcaagaggaaaagtgacttctcagtaatagactgtcaaattcgggctgctgcccgagtgttcgctttgttatggcaggtgaagttcacctttgccccacccagtgtttccacaaaaaggcaaggttccaagtattcatatgaacaagtgttactttaggacttggagggttgggggtggaggatgtttgcatagttgaagccttgggcgggggtgtaggaaacggcgagtacagaggccatagaaaaagctaagactcagtttgacgtcgtcagccggcttggtcttctacccagtgactcaaagcactaaaagtcagcataatcggaactgaagtcagtagcatcgcccatttgccattcactgcagtagcaaaagtagtactctgtggtgggttaatcggtttgaggcagctccttaaatgaacatttgtgtttcatttttctgttattttcccgaacatgaaaagacgataaaactgaaatggaaaaggtaactgacaaaagtgtgccttacctgtttccgccctgatttctgctgattcaagactattctggctaaactgattggattctttttctaactaggcagtaggggatcagaaatcacacacggtaccggctgtgtttattctgagaggtgctggggagctttgggtctgacttccttttacatgcctgtcttctcttttggacagatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcagtaagtggattacagaacaaaaaaataaaaaatgccagtaatgtcggttctgcccctttgaactaataacatgttgtttaattatacggctttgtcatgtgttggatgaagtaggtggcttaagctagggactaggaagaggaaaaacattttttgagtccctattaactattaggaaacttgatcatttaaaagtatatatatatatgaggagctaccttgagttttgaattcaggatgttacaggaagaaatatatgtccaattctaatttatccaaaagcagttgggagaattacagggattggtccagacatgctgcgtatgcaaggtatagccctcatctgtggtactttggcagggcttagactgcatcaaaatatttatagatgtacatttgagtgtacagttaggatctgatgtggaacattgtaagatcattgctagaaaaactttgtcataatttttcaatattattctaagtgaataaccgtaaagattttacatcttagcttccttccttacagtaaaaaaactatctgatctcttgatcagtattatagtagccacctatcactttatcttaacaaattctcaattccttaggtttatgtgcttttacttcttttatttgattaaaattgctgtcatgacctctctctgcagagggctgcatcattttggtcattctcaagtgatctctttgagcaatttaagaattgccataagattctaacctctgctgtaactatggttgtgtgttcttggttagaccactaaatcttattagcagttttaaaaattattccttttggtttagaagttaagactaaatgctgaagtttttgtaacttttggttttgatatcatttcaaacttaagaaaacatttgaagaaaaggacaaagaatttccacttaccctttacccaggtttaccagttattgataagtatatccatttgctttaccagaaggctaacttgttttagttctcattttcacctttgagacatttggaataaatatcaatgttaacataaattggaattttgactttgattttaggaccaatgaacaagccaagtacttaccctagtcatatataatccaactgtatggttatttggtattcattccacacttcattttacttgatctcccttaagattgcaagattgtgtttgcagtttttctgaaaatctggggctataaaagcatcaggacctcccccgtaggggaggtcgtgtgtttggggtccttacacaacaggttacccttgagcttcaggaaaagaactggctctcagttccccagttccagcttaatgggtctaattaggtcctgaccaaaaaggtggcagttcttttccctcatgtctcttcagcgctccccgagactctggagactctgtcatatccctagggctgagcctcccaggaaccattcggctgttgtggcatctgtgtatgccatgcccagtgctgaggacctagtaacaaacgacaaatgcacaggcacagtggcatttttgtggaactcgtattccagctgtgcgtctcagaagaagcgcacagctccctcctggctttcttaacatagtgagccacttccacttaagggtctccttacattccttgagtttaatcattcatggattcagaggaaagtcttttgatttttgcttttctttaaacagttcatttgaggtgacctaccccagtgactttgcaccaaccaccaagaaacttttttgcatgcttcccgcaccctgtgccaatcaagggaagggtttaaaggcctggcgtttttattcctcaaagaaaggttttgcacagtattttaaggttcaagtgcttctactttgtgttcagaagcaactgtcatatatactgtgaaatgacaccttttatttatccctttttatttatgcagtatgtccccttttattttggcagaattttttctaaatggtggtttaacattttcaagcacatttcattgtccaatattcatagtaaagaatgagagttaacaataaccagtcacattaaaacaagattcctgctgccagttgtgaaaccggttgtcttaggcgtggcagctgatgattgagactgtgatcaggaaaatttccactatttcatcaggcctaataggtagattgtgtctccaaatgaactgtgttgggtttccatgcttaaagcacaatagaggtggtgcaagaatctccatgagggcttaaatggcagtgatggttcaggcggtagagtttggagaagaagggatttgaaacaaaccaaaggaaagaaaagtaagtagccagaaatcacaaaatggcatttttctaaaaacaaaggaaaaggaataaaagaactaataagtttgaaacccctacccctcccaaatttggcagggggggaggtattttttttctatctatctaactaacccatctagaaaacagttgaccaaattatagacttctaaatgttaatctgctttctcagtttcagttgaaaagagactttgttttgcctactgcagaacttctaggttctttcttatagtcttggggttcttattatagatcgaaaatgtgagtcggcataattaagccattcggagtcttcagaagcagttcactcttgaaatgactccgtccgcctacagccatttaagatttcagaacaaaaacagatcttgattttctttttcatgttaactcaagctgttgctgagtgggagagtcagaaatgacaccagctccactgattactcagctgctgaaggatgattttttaaaatgcacctttactgtatatggacttcctaatttccacctgtagagcatcttagggaggctaacatgtcactctggatgttcttttagaataagatgcaaatctatttttctgaaggcattagagatagcaaacatttattgtgagtttactatatactaggcactgtgctaagtgttttgcatagaaagtttaaaattctggcttttttgttggcccaatcataagtttcatatcagttcaacattcaaattatattaaggtacttaagaagaatccctggctaaatgtgaggggcagtgccacagatggactgaaactttatgcttattgcacatttatgctattattatttgttgaattatagaaccaagggagtgtggaagccactggaaaaaatatgagacttagatacataatttgagtaaaaatggctcaaagtcatgagggtaaagttttttgtatttccattttattcgagcggcatcgtttttaaaaatcattatgaatttgaccctatatagatgtttccaaataattctttttcaccttcataaaattccttcctgtggctgtgagatgccttgcctatcagttttcaagcttagttgtctttctcatcctttaccattttagctttaaaaaacaaaagtgacaattagaacttcctgcctgctgggcctcactgaaagaccgatattggcctgataaggagatatttattttgttttagtggcttcagaaatccctctccctcagcaagctttccatcacggcccccccgtcagcatcttccctgatagcgttcttctctgtgtttattctggggcttcaggctcgcccaggaggaactgataaccgctggcaggagataacattctctaaggggctctcaaattggaatcgaatccctcaagccagtcagcctagagaatacatttaaagggttcagttctggagtttcacagagttcatttctagacctatcagatagcaagtgtggagttctttctcaactaaattcaagcagagacattttttagacgatgaaggatatttgcacaaaggcttcagcatgatcccccaaacctgctgcctctgaaggcatctccacacattgacagccaatgccttcagtgcgttcctagggcaggtgtcctggcttgagtgactgtcctccaataatcagagctcaaactaaacatcgtatgttttacttttggtttccaggcaaggctgagcagggaattttcagttttccctgcccagatgggtgttttttcctgaaggcatcatttattgtgtagcgaggagacagggctggctgtggcagggatagtctagaactgtcctcattgctgctgttcctaaatagtatctttaccaagtaataacgtgccgtctttgggaataagtgctttcctcttagcctgttctgttttcttgggtgcgctaagtaattgaactggctcaggaagtacctattgtggtttggcagaggtgactgtcacgccttgtgactccaggggccagcactgctgggatcctggctagaccagacagagccttggtgaagtgcttaggctgtctgcacatcgcgaggaaggtggtattcacttcgctaagctccttggcataggcagtttgaacagggctttatcaaattcgtattcaacaagagtagaagcgaaaattgatgactgtgtattacttgaaatgagtcttaatctttcacatttagttctcagggtatgctgatttcctttaggtaaaccatgaacatcagaaagacttttattaacctatgacagggtccccaccccagtatttttccactccattaaaatggaagttttttttttttttttcttttttgagacagagttttgctcttgttgcccagtctggagtgcaatggcacaatctcggctcaccacaacctccacctcccagattcaagcgattcttctgcctcagcctcccaagtagctgggattacaggtgtgcgccaccacgcccagctaattttgtatttttagtagagatggggtttctccatgttggtcaggctggtctcgaacttccgacctcaggtgatccgcccacctcggcctcccaaagtgctgggattacaggcaagagccactgcatccagcttaggctatcttactccagcctaaacagcaattttctatcataaggtctgtactaatgaaaacagaatcacccaaggctgctgtttgttctgtctgtgctgccattgtccgcattttgctgaggaggaaacggaactgcacttttgagtgagtggcccagagccttctagaatgagagtgcgttggaagccagatatgtggcgattgtgtcgccagctgttactcaggttttctcaagaaggaggagcaactttggcagttttgcttcagttctctctagccctctgtgtaatcgcccctttttctttatttcagcacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtaggccttgagagagagcagtccaaggggctgtgagtgcatgcttgtgtttgtatttagcttgctttccatggggtatcgattgcatttgcagtagtatgagcccccggttggggatagtgggtatggattccgcctggcttttgccacttctagctctttgactttggacaagtgacttcccttctcctgattttcttctgaataataaaaaaattaggggtttggactagaagattaggtgaaactccctgctagcctgtgatttttgtgcttttaagaaaaacaccattctgaaaacatgaagatttcttctttttaagactgtcttgatgcttttcttaagatatttgcatcaacacttgagtcttggagcagaaatgttaggtctcagagccagcttgagagcagagctaacacatgtggcttcttcccaggtccacctgagagtgcacagtggagaacggcctttcaaatgtcagacttgcaacaagggctttactcagctcgcccacctgcagaaacactacctggtacacacgggagaaaagccacatgaatgccaggtgcgcagtattttctgggtagaccttctgacctttgtagaaaatgtctgtgagtcaccctcccatgtcctatatagcccgtagttaaagccaacaccagattctgcgttgtcccatcctggactgatggcactatggtccttcccagtactttgtatctgctgatgacttgagatggcacagccagcttccagtgggtgggaaaatggtaggggaaataaacagcccctcgtgtgctgtgtgcccacatccccccgtttgcttaataccacactggaggtgccacaaggaggcttctcacctcctaggttgctgggcgttggccggtaagcctgcccctcccgttggcaactcttaatcttctggccttcctgtctcccttccctgctgtctctctcccctacactgtaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttgcatccattgtattatcagaaaatgtgaagaagaaaaaaatgccatgttttaaaaccactgcgaaaatttccccaaagcataggtggctttgtgtgtgtgcgatttgggggcttgagtctgggtggtgttttgttgttggtttttgttgctttttttttttttttttttttaatgtcaaaattgcacaaacatggtgctctaccaggaaggattcgaggtagataggctcaggccacactttaaaaacaaacacacaaacaacaaaaaacgggtattctagtcatcttggggtaaaagcgggtaatgaacattcctatccccaacacatcaattgtattttttctgtaaaactcagattttcctcagtatttgtgtttttacattttatggttaatttaatggaagatgaaagggcattgcaaagttgttcaacaacagttacctcattgagtgtgtccagtagtgcaggaaatgatgtcttatctaatgatttgcttctctagaggagaaaccgagtaaatgtgctccagcaagatagactttgtgttattctatcttttattctgctaagcccaaagattacatgttggtgttcaaagtgtagcaaaaaatgatgtatatttataaatctatttataccactatatcatatgtatatatatttataaccacttaaattgtgagccaagccatgtaaaagatctactttttctaagggcaaaaaaaaaaaaaaaaaaaaaagaacactcctttctgagactttgcttaatacttggtgacctcacaatcacgtcggtatgattgggcacccttgcctactgtaagagaccctaaaaccttggtgcagtggtggggaccacaaaacaaccagggaggaagagatacatcattttttagtattaaggaccatctaagacagctctattttttttttgccactttatgattatgtggtcacacccaagtcacagaaataaaaaactgactttaccgctgcaatttttctgttttcctccttactaaatactgatacattactccaatctattttataattatatttgacattttgttcacatcaactaatgttcacctgtagaagagaacaaatttcgaataatccagggaaacccaagagccttactggtcttctgtaacttccaagactgacagctttttatgtatcagtgtttgataaacacagtccttaactgaaggtaaaccaaagcatcacgttgacattagaccaaatacttttgattcccaactactcgtttgttctttttctccttttgtgctttcccatagtgagaatttttataaagacttcttgcttctctcaccatccatccttctcttttctgcctcttacatgtgaatgttgagcccacaatcaacagtggttttattttttcctctactcaaagttaaaactgaccaaagttactggctttttactttgctagaacaacaaactatcttatgtttacatactggtttacaatgttatttatgtgcaaattgtcaaaatgtaaattaaatataaatgttcatgctttaccaaaat

SEQ ID NO: 113 - DNA, 24552 bp, Homo sapiens
caagagagagagagagcgtgcaagccccaaagcgagcgacatgtccctttggggagcagtccctctgcaccccagagtgaggaggacgcaggggtcagaggtggctacagggcaggcagaggaggcacctgtagggggtggtgggctggtggcccaggagaagtcaggaagggagcccagctggtgacaagagagcccagaggtgcctggggctgagtgtgagagcccggaagatttcagccatgcctcacagctccgacagcagtgactccagcttcagccgctctcctccccctggcaaacaggtagagtcctcctttttctctctcctaccttctgattctcctgggggatggaaagagagccaggcttccttgtcctgcccagggagctgaggatggaggaagtggctcgttgcacgggcactctgttagacttaggacatggaatttgctactaagctgtgcatattggcagagatcctcatccttccacccattctgccaaagcccctttttctctccattttccaaggctgcctatcacctctgcctcactggggttgccaccctaaaaagctttctaggaagcaaagaggaggatgaacatcaaagaatgcagagaaaagagtctactgttctccaaggctgtagaaaagtgagaggagttttcaagtgggccgctggcatgcacagctcaaatcctagatatgcagtttcccaggagacagccaatagggaaggggagaaaaggggttagggaaaagttaaaaaaaaaaaaaaagaagaagaagaagaggaagaaggaggaggaggaggagaaacccaggctagcatagaaggatctctctactggggcactgcctctgttgctagcacagccagcaaggggagatgctagaggtccagccaatatctctttgcttgtggcttctggataggagcaaggaaatgaatgaggaggtggctctggaaatttgttggaagacatttgctggtagttcatcttagctctggggaaaccagagagactgagatagggattgtgggagcatttggagtctagattgtgacttccaagtccaaaggttttagcttgaggattaccaaaaaaggagtgccctgcccatctcacagcttctagggttttgttctgcaccacactcttgacatcccttgctgtaggaagccctcctctttctcatccgacatgtatccgtgggttaaaattttctcaaccttcatagtttaaaaacttcattctttccttagcacagatatccacaagggttttcaaaatgctgcagccaaaataaaagtatataaatattgaacagggcgtatatcctaagcctctaataacggagcagcaggctgggatgagtctgggtggagacctctagaaggcacagaatccagtctgctgctcaagatggtgtcagagtggctctgactgcctggaagtttgtacttttcttaggaaggaaattactcatggcttccatggtaacctggtgccccatcccccttagaggaagagcacttccttcctatctatgccaatgacctcctaccacaaaggcctgaaagtattggacatgttggtgagcccagtacttagtgatcccagagctttgcccttggatctgtgcccctctagcctgtgggagacgtggaagggaacagggcatgagttgccaggactcctacacctacactgcagcatctgggagagaactggagctaacctctctgcccaggcacaggacatgcctctctctgggtgtaattagagaacacccaaagatccccttatcctaccaagcacccatctactgcccaccacagccaggtcacctccaccattaacgttctttttggcattgatgtgccaggcattgtgctggggccatggggaatgtcacagtggctgagcacaacggaaggaaagaggaggcagatctgggatgcaccctcagctcaggaatgcagcagaagaccacatggggtgcagagtagctagcggggaagggtcttggaaagccattgggctcagcaccagaagatgtagcactctcagatgaccaggagtccttgggcacactcttagagcctcagtttcctcacatataaaatggaaatgatgatatcaacttcacagcattggggaattaaacaagagcacttctgaaagaacacttgcccagaggttggcatatagtaggcactcaacaaagtctgaaaaaaagaaaacagctaaaagaacagcaagaagagcctaaaggccaaaaagtgagagggcgagggtggagcagccctacagaggagaggtgataaaacacacttcatcgccttaaccattttttttttttttggccaaatacagctctattgagtcctcaagttctcttttctttttcctgtagctattggtcaaaaaagtcagagacctgggaatgtgtaagcaggcatggagaagagctctccttcgggtgcaggcttttggtaaatagagggatggagggttcatgcagagacgaaggcatggaaggatggctggacggataccacacaccaccagagcctgctttcactcagaagggagatgcagacccatgtaatcctccccgtctctgcttcccaggactcatctgatgatgtgagaagagttcagaggagggagaaaaatcgtattgccgcccagaagagccgacagaggcagacacagaaggccgacaccctgcacctggtaagtgttcagatcaatcttcatcctcgtgagctttaggctttgccctccgccatctgggaacccttggaccatagctttgattctgcttgtgtggggatgtgtatgtggggtgggttagtggagggtgagggccgtggggtgaggtagggaagggaagctgtcgtgagagtgctttaagaaggctctgtagtccgggcgtggtggctcacacctgtaatcccagcattttgggaggccaaggcgggtgggtcacctgaggtcaggagttcgagaccagcctggccaacatggtgaaacctcgtctctactaaaaatacaaaaaattagccaggcatggtggtgcatgcctgtagtcccagctacttgggaggctgaggcaggagaatcacttgaacaggcagaggttgcagtgagccgagatcgcgccattgcattcaaacctgggtgataggagtgaaacttcatctcaaaaaaaaaaaaaaaaaaatagaaggctctgtagcagggaatgggccaggaggctgaacagagaaatgggcctttctaccccaggagggctcaaggggtgggagaaggcagagctgtattgggaaagaatttagaaggtatcaagtgctttggggacggcccattgtctcgcagtgcaaggaccacacatagtcgcatcccttggcagagacccaaatgcccctgcatttgacacaaggaaattcacagggcgctgtaccagattcctcttttcagagcattattaaagtcttattttgaaatttctgtctttaatggtatcccaaggggtctatgaaagatgcaatttcaagtgcccttatctgggatgatcaccatcctagttgagttgcctctagtcccaaatttttctagagaaagcttttacctctgtcttgagtggtccaggggccttgagcagtgctgaactgcagttccgccagtggccaaggccctagatggtgtttctaggttctggctgtgccccttataaagtactgcttcctccccattgctcataccttaccaccttacctctcttcactctgcccccagtatggttcttgttcaaccaactcttcactagttcctttctctccatcccctcatccccttccctagcaactctaccttcctgcccttgctccagaaacattcccttacctctaatagcctagcaattcctttccatggaaaaagtgcaattggcaccaaaaatcaataagcttgtatttatctggaagattagcatgataatcagccagttagaatggctgtgttaaccgtatcaagaataagtaagtaagatgtagttttaggggaaataatgcatctttcagctttacaaggaaacagagcagactgcaccaacagctctgattgggtgcttgggttttatttgaaatgtattcagcttacactccattgcacactaacattaaattcacagctatttgttaactttttggaaagaatgaatgaacagaaagtctgtactaactgtgctcaacagtctgaatgtcaagtttttggtggccctgctgcttgtatgttctccatgatttcactgtgtccccacattctggtttaccaccttaagcttgaacatctatgatccttacctctttctctatcagagtctgattctgattcactattctttagggcaagcaaacagaccaatcaaaatttaaaaggataaaatcttccttgtgtacaagtagacaatgtcctcagactggcaaactgctgtaagctttttaagtgtgtacctgttttcttaagtggaatgtaagtatagttcggcagctcagcagtcagaacagggattgaatcccagccctgctgcctactatctgtgtgacagagacgttcttggcctcccttgggcttggtttccttatctagaaaatggaaaatgacaataactaccctatacagatcgtacatttaaagagcccaacacaatgcctgtcattcataaatactcaaaaatttaagtataataagagtaataataattatcataagaagcaagataatcacaaattatacacacattttatatatatatgaaaacatatatacattttgtgtatatttaatcacagaagctcagggttgaaaggtttcttaaaggctagaaagtttagacataagtttgatgcttcagacttctctgcaacacctccagccaatggtcccattgtatgcctggtcacttctagggctggagatcttcctctctcccaatttatgaacagaagagtctttcctatgttaagctgcacccctgtctccctgtaaattcaactcactggtcttcatccaaacccttggggaacgtattaatgagggtgacacagatgtctctttgctgcggcaaggctttcagcactgaatcagctctctccctctccaagacaaatgtcagagcccaaagagtcagctcatctaattatacaagtcatgtgacattagggtaatctctagagcttgagggtccacagagccccaagtcatatagtcaacatatccatagccacaccccagcctcagtttctagaatgttccaatcttccccacatctgaacacagattcctcctccactgctttcttttgagcaccacagcatcgtctttaccttttgcccaatgagtaggtcgcagcggagttgatgcagcaagcctgcggactgctgccaatgcaacttatgtttcttggcttcaggtagaagcttttggcagcaacgtgttcaatctgccctacatcaaattagctgtggtttgacatcttcctttcctccgagatgacaatcacctatcttctccatccattatcctcttaattatgtctgagattcaggtgaaaagtcttctggtttaccaccagtgtcagggctcagtgtgtggtttgcccttgactcctttccatgcttggctccacatgctggggttgttctctggccctcagacatggccataggcctcgcctaccagtgctttacagatgagggtttgggagctactgagagtaccatatcaaaaaaggaccacattcctattagggttctagcctcatatatactggtatgttttcttagtttcaactgctgtcactattatcaaccttaaaatactgaaacaattatcttgttcctctagtgagagtgtgggatgcttactattcgacattttcagcatctatcctataaatggctggcaccaagacactgtacatcgattgctttaaaaattgacagagtagggagagagcctctttttatgattgtgttataaatccctggccttgactatctctgacataaaatggatcggtgattcctttcgtaattgtgacatcaacaaacaatctaattctgttttaattctccttttgttgagcatctcacacaagcaccctgcacacttagttccttttctcctgcagacaactgtagggttcattgtatatagtacagatgttgattaaaaaagagaaaggcataacttgaccagttagtttctaaaagatatcaatagctaataagtggacctaagataatcagctgaaaaattatttgaaataataagagaatgcagtcagcttctaaaattaaaacaaaatgtaataacgttcctatatgcaaaacataaccaattaggaaattaatggaaggaaagatcctgtttataataccaatgacaacagcaaatggaaggaaggaataatttaacaaaaattatgaagagtgtatcctaaatgatttttaaaagattcaaataattggaaagatataccttatgtaaagttagcaattttccttaagttaattgataaatttaatgagatcccaataaaaaacccaatagggttttctgggatttgggcaagaactagattagctattctaagtttccagtgaaaaaaaatcatatgacaattgccaggaaaattctaaagaagaagtataatgaaaaaagattaactgaccaacatattaaagtgaaacacaaatacagaaatcaaaacaatgtggaaaagacagaacattgaacaggatagaatatggaaacagacccaaaaacaaattcagattttaagacccaaatacatatttcaactcctaggacacaagtataaatacaaaatgggctgggcacggtggctcacgcttgtaatcctagcactttgggaggccaaggtgggcagatcacttgaagtcaggagttcgagaccagcctggccaacatggtaaatgttaaattttttaaaaaaaggaagctaaagaaacttgaaaagacaaataaccattaaaaatttatcttggaatgaggaattattttctaaataaaacataaaaccctgaagccataaaggaaaagattgatatacattacttttattcataaaaagtaaaagtttctttatagatcaaaatactgtatgcaaaatcaaaggcaaatgacaagctgaggaaaaatatctgtaatacatatgaccaaaaaaggtatgtttacttactatatgagagagctcttatgaataggagatgattaacaacccaaaagaaaaatgaacaatgggccgggcgcggcggctcacgccttaatcccagcaatttgggaggccgaggcgggcggatcacgaggtcagcagatcgagaccatcctggctaacacagtgaaaccccgtctctactaaaaatacaaaaaattagccaggcgtggtggcgggtgcctgtagtcccagctacttgagaggctgaggcaggagaatggcgtgaacccgggaggcggagcttgcagtgaaccaagatagcgccactgcactccagcctgggagacagagcgagactccgtcaaaaaaaaaaaaaaaaaagtaaagaaaaatgaacaatgactatgaataggcaatttacagaaaagagaaataagtggcaaataaatgtgtgaaaagatggtagaccttatttagttaggaaaatgccaattaaagcagcagtgaggctggcaaagatgaaacatgttgttgatacacgatgttgccaaggtaatggagaagcaggcaccatcacacacagctagtagtagagtctgcataaccctggtagaaggcaatttgcccacgtccattcaaattataggtgcacataccctgcgactcagcaatttgacatccaggagtgtgttcacaaacaaatccacacatcatacaattctgtacatgtaaagataatcattgctgcattgtttcttataggaaagactgaacataagctaaaaaaatccaccaataagggattcaataaattattgtccattctgtggaatattgcagatatgttaaaataatgagttacatctgaatgtgctaatctggaaggattatcacttctgtactttaagttaaaaaggcataaatatagtccatagtttgctaccattagttttttaatttaatgttttatttatttatttattttttatttttagagacagggtctcactatgttgcccaggctggtctcgaactcctgagctcaagtgatctgccctgcccaccttggcctcccaaagtgctgggattacaggtgtgagcaacagcacccagccccttctgtgtttttaataaaaagaaaaagttacatatatgcataagtataaatgcaaactttttcaaatagattataaaaaattgttaatgatatttatttctgaaaagtaggactaaagatctaaagcaagagggagatacttggcattctttaccttttatacagtttgggattttttatcacatgcttttatctttataatatagatatcaaaattctcagcattgatcattaccacacatgcattaggaggatttcttttctaattttgacatcaaacattgaataatcttccatcacgacatggaagagtattcaatcttgacgttatcttttgaacatcatacataaatatctcagcccttgggagaaccaactgtaagttgggatttgagtgactctaaggtccacagtactatatgataaaagatggcaaatccgtttcctttgtgtagccatcttggttggttggtcatggctatctggtgccgtacagctggaaggatttcaagtcaaagaccaggatcagtggaaaagagagctgaggtcaattaagaagctttattcatgaaaaggctaaaatcagtggagttgccgggagcagtggcaaatagcagtgttagccctgagccgagctgttgacaagtcatatctggcctggtggatggagctgaaagcaagtgagagtaacagccaagtttgaaagcttgagatttaggtactgtcttagatggaagtgggccaggtgcttgcctggggctgcctcctgaaggagtctcacaccagtataagaaaaaagagaggtttacaggctccagggatgtgctttgtcatatatgacagaaaagtcatgagtataaattatgcattaaatgaagctttgagctaacactgtgagaaatacggtatttacaattggagaaaaattgagtaatggaggaaaagatgtttgggtagcactattgttcttggccttctgaggaggcagagaaggatgcttacggtcctatttcactcctggaattcttttgctctctctgggagaccatgccataatgtttgttggcacagataagtcacaggtcaggaatgttcaggctagttccacccttaaaaagttcaatgtagaatcagtgaaccatctatggaaagagatgcgacccttctgtctccattgctatgaatttcttttaagaaaaaaccatgttaattgaacaaacgactatgtattaaccactgtgcctcaagtgctctccctgcagcatctcatttaatctgcataaaagctgtattttataattccttgcattaagtaacttgatggagatgacacagcttgtgactaggtctgtctgacgtcagaacccattttcctaaccattaagttttactgcctctttcttcaaactctgatgaagatgtattcatcttccctaacctatattttccttgaatctctacatgaattaatttttttgtcttttaagcaatatcctccaaaatctacactgtcccccagccatcatcaggcgtgatcaagaaagtaaagacatgtttactttcaatacagtatatccattgtacaattgatatcatatatgtcatatatatcatgatatcaacatatatagataggtactatatatagatagatacaattggtatatcaaatgatacaatatgtcaattgaaatcttttttgagaagtctgtgtagcaataaatgttaacatctttcacaggaattacctttgacacaacagagtttgaagaaaaaataatttacaaagatgcttagttcatcattatctgtgaatagtaaatactttaacaatgctataaaacttgacagggggcttacaacagaagatgaagcatattatgatacattcatacaataaaaaaatttatgctggtactaaaaatgattatgtagatctgtatttatcagcatagaaagatgtcagtgatacagcattaagtgaaaaaggcaaattacaaagagcatgcagagtataaccctttcacgtaaaatttgtgggttttgggcatggtcgcatgcataaagagatatccggaaggatattctccaaaatgctaatagcagttatgagtggttgagtttgggtagttcatcttattcttggtacttttctctcttttttattataatgaatgtgtgccattttaaaaatcagaattttaaaaattaggctattttcatttggggagggaaaacacatcaaggaaatccaccacccctaactgcttgtcttaccgatgacgggtcggcatggctaagtttgggaggcatattggaaattgggagtccagctccatgctggtgttgatgctgtaaagaacgactgtttgggaggccaaggtgggcagatcatgaggtcaggagactgagaccatcctggccaacacagtgaaaccctgtctctactaaaaatgcaaaaaattagccaggcgtggtggcgggcgcctgtagtcccagctactcgggaggatgaggcaggagaacggcatgaacctgggaggcggagcttgcagtgagctgagatcacaccactgcactccagccaaggcaacagagtgagactccgtctcaaaaaaaaaaaaaaaaaaagaatgactgtctgtctacataggatgatggtcctaggtcacaaactgacagctgcctgttcagcagatgtcttgatggagctattctcagcagcacccagacttccttctcttgagcagaatgggagtctccccagagtgcccttgtgcaagcttctcagaggttttcttactcccctcttttgaacttagtctagtcccctgcttcctaggaggggtgggttgggtccacagtataaaggccccttcagattgtgggatatctgtagagggttccactacgggttcacatgatggcttgtggagggaataacaatcataatagtcatactaccttgttgataaaatttcagaattaagtgggaactcagagatcttctagggtgacttgccacatttccaatgaggaaactgaggacgcccaagaacccaaacctcttgccttcccaccagtctgcttttgtttcatgccactttgctgaacagagctttactaggcaggtgtttacataaggcctattgcaaaggtgggccaagaagcaggccattaaccagaacacttgaactgcctagacactcatcagctccagaacatacggctatacatgagaccagaaagagagtgagtccaaacttgacaggggctgaagtgtaaatgtttctttgtttaaagagattttaaagttgtaatccaaaattagaaagggcagtgacatattggggaaaatatttgcatcaaattaaagaaatgaaggtttaatatttatgctacagaaagaaactcttataaagcaaaacatcaggactccaatagacaagtgggcagaggcaatgaacagaaagcttacataatatttttcctaccaaaatgaaaataccctaatttcctattctgattatgaaaacgatacacactaaggcagggtttctcaaccccagtggaactgatacttcgagtccgataattctttgttgttggggattgtcctgtgccttgtaaaatgtaaaatttacccacaagatgccagtagaacaccccctcaccctgcttagtttgataaccaaaaatatttccagaacttgctaaatgtccctggaaaggcaaaatcagtcctagttgagaacgctacactaaggagaaagacacatggaaagttgttctttctccttaatacttgacaacctgtaacattaacatgaaattaagaagccttcatcaagctaattggcaacaagtaaattatttaaaattataacacctaaatgccagtgaggttgtagtgaaatggatagaagcattcgctagtggtgacattatatacttgatatgaccccttttcagtaatacttctcaggactgggaagattgaatgcctcctttgcctcattcatttcattcctaggaatttctccaaggaaatcactgaacagagacaaaacccagtgtgcatcacgatgttcatctcagcattatttttaatagtgacaatttgatagcaaccaagatgtccagcattagaagaccactttaagtaaattgtggataatcaatttgatgatgcagtcattaaaaattatgttgactatgtagatgtgacaaagttatgacagaaagcaaaatacaaattgtatgtgtactatgattgaaattttgtaaaaataagtatgcatgtttgttcaaaaggatgagatggccaagtgggatggttcatgcctgtaatcccaatacatacggaggccaaggcaggaggatgacttgagaccaagctgggcaacagagtgagatcctgtctctacaaaatataaaaataaaaataaaaataattagccaggcgtggtagcttgcacccagctactttagaggctgaggtgggaagatcacttgagcccaggaggttgaggctgcagtgagccctgattacatcactgcactctggactgggtaatagagtgagaccctgtgtcaacaaaaaggatgagatctcaatatgtgtaaatgaaaacagctgtattaagggactaggatcatgggcgtttttaacttttaaaaaatatctttaatgtagttatactgtatttttttatttttaaagaaacagaagaaaatggccaaatagagagctgaaggaactctggaggacatcaagtacaaagagacaatattactgagctcgaatttggggatcaggttttggtaggagaccttataatttataccccaaataggaatacttcgagagtggaagatggaacttgtaaatattacaccaggaaaacaggtgtcccagtaaatgtctggtcaccctagacagggaaaccaagaaagatgacatgaagctcttatgaaaactcagaagtgataaagttcagagtcaagtagaggggactggattcctatgaccaaaatgtgatttcctgcaactgaggaccctgtaactaaaaaagggtactcagctggcataagaatatgtcttatcattaagagagtaggatgacacagaaaattataaagcaaaggccatattatcagtactagagctgagatcagcggaagtgattcatctactcaacaaatatttatcagccaggaacagttcgttctaggcactgagaatattgcagggacaggacagacagagtctctgatttcacgaaccttacagtcagttggaagtcaggctggaaaacaaataaacacactaatcacatgacatgtaaagtgcttcaaagaagatgaaatcatgcaatgtggaaagtgtctaagggacgggattggggcagcgatcaggggaggccttcctgaggccctggaatttgagatcaaaggtgaatcaaagaggagactggaaagatctggggagagggtgatctcagcctagagagccttgaggccaagctgcgaggccaggcaaaggtcagaaaggtgcttggtaaggtggagaccaagttcaagaccataagggagtgaggaggaactcagtaataatggcaattgtagggctgagcacagtggctcacacctgtaatcccagcactttgggaggccgagttggttggatcatttgaggccaggagttcgagaccagcctgagcaacacagtgaaaccccatctctacaaaaaaaaattttttttaaatatccaggcatgcacctatggtcccacctacttgggaggctgaggcgggagatttgcttaagtccaagaggtcgaggttgcagtgagttgtgatagcaccactgcactccagcctgggcaacagggcaagatcctgtctttaaaataaaataaaataaaataaaataaaataaaataaaggcaattgtgctgctaggagcaggaactggatggggcatgtggtggggacccaactaattcaaaccctgcctgggggatttctctgaacctaaactctgatcataagttgagaagcaatagcacctcactaggctgtttgaccgtttaattgagagggcaaatgtaagaacaaagcaatattgtcattttttttttacactgttcctttgtttaatgcagacagcctgcccttttcctagaaatcaatcagatatattatcctacatgaacacacacgttcttctttctggttgcttataaactctttaaggatatcagtagtttcaggggcttggcctttcacaactaggcaagtctcctttgttgggtatgaatggagagagggtcaaatttgaactagggaaatggcacgacgaagttcttaaagtggttgtaattctgccactcccacgctgttggttcagtttggggaataaacagaggtttgacctaggccttttgaaaaaatgaatctcttggattcatttggaagtatcccagatttacaaagtagaagctattaaagtgtttgagtggtggttaatcactctctaggaattctcatggacatcacagatttactcagctgacccttcttcataggcacatctcagattttggaaaattattccagattataagttggcagtcaagcaacgtgatttgatcgaacacttactctatggcaggcactgtccttgtcactgagaacaaaacagtgaagacaataatagctcctgccctcacagagctcaacaatgtaaatggtaaggaaacgaaacggttaaagttataattaatgaaacacgaatagatccctgagctcttgcctttccattatatgaatgaactgtgctggactatttagaattgtttccaccaatttaagaatataatagtagtgtgcttaaatggacattttgttttagaaatttttttaactagaaatagtctcccaactctttaaattttttaatattatactataaatgataaaataaaatacatatttaataaaatgaaaatatgtaaaaatataaactctttaaggatatcagtagtttcaggggcttggcctttcacaactgggcaagtctcacaaatttaatttgtttgttaacaaacaaatttaataaaatcaaacactatatagttatgttatatttttattattttgagataaggtttcactcttttcccaggctggagtgcagtggtgcgatcatggctgactgcagcctccacctcccaggcacaaatgatcctcccaccttggcctcccaaatagctgggactacaggtgtgtgccactatgcctggttaacttttaaattttttgtaaagattgggtatcactatgttgcccaggctggtctcaaacttccgggctcaaatgaccctcctgccaaagaagcctcccaaagtgctaggattacagcaactgcacctggccttatgttattattaaaaggaatccactatgaacatgattttttgcccatttggctcacttaggaagcatttttaaagtcttgatgcctgcaaccactccagaacaattaaattggaacctctgggggtctggcatccaggaatccagactgtttaaggctctccgggtgctggcagtgtgcacagccagggttgagaatcagaagcagtacatttgcagcctatcaggtctgtacctgaatatgtggagtgagtagaatgtgtggagtgagcagaatgtgtggagtgagtgtggggcaattgtgtgggtaagtacacagatactctgtcacatacagtggcctgatggcttaaaacaaaacaaacggccaggtgcggtggctcacgcctgtaatcccaacactttgggagcccgaggcgggtggatcacgaggtcaggagatcgagaccatcctggctaacacggtgaaaccatgtctctactaaaaatacaaaaaattagccgggcatggtggcgggtgcccgtagtcccagctactagggaggctgaggcaggagaatggcatgaacccgggaggcggagcttgcaatgagccgagatcgtgccactgcactccagcctgggcgacagagcgagacacggtctcaaaaaacaaacaaacaaacaaacaaactattcaaacccttgctttgatggcagttattatttgttttgttgtttggttttgaacattgataatcttgctagtggtaacctttgtaactcgaagcatcagtatcagccaagattgcatgcattcagagacaagtgagagaccagccatcaaatgaggaatcaacaaatcatggcctacttttctcatgtaacaagaagttcaaaagtggagagaccaggctacagcaaggaagaaccaagctccttctctctaagcagccatcctcagtatgaggctttcattctctaggctgtgagatgggtgccgagcctctcggcatcagtctatgttgaaggaaggaagcctttgtccttatgagcaggctgtgcctttttggtaggaagggaagctctgccttcacctccctcccgcccatcaggtacttctgcttacgtatctttggtcagaattctgtcacatggctacccctagctacaaggtaaggtaagctggaatttttttttttttttttttttttttttagcaattcttttcccagtctttctagaggaaggcaaggcagaaggggtttgggatggacgctgaatgaaccaaactatagtttttttcacatttgagggcaatgaaatcatagtcttgaaaaccaaggaccaggcgatagccttttcaccctgtgactagacaggtccctgagggcacggctgatgtggccaatcttctgtaaatgcaaaggtgcttatggccctagagcttcagctctaagacatgaaagtgaaggttcctccagaatcacacacgtgcattattcagcgcaaagatctgtggtttggtgattcttcttctcctttcataaggtgagaggcagcagttggggtgaatttccccaggaatggtgggagatgtgggcctagatcctcccgctgcttgggaagagtcgtacttttcagttggaagcctgctccaggaatggcgggctccaccctctgcatgtgacgtacaggggctggtaactgatggagcctgaacatatatctgggtgtgagggataagcttcgaacgccacttaagtgtaggtgggagccaaaaggtcaccctgccaatacatgattacatgtcctgttgaggagaaaatacacagggactattttcacccttctggaaattgtgattagaaaatgcaaggagaaggccaagacactaaactggagctggtagggaggaagcctcagccctgctcagggtgcctggacagtccccaccagggcccagctaggaaatgccagccttgtccttggtcttcgtccctaatggctcccggcgggtgagggaactgcctggggattccccatcgttgaagcgctctgtgagtgaccccctcctaagcccctccagtaggggatttcccagaatgttcccacgcccccaggaagcctcttccttagccacccccaagctgcttgcggttcatggtagaggtaggtggcatcaaatgaccccacaggtgagggatttgcctgaggtgggaaaagagggaagataaaattggaaagccaccggggctgaggaattatctcataggagagaactgtcaaacagtataacgtttaaacagactttaaaggcaagaaaggatggagggcacagactctgaagccagagtgcctcaattcaagtaccggtgctgcaacttccaagctgcgtgatcttgagccagtgacttaacttctctgttcctctgtttttcctcttctgtaaaacggagataatattttctaccacacaagtttgttgaaaatatcaaatgtaatgataaccataaaatacttaaaagagtgattggcacacggaagtattcaataaatgttagttattggccaggcatggatgattcacgcctgaaatcccagaactttgggaggctgaggcaggcggatcacttgcggtcagaagttcaaaaccagcctggccaacatggtgaaaccccgtctctactagaaatacaaaaagttagccaagtgtattggcgggcacctgtaaccccagctacccagaaggctgaggtggggagaattgcttgaaccagggaggcagaggttgcggtgagctgagattgcaccactgcactcccagtctgggcaacagagagagactctgtctcaaaaattaaataaacaaataaatgatagttaagttaacctaggctatttttttaaaaaaattttggtttctatccacctttttcgtataaattgagccaggttacaccttagacctattagatcagaatcaggcatcaggattgctaaagctccccaggggaccccagtgtgtggatgaggttgagaatcattgttttggtccagtctttccattttaaagtgaggcaactggagctgaatagggaaatcgagtcactgaggatcacccagccaggaccagggcccaagttcctattcccatttaccgctgatggagctcaccgtggtcatgagttcaggacctggctctgtgtctggaggaaggtctggcctcgagtcagcccttgtccagaatatctggccaggtgaccccctctccatgcagcccaggaggcagatggtcagctctatgattggaagaatgtgagtgactcagggatcttgtgttgtgttgtgttgtgtgtgggtcaccaaaaccgagacccagctttctcctgggagacaacagggtagccaaggacttatttttttgttttgttttgttttgttttttgagacagagtcttgctgggttgcccaggctgaactacaatggtaaaatcttggctcactgcaacttctgcctcccaggttcaagtgattctcctgcctcagcctccggagttgctgggactacaggcatgcgccaccacgcccggctaatttttgtattttttgtagagacagggcttcaccatgctggccaggctggtcttgaattcctgacctcaagtgatctgcccacctcagcctcccaaagtgctgggattacaggcgtgagccacagcacctggccaactttctagtgttctcgggagacctttgcccactcaagtctccagtctctcgggggaagcagtcagtgtgagagaaggaacacagggccccgagccaagccctgctctgcgcctccctcgcgggcaatgagtctttgcatcaaacactcaaagtttctgaacttctgagaaaacaagtgccttgaggtgaatcctatagcacagctgtcaccagcctgtggtcattttggagggtatgtggcataggtttgtcccagggtctcagttgtcctcatctgtagagtggggataataacagctgaccttccctatcccacacagagcgttattgtgaggagtctgatggacctggatgaattctgaataggagaaagatgggtacatggatgcccaaatgcaggctcacccccacccctctcagtagcagaagacatgcatatgggagaagctgcatttcctcccagcctcactgtgctctaggtgtccagccctcattgttaggggatgtcactgttgtacctctggataaacagctgctctcatgccacctttgccagttgtcccttcagctgggcgagccctttccagggcatgactgccccaaggagggccagaggggactgggcaatagcagggacatggagggacgaggccccagatcagccacttcctcctgcaagggaagtcaaaccctttctctcataagtgtcaggctggctgcacggtccctgggctggcagggcaggtttcttgggggccctagcaggaagcactcttgcttcccaaggtaaagacaagtttcttatcactggcggtggttttctggttagaggcagcaggcagcggttacaaactttgcctagagctctgggatctgcaagccagggagggggaggcagacgacagagctagagtgagctcagcagagcttgcttagggaggaaggacccgctgtcacttcccgaaagctgggccagcctctaggcggggagaaggtcagagtggccctcccttctgcctcggggtttgcccaggctcttcagagcacagaatttacagtaaatgttgtcaccagtggaaactctcagagggggcgaagaaaagggctagaggaaggagccaggactcccggcccccagttcccgtcttaccaacaccccctagtctcatcgtgttgcttgatcttacctttcggtaaagaggggatgccctccttctgggatgtgccaggaaatacccaaatggtaaaatgaatgagccggccacaccttgcagaaggcagggctgtgactccatcatcgtggctcttgataactcctctgccccgttttagaggggcttcctttgtactgaccttggcacactttctagctcagagccccattcaagaaatgccaggttgaggctgagcatgcttgtgtctgtccttcacagatgatggaacctggcttgatgagcaaggccatgttggtatatgcttctctgccatttagaaagaccccccccaggatgtggggtttaagatgattgacagtataaccgattaacctcattagcctacagctcatgcacctgatggattcgttagggcaaattttattttattattttattttattttttgagagaggacctcactccatcagtgaggctggagtgcagtggcatgatcatggctcactgcagcctccaacccctggtgctccatagctaattttcttttatttttattattgtagatactgggtctcaataatgttgcacaggctggtcttaaactcctgggctctcaggaggtagaggttgcagtgagctgagatcgcaccattgtactccagcctgggagacagagcaagactgtctcaaaaaaaaaaacccaaaaaaccaaaaaactgctgggctcaagcgatcctctcacctcggcctcccaaagtgctgggattataggtgtgagccactgcacccagcctatttagggcaaattttaaatgtcaagttatcttacatctgctcaccacccaccctatttttgagttaccttcttcattccagcagatgatgtcataagtctgtcagtcaacaaacatctgagttcatactatgtgccaggcattgagccaggcattaacaaataggcatttaataagtgcttgaataattaaaacaaatttaaaataatatttaactagtgctttccaacttgcctgatcattagaatgacctgtggcactagttaaaaatccaaatttcactccctagtagtctagtggctaggatttaaaaaaaaaattattattatttttttaattcagctctgcagccaggcatggtggctcacgcctgtaatcccagcactttgggagaccaaggtgggcagatcccctgaggtcaggagttcaagaccagcctggccaacatggtgaaaccccgtctctactaaaaatacaaaaactagccaggcgtggtggtgcctgcctgtaatcccagcaactcgggaggttgaggcaggagaactgcttgaacctgggaggcagaggttgcagtgagccaagatcacactactgcactccagcctgggtgacagagtgagactgtctcaaaaaaaaaaaaaaaaaaaaaaaaattcagatctgcagacttcactccgcaaatcccaaaaccactgattcacattcctagattttaggatgggcctgaaattctattcttaacaagccttcaaattaattctcatgatatggcaagtttgggaaatactgacctaatccaaatagatttagaaaggtaagacctggtctccaaatatcaggttgccttttgaactgaaattttttttttttttttttttttgcatctccaatgatatttgcctttcctctgtggttaccaatgcttagcagagaaagtctgtttggttgagtcgaataatgtaaaccttaaaattataccggaattgcgatctcctgggctttctgaggatgggattgcttttccataattgctaattaccagattgcaattgttgattaattaatgatgtgatcagaaatcagcacttcttagcaggcatttttctgattagcatgtatttgatggttcccccaagcaacagggaaaagagtttccagaaaaaagagaagctcacaggcttgggacacccccaaaataccgtcagaatgctttctggtaggccggacagggtggaacaaaacgttgtagcagactttgaccatttagtatttatttatttcatttttatttttatttttatttttgagatggagtcttgctttgtcacccaggctggagtgcagtggcatgatctcggctcactgcagcctctgcctcctgggtttcagcaattctcttccccgagcctcccgggtagctgggattacaggtgtgcaccaccacgcctggttaatttttttttttttttttttttgtatttttagagacagggtttcaccatgttggccaggctggtctcgaactcctgacttcaggtgatccacccacctccgcctcccaaaatgctaggattataggcatgagccaccgcacctggccccatttactatttataaagaccctgagcattctagaatctgggtgcagtagacaagtatccagtgactttatttgtaagacgaaatgcagacaccgggagcttttggaaaacacgtggcataacacagtggaaaagagtgaaactggtgtaagacgttctcacaaacgaccttccatttccttaggctctggcctgccagctgctttcccttgctgtattcccgccacctcccacccacacaccctcacagagacccctacatgcatacacgcagaggaacacactcacacacacccctctatcaggttgaaccatatgaaattgcttttttgccgggaggagagatgtagtcttgctgtgttgcccaggctggagtgcagtggctcaatctcggctcactgcaacctctgcctccctggttcaagtaatgcttctgtttcagcctcctgagtagctgggactacaggcgcactgccacacccagctaatttctgtttttgtattttagtagagacagggttttgccacgttgcccaggctggtctcaaactccccacctcaggcaatccgcccgcctcggcctcctaaagggctaggattacaggggtaagccaccgcgcccggcctgaaattgctattcttataggtcacaacagacaaatatcagcagcttcacgtggttcagcctcatatctatgtgtatacatgcacacccacccatgtgcttacgtaaacgcgcccatacacacctacaaacatatatacacttgtgcacacattcacacgtgcaggaaaattctctggtgcccttctccatggctgtgctagtgaacaactaatctggcccctcctgtgtccctccgcaccccacccaccttgcctccttcctagacactaacctccggtgctgatccccacccctacaggagagcgaagacctggagaaacagaacgcggctctacgcaaggagatcaagcagctcacagaggaactgaagtacttcacgtcggtgctgaacagccacgagcccctgtgctcggtgctggccgccagcacgccctcgccccccgaggtggtgtacagcgcccacgcattccaccaacctcatgtcagctccccgcgcttccagccctgagcttccgatgcggggagagcagagcctcgggaggggcacacagactgtggcagagctgcgcccatcccgcagaggcccctgtccacctggagacccggagacagaggcctggacaaggagtgaacacgggaactgtcacgactggaagggcgtgaggcctcccagcagtgccgcagcgtttcgaggggcgtgtgctggaccccaccactgtgggttgcaggcccaatgcagaagagtattaagaaagatgctcaagtcccatggcacagagcaaggcgggcagggaacggttatttttctaaataaatgctttaaaagaaa

(The sequence listing continues in the following parts.)

What is claimed is:

1. A method of treating a cancer in a subject in need thereof, the method comprising:
   contacting a population of immune cells ex vivo with a population of engineered adeno-associated virus (AAV) particles comprising:
   a) an engineered capsid that comprises a VP1, a VP2, and a VP3 polypeptide, wherein at least two of said VP1, VP2, and VP3 polypeptides comprise sequences from a VP protein of a first AAV serotype, and at least one of said VP1, VP2, and VP3 polypeptides comprises a sequence from a VP protein of a second AAV serotype, wherein said first AAV serotype and said second AAV serotype are different, wherein said first AAV serotype or said second AAV serotype is AAV6; and
   b) a nucleic acid sequence comprising a transgene that encodes an exogenous T cell receptor or an exogenous chimeric antigen receptor that binds a neoantigen specific for said cancer in said subject:
   thereby generating a population of engineered immune cells expressing said exogenous T cell receptor or said exogenous chimeric antigen receptor; and
   administering said engineered immune cells to said subject, thereby treating said cancer in said subject.

2. The method of claim 1, further comprising disrupting an immune checkpoint gene in said population of immune cells or said population of engineered immune cells ex vivo prior to administering said engineered immune cells to said subject.

3. The method of claim 2, wherein said immune checkpoint gene is a cytokine inducible SH2-containing protein (CISH) gene.

4. The method of claim 1, wherein said population of immune cells comprises T cells, B cells, NK cells, TILs, or any combination thereof.

5. The method of claim 1, wherein said population of immune cells comprises T cells.

6. The method of claim 1, wherein said population of immune cells comprises NK cells.

7. The method of claim 1, wherein said first AAV serotype and said second AAV serotype, respectively, are selected from the group consisting of: AAV4 and AAV6, AAV5 and AAV6, AAV11 and AAV6, AAV12 and AAV6, AAV6 and AAV5, AAV6 and AAV4, AAV6 and AAV11, and AAV6 and AAV12.

8. The method of claim 1, wherein said first AAV serotype is AAV12 and said second AAV serotype is AAV6.

9. The method of claim 1, wherein another of said first AAV serotype or said second AAV serotype is selected from the group consisting of: AAV4, AAV5, AAV11, and AAV12.

10. The method of claim 1, wherein said VP1 polypeptide comprises a first sequence from a VP1 protein of said first AAV serotype and a second sequence from a VP1 protein of said second AAV serotype.

11. The method of claim 1, wherein said VP3 polypeptide comprises a sequence from a VP3 protein of said AAV6.

12. The method of claim 1, wherein said VP1 and VP2 polypeptides comprise sequences from said first AAV serotype, and said VP3 polypeptide comprises a sequence from said second AAV serotype.

13. The method of claim 1, wherein said population of engineered AAV particles further comprises an ITR sequence from a third AAV serotype, wherein said third AAV serotype is different from said first AAV serotype or said second AAV serotype.

14. The method of claim 11, wherein said third AAV serotype is AAV2.

15. The method of claim 2, wherein said disrupting comprises using a CRISPR-associated (Cas) protein.

16. The method of claim 13, wherein said Cas protein is a Cas9 protein.

17. The method of claim 1, wherein said transgene encodes said exogenous T cell receptor.

18. The method of claim 1, wherein said transgene encodes said exogenous chimeric antigen receptor.

19. The method of claim 1, wherein said population of immune cells is contacted with said population of engineered AAV particles at concentration of less than or equal to about $1 \times 10^6$ GC/mL.

20. The method of claim 1, wherein said neoantigen is encoded by a gene selected from the group consisting of: phosphatidylinositol-4,5-bisphosphate 3-kinase (PIK3), Kirsten rat sarcoma (KRAS), Erbb2 interacting protein (ERBB2IP), and any combination thereof.

* * * * *